United States Patent 9,567,581 (SELECTIVE REACTIVATION OF GENES ON THE INACTIVE X CHROMOSOME) - sequence listing, part 58

SEQ ID NO: 5898 - DNA, 571258 bp, human
atgagtggaaaggtgaccaagcccaaagaggagaaagatgcttctaagggtaagcccgcccgccgagtccgcctgctttcctttccttcgtttccctcgccccctcgcgtgcgcgccgccctccggcggctccttgcctccttcccggagcctaagctgcccatgacctctgcgaccccgggagaaaagggggggcagaggtcgctagggggtggatctaggtttgcaccactttccctccttcctcgcggaattgtcgaccctcgagtgcctccagcctcctccacttcccctctggacgcacggtggtggcgctgcgggcagacgaagctgctgcagcctggagcgccgggaaccgcgctgtctgctgacagccggccgcctgtctgtatgagtgcatgtgtgtgcgtgtgcgcgagtgtgcatatgtgtgctgcgcgcgtgcaacatggtgacatactcaggaatctgccctgctgtcagaacccaagcttgaacccaccttcagccccctctccccgcccccaatgcaaacaaagagcctggtcgagacgcagaacccctcccccctcctttcccaccacctccttccccccccccgccacccgacacctcctaatcctaaactccttatccaccccaaccctccgggaaggcaggagtttgcacccttcgacacgccgcgtgcaaaggtgagcaaccctggtgccctggcgccgcccgcgctgcgctttggcagcgcagcctcgccaagccccaggagaacaaaggctgatgtccccttgtcactagtgcccagcgtgagtgggcctccgcgggagggggcagtcctcttcctctgtttgctggggttcagccaccgcgcccggggcacccgaccactggtccccctggagtgcgcgcctctgcccagggcctcccatcggcgggttggggaggcgcagcaaagcggtgctcaggctggggagaactaaggcaaaggcaggggacgcccccccaccctttgccggttctagccgttgcctttctcaggaccgggattagctccagaatgtaaactggagacagcagccttggagaccggggtgcggagaggcacagagagggaatatggaagagcagtggggaacagcaggtgccttaggtgcaagtgtccgaatggccacggagcagacgctggagtgggctggactagccctgagggccccaagcacactggaccgcagcgacccacgccgagtccccactgcagaagtgaggttgcagcgcagggagtcccagcttttgttcatgggggccccagttccttcctgagccctcaggcccccttcactcccactcctttctctattccttgttctcctctcctccttctcgcctctccccatctctcagagctttctttcccgggagattctagggcagcaccagccctcccccgcggaaagttgtcaaagtcttcagctcaaggcctttatccttgtttctaagtggagccatttctcccccaaataggcgaaagggtgactgaaggttccggaagtttgtggaggggttagatccgttgtcatacgggtcattgttgcccccggtctggctcaaggctagcattcaatcccaagtgaaagagtaactttggaaagtagaacgacagctgtaggtttccagagctcccctaattgttgagtctcaaacaggcatttatatgataaaggaaaatgacttcagggtcattaaatcgttttgttttccactgagggcccagagaagtaaatgtaattaaagaatgtagcaccagattgatctaggcacgtcattcccctgttgaatctgggagtatttctcgtttgtttctggaactttggttcctgatttccatcaggtggttacttcaggtttatttcaggctaccgttgggagaccctgaaaccaaattcattcacagaaaatgagtttctgttctgtttataatttgcagttgtccagaatggattaacgcatctggaaacaggacaggtttctgtaattcaataatacaaatttgtactaggcatgtgtcataacattttcttgtgttgactcaccacatttgaaaccacatacctctgtaggaattgagtaattagcacttgaaattatggctgtaattagaataaattaattttacaaggcaacttttaagaagggagtttacttccccgagaagatgggaagcttttggctgctaagagcaagattgccatttcagcctttctgttcgttgttgaatttagagcattttcaaaatattaagtgtgtagtagccattagtattttcttctttcaagtatatgaaaagtcttatgtgaccaaattttaaagactactttttatattagagatgaaaggtacaaggtctacttatcttttaatcaatagagtttatatatgttgaccatatttctgaagagttttccttacttacaaatttcctatatataggtcatctttaatttttttaagctgaaaaactaattggcatattctttgtaacatagcaagatataggatcaagcatttcatagataccttgaatatacacacatttaattttgaacaatggtgtgacagatgattggatgaaatcaaataatttagtaacagtttgaatgaatttcataatctgttttcagagtctactgctcatttaaattcagcctcccacccccatcagttagggctcatacccacagtgtatcataactacatcaattattatagagtacagtgtttccagagcttttaaagcacaggtagtaggtttccagtaaattattttgtgctgctgaatgaaatatggccttaagagtacataaattgctgattgtctttttaaatgacattttcttcaactcactgaggttaagaccagtgatggacactgatctttttcataaccttttcaaaaatgtagccagacaagataggctgttctgtttggaaagggggcggggaccttgattctgtttgaaactattaaaaaggcctcttgtgcagccagtcgccttttgtgtatttatttatgctttgtataaactttaaaattggcagatgtgtatatagtttgagtcacgcggctcttggaccggaggatctgtttccatttcagggaagaagaaagcataatatttgtttgttcaagcagatattctcttagctttgactcactcttctctaccttgtcacataagatcttttcagcagtcttctgttggaaaagcactcagttaaggctgtttctggtttgttgcaacagttttcctgtggcatcggaaatcttgtaggctgctatagataaaaccaaatcttttttggattaagtaaaaatgctagctaattctcgctttcaaaactgtctttaggtttgtggctacatgtttggagttgggtgtgttcttttcaacaaccctttcctttgtgcttagcttaacagccaccatatccaggcaagtttcaaggctctgtgggctgtgggttctcttggtgagacagcactgttgtcaggctgggctcatgctggctgctggacaatggaggacaattccatgcatagcccaagaagccagccacttgtacagctgctgttgtaatgggtagtagtggccccatgcatttacaccacagttcgttttttgttcacttcctggccctttccaatagtctttctatcctatcctactgaagaaggacaggtcactgtggtcatgcagccagcatatctaggcttgagtcctgaatgccttccaaaagatcatcttgatcattgtggtttactataataggtttcatcaagtgtctttctcagacttgggccaggcaaaagcagatgtttagaggtattttaccgacaagaaattatgaggttggtgacctcttattaagaagtaacagtgatcatctgtctattactcatgtagggacttgtttttttcactctgacatcatggtcccatggttttacatacagtgtcataagccacacggtcttttctgtgctgaaggaggtgatcatagccttgctaaggaggtgtgaccagggagatctctaatcagaaatattggtctgttcttggggataggtggagaaaatgagtgcacattatacccaaatcctcttcataattatttgtagcagcgtgtagcttctttattgacaaaggctaaagctagaagggggagcaagttgaggcatgggttaggggtactgtatcttttctctagcttagtactgcttcctctaagcctcttttcagcacagttcaaataatttaaagggcttagtatgtgtcctaggtctggagatgtgggtgaggttggagtgggaatggatgttgaattggggcctgggtaagaagcagagggtgagctgtggggcgaaggaaggagttgaggtctatgcccacagcagggagattttatgggtggctttgaggacagggtcaggactggggagagaattggaatcagggagagaatttgaatcagaattggataagccagagggctgatttgtaaggcggtaagtaaggatatgaaacagcgttccaggtctctttgcagctgtgctgttttatgtccaaatcaacttcttattctgggaattacaatcaacatagaacaaccagaatgtgttgcagttcttcaaatatatccaataaaaaggctttctagtgtctgcttcagtatgacttatatttttggagttgagaaatttgaaaagaatggacaataattgtcaagattaagcaattgaaggaggggggaaaaaccatgtgcattagagtagatgaaggggatcctacatgtctattaccttgctcagctaaacattatctttgaaatgtgaagactaggcacataatatagttttagcaattagtacagaacacaaatgtctgcataactcattttctgcagtcactgatttatgtttccctatcaagaagacacatcatcaccatgatatatcagcacaggctgaagagtggatttcaggctcattgtcctgtgtaatgtgggtcatcttagttagttttcatcaacttgaaatgtaggttatctatttgtaatataccagctctacaaacttagttgaatcttatttctgacattttttaacatggcattttatcacttttttgaatgtcatatattgatgaaacatttcctaagagtgtgggtttcccggtaaatgcattaatttcctaaagaagtgaaataatatttagtagtcattatgaccaccactccaggccttagatccgatttctccttgaattggatggccatttttttcctttaaagcagtgttttccagagtattaattctgaaaatggtgggggaggggttattagaaaagaaataaattcttgattcttagggcacaatggatatatgaaggactattaagggatctgagttgtaataaatattaagtctaaattacaatgactgtttattgtgattactgtaaagcagttctcatggctgatcttgcctctgccctttgaaattacttttagcattgattttcaaatagaaatagtactagtgtcacgggctaatgaccttccccacaggcaaaggcttctgctggtgtagggttgtggttgacattctagggagtacagtagggctgtccagagctaagttgcttgcttggcctgcctgcagagacatcagatttggtctggacaatcactctttggcctaaaggaatccctagttgtatatgtctgtcctttattttgtggttcctgtaagtagggctgggaagaaagaaaagaatcttctggtgaaaggcaggccagtcaaaggccaaattagaaaagaaaaacagtaaaactcaatttcctttttttgtaattgaaatttacctgtagtaacatgtacagatcttaagtgtgcatctcaatgatttttgagaaatatttacatccgtaaaatcaacaccaaagtcaagatacagaacattcttgtcaccccagaaagttctttcatgcccttttctagtcattcccctcacctaaagacaactcttattttattctttttttttttttttttttttttttgaggtagggtctcaatctgtcacccagactggagtgcagtggcacaatctccgctcactgcaacctccgcctcccaggttcaagtgattctcctgccccagccttcctagtagctgggattacaggcacacgccaccaccgcccggccaattttttgtatttttagtagagatggggtttcaccatgttggccaagctggtcttgaactcctgacctcaaacgatccacccgcctcggcctcccaaagtgctgggattacaggcgtgagccactgcacctggcctcctatttttatttctatcatcatctattagtttttcctgtatgcactctttggtttctgacacacctagccacctccccatccaacactcttcatcccctgttgataacccttcttgtcttgtcctctggtttcttggaagactcccaccgtgccccacactggggcattcaatagaatcttagacatggttagtcttctaggagtagttgttgaatgacctgggaaagatagggaaatcctttaagcagaggtatgtttcattcatcctttaatagcaaataacaataatgaacattgctgtctttataatagtagcctctaaattattgagcagttactatttactaggcaaacattatttttacatatatctaatttaatcctgacagccaaatgaagtacagtagctcttagtacatacagactttagagatgagaaaattgaagttcatggagatcatgtagcttatatgaagtcacaccactagtggtttgcaaattactaacacggtgcttggccttgtagtaatcaataaatgatgaatgcatatgccatgcacctatgaaaactcatcggtcctatgccctgctcacttcctgttttgttgtcatatcagaaggcactgtgatagagaaagactttttcagagcctcctggtggcttaatctgacaaatacctagggatatttacattctatctaaagattgcctggggtagagctttcactcaaagaattcaatagttaatggttgactttccaacacctagatacgtggcagaaataattttgactggtgtcctaaaaatagtattttctgagcactgactataggccagggagttgacatgaaatatctcatgaaatcttcataacaatgtatggacattcaatgtatggagaatgaatatccacactagtcttcaatgtgacagatgaagaaacagaccgaggccatccttaggtcactcagctaacaagatggtgaagtgaggatttgaccagatttcattgactccaaatctacctcctaaccactaaccactatatcatactcccttcctaggcagcacagctgagtctttctaatgcaggtttgcacaaagacgaaattacttccattcaccaaattggacataattaggaggagtgtgcctatactaaatacatggttgctccagggctgtggtctttgttcagttaaacaaaatctgaacattttttgagtgacttttctctatcaggtgctgtgccggggtaccctttccttcttctctggcctgggacattctgactttaaactttccgatgtgcatctcacttcacttggccatcctcttgaaccactgctacaggacattggccaggtgactgtgtctttcattggccaggtgactttggctttcatattggtttaaaaacaatggtactttcttttgcaactgcatctgagaccttgtttcacctgtgtcttcaagattatacatcctcttaattcactgttgagtaaaaactccacttgtttattttagttttcattacatggtatatgctttcagtctgtctcccatcagaatcatatgtctcatttcccttctctttgtctctcaaccctaccccgttcttcctccgactctccttctttccctccctccttttcttgttaacaaatgtcagtggtttttattaaccgaatggggctcctcagggtgtgctgagctcattgaaagattttcatttctggattttttcctttgatagctatattaatcgtgatgaaagaaatccaccccccacaacaaagcgtagctccacagaagaggtttttcactacttacgtaactcattttaaatggaaaaataaaaaagtgcaagctttattttgtatactatttatgctgccttcagttagataatatttccaaaaatatatcttgttaacagagacacaacgccttgaacaagcatattaattacagttctcgaagttgggaatcatgtagtatttatctgtattgtagaactgttgctcaatggtaataattaacagtgatgggtctattgcatggctataggtaaatttaataacaaacatgaaacccagttctcaaaacttgctccaaataatgtaggtagcatttgttactgttctggagttgagggttagtaaatagctagggttcttaaaatatttatctagctcttaaaagtagaagtaaacaacctaaagaagacaggctgagtgcacttcttgaatatgcccatagatattttcagaaacttctttcaatggtgactttgaaagtattgagaattgacctgcttattttgcctttgattctctgtgtgtatgcttgcctctccccttggggggtttattgaacattaaggcttccaagagctcttgaatttgtgagtgattttcggagctctgggaacaatgtgagccattctcttggaaacaggacaaggtgctcctagatgctctcattccggggaacatttgtttttcggctagctgggaaccgacgatcgcgctgaaaggtctggtcaaccagcctccctcagttcctgtgtatctggcaggcaggtttattacaaaccttagtgtgctcattagcctcgtgatgtggcagctgcctaaaaaagaaacacggaaaagttgtgtcaccgaaggtgaaacttggcaaagagctgcccggcgccggctccgggcatgacaaagcgccttcctggcggcggcagcggcggtgggcagtgggggtttctgtttgcttgtcctcgatacccacggcccagtcgactcacggggaggcgtcgcaaagggaaccgcgggcccgggccagggctccgtggctggcggtgcgggtggtcgcagtccgggggaagatactgcgcgctccggtgcagcccgcggcctcgcagtctagaccgcgggcacgttgcagcctgtggggaagcagcgttaagatggtggcggtcagagcagcgctggtggtggccgggcggggctcagggaggcgcgccctcctcccttagcgacacctatcaaggctttcttgctttccgtacacctgacccacccactagacacctcaaaggcaggcatagaaggccaagagccttgaagtcagggcttgaccaacacaagagctttgctttctctgtcttcttgttaatgctaatttgactttagctgctcaaaaaccgaagatgcatcttgagcaggacgctcacaggcagatttgaatttatgtgtgtgtttttatattgcttatgttttattacattgatttttttcagattacaaaataatgcatgtttaccggagacaatttggaacatcataaaagcgtagagaagaaaatatcacccaaggttccactaccaagttaactttttgaggctttgcttctagtcctttttctctgcatattataatacatagacatggctaattatctttaagtgtgtatgtgggatcaggcacatacacgataacttcctttttttccctcaacgtcttagaatgttattttatgtcgttaaataatttgcaccatcattttcagtgtgtatactaggtgtggacttaggggtaaccaaggagagatggtgatttgtgcctggggtgtgaacatttttcctgcacctccttgagatccttctcactggacaccacaagcatgattagtattttgtaaaagtacatatatgaatatgtgcccatatggggctatgtatatgtgtgtataaatctgtaaataccaaattaaacacacatagacaactatgcacatatgtaaatagatacacaacaaatatgctaagaataaatcttgaaagaatatacaccaaaaggaatctctgggtggttggcttatagaaatttatagtgtttagtcatattttctatttttatctatagtggaaatacataattatattaatgatataataataaaaataatactaatgaaatattacttattgattgtcttcaaactgagttttctgctccctcattccttgatctaccgtgacctacttattatttttatattatatgatgcttcaagtccaagctaaatctccatcctccatgaagcctttcttccgccctcccagcaggcactgactgcttacttctgtacagggcttctatgtcacccatctggcaatctccatgggctactttgggtgtatctcatggttaacttctcatctgcttatgtcttatctctctgaatagactggaatgtcttcaaggatccttttcacaaagcaagtgctcactaaatgtgttacgtaatgacaatgcttatcatccatcgtaggtttctgtaaatgctcctttacctttgaaactctataccaaaagcccttagactgacagcaataatcctgctggatttaattttgctaatttaatttaggatacaattgctacttcataatgggctatctacgtagaatttggtcaatgatgatactgataatattactgaaatagtagtgattttcatattgatttttcaagttagaggactcttgatagagggtttcttggtggtagaaataaatctacagattcacacatgcattggacagtcataccccaacttaagtgatttcagttattttaatgcatgtgtaaattaattcatctgttaatttactcgataaatatgtattgaaccttctatgtgccatctgctttcttagacactgagaatacagcagtgagcggaacagataactatccctgccttcatggataatacaagcatattttgcaagttttcttagggaaacagactttcagtgcatgaagcactctgtttcatgttcgtggtatgtcaagcagtgagtgatctggtgcccatcatagccatcaggctctggccaagccaaattactaatgagtcaagctggatggagtcatacatgggttgcttatctgtggttcaggaaccaccgaagctgtggttcctggaccagcttgggcatcagcatcacgtctaaccacatatacccccgaccatgagaatttgattcagtatatctgggcatgagccttagaaagccacattttttattaagctcctcaagtggttctaatgcacagctggtttagggacctactgcctctgggcagtgtttctcaagcttgcctaaagaatcacctgtagggtttgtttgttttttctaaacaaaacaaaacaaaaaccctcccgctgacctactgaattagaattttaggaaaagagatggtaatctgacttgtaagcaggtgtcctggtgattcttatcatcaggctagttggggaaacattgtcctagagacaatcacaggactcccctagaaattatgtataaatgtcaatttttctggtgagcaggctccattgctttgaacagattctcaaaggagtcatccactccaaaaatattacatgaggtggagccctgatgtctaggaccagcattgttgtcaactgtatgttttgagttctcagtgtcctcatgggttgaattaagcaaccttaaagaccttctcggccctattcatcttccacatataaatgttctgcttggaagccttctttctctctttttgctgcttttttctatcttattgccagtcctgcctcaattgtttcccttgatggtctccctttaggagaaagtagggaagcaggagaatttcaaagcctcggctctcgcagagagggcggggctgggagggagcttcgggcatgccattcagagatggcaatcctagcacagctgttagaatagcagaggtcagtgtccaaatattttgacccttatgatagcttgaacctcagtggatcttaaactggtgggataagggggtgggagtgggacttccaagacatttctctgccagtctagagcagggtgacacagggtggacaaggtaattccgcttttccttggacataatttttctgcctgtatctggcagcaggtggtgatgggaggtggaagcaggagtgtgagtgttgggctgggcctaggtgcacccccaccccttctcatccttgaggcaccaagcagtgtctctgtaattggttcatgaccaatcaagtgcattgacctattactgctagttactttgagttataaatggtttttatttcctctgtggaattgggggttcaggctgtataggatgacctgatttgtatcacaagagcctttgggactttgacagatttcaccgtttaaaacacaccgagcttcctccctccaccccactggacataaaagcaacctttgaatttctggcacaaagagcatgtctttaaagggcagcatgcagaaaaagggaggaaaaagaagtaaggcagttcatcttcttttctgaggccattgtctccaaacaagtgacaaaactgaataccttgaaaaatcttgtattgatttttagtgcagaggcatctccccaggatctgaaaatcctggcagaagataataaacttatttccctgcctttgagccagagttgagttgcttgttttacatggctggaagaaatgagagtagttgctctgctgagagtgagatttggttcagagtgcatctctcttgaccatattgtatataggggagactcaatttataaaaactatatatacaaatctaactcaaatgccgaatgtggaggtagttacaatattgaaagagttattgttttatgaaaagtttttcttttaatagcatcatctttagtgtactcgcacgtttctttgggcatgaaggactacttgattaaaaagaaagaaatcaaaaccaagcctagaggcctcttgttgaggcatttgtttcctgctattctaattagaaactgttgctcagagtggctgtcttgcttctcggattattatcttttttattttaattattttaaatatgtttactgtggcaaaatatacaacataaaactgaccattttatagtcaattctatggtatccagttctatggtattaagtatattcacattgttctgcagccttaatcaccatgctccacagatccttaattacaggctataatggctggaagggaccttcatcatcatttggtctaaccttcccactacagagtagaagaattaggcccacagagaggcaatgacttgcccaaggtcatagaacaagttagtggcaggggcctagcccagtacatttccacattgacacagtaacagattcaggcaggtggcctctgttactctactgatagcagaatcaaggattgacataaatgtttagggtatttttctgttttttttttcttttatcaagcaagcaaccaattattatggtttagagccagaaggtccttcagacactgtctagttcaatttccttatttaaaataattggccgtatttgtgatttctaaatccaagttgaactacagaaagatgctaacattcttatttctaaaatacaggacaattcttccccagccttcctttcactgactccatggcattctttggttgaaaccaggtcctttgtgggtggctgttattaataagcttttcttgggatgtttacagtgactgctgtgacctaaataagtttgcttgtattgttttccccacaaaggcaagaacagcttttaaaactatgttcatccctctcatcacaatgtatttattcatgactaaaagaactgaagtattgcattttctcacatttggggcctttgtgtaccccaatcatgttttcttggagtagagcttcaggacaatacaccatgtaacattataacatgatccctcttgaaaattttatttttacttttaattgtggtaaaatacacataacataaaatttaccatcttaaccatttttatgtgtacagatcagtagtgttaagtatttaactgaagtatataatctgaagactgcttgtgcaaccagtcttcagaacgttatctcacaaaagtgaaaccgtgtacacattaaacaattccccatttccccattaccccagtcccttgcaacctccattctactttgtctctatgggtttgactactttagctaccttgtataagtggaactatagttatttgtcattttgtgactgactgatttcatttagcattgctataaagagacccctgagattgggtaatttataaggaaaagatgagccttgaggctcatccatgttgtagtgtgtgtgggaatttctttcctttttcaggctgaataatattacattgtatatatagaccacatttggcttatccattcgtccaaggagggaaacttgggttgctttcatcttctgactcttgtgaataatgctgctatgaacttgggtgtagatcttttttcaattgatgggataaattgttttaaaatactcaatttattttctcagtctttagtctaagattattaaaataacatggtgaataaaataaaggaagaatgcaaatttttagggtactggagaattgaggcatcaatccaaatgacttgcaagtttgagaaccatgagtagagtaaataggacttttttaggtcctcttgggtctattatgttacttttttatagtgattttgtgtgtgtgtgtgtgtgtgtgtgtggaaacaatgaacttcctctgtgatagcctctatgatccttcatccttgcatttttgccctttaccatttatttccattcctgtttatatgtgtcccccactatactgtaaacttgttgagtgcagggaccaagttattaatttctgaatagtacttaggacaaagcctggctcataaggcaaatgcaataaatgtttgaagagaaatttgactcactctgtcatttggaaaaatttaacttcacagttagccttggaataattcaacatttttatttgtttttatctgcttcttttatatttgaaacatagctcatgtttaggagcacaaattagttttaaatatgaagcaatcaagttttttttgttttcaactctttttgggcagtgggagaaacatttgttgaatacttggcatcaaatagaggaaatatccaggccttgactttagttttgatttgagtaagtccctctgaatttccactgtgaattctgtctcctccctgccacctctgaagtgctgtgtgtggctttgagttgtgcagctagtgctgtgagtgctgtttctgtatcagggcacagatttcccactccatgtattggctcctaagctttgttttcatgccccctaacttctcctgaactgtctccaacctctttataatgttccagaaatagaaatctcccaaagggattgtcatttgtaataaacgccctcaatccttaatatattatttcccattggtgggcagaaagcctgcagatatatttattttcaggtgatagacaatactttagagacacatgcttaagaatctggactccattcattcaaagagcatcaagcattatggcaggcccaggcactggtgaaacaccaatgaggaagagtctctattcttgctcttacagagctgatagtgggagaaataaaaaggaagcagtgccttgactgggaaacacagagaactaaggaagctcataggagagggagctgacatagttgggtggtggtagcaagtgcgatcgttaacttgacacctgaaggatgagtaagaatttgtcagttgatgaagaggaataagagtgtcctggaaagtggggacagcacatgtagaagctaggtgatgagcaagaacatggcttacttagagaacggaaggaagtacattattcctagagtagtgagtcaccttagttacgtggatagtcctggcatatcctgaattatgccactctcatttcagtggacagtcccattgattccaatttttaagcagaaatattgaaaatgcagtttttctgtgcattaacaaggaggttccctggtaggaagaaatgcatgaaaaacaagtaggctcaatggtaacttaatgcacttgatgaaatgctgattgtgaacaaaacttcaggatactatcattataaatgaatgaaacccattagattttaagtagaagacttattttttttctgctaagattagaggcctcagggttttgttaattgtggactccatgatcagaaatccatatatgtgtctgcagccatgatttttttattagtaacaagaaagagggataacttcttaactattcagaatatgcattatttagcagtaagacacaactattccagaaagtggcttaatcaactttattcatatgaaagtacatagttttatggctattattagtaggccatgaatttttattaagtcaaaaagaacattgatatttaacagataatgccattcttggcagtgtagggtgtaatcaggcagaacacaactcatttctgacttccaactatatcactcatgttgactttctgctttgtctccagcagttgcatgaaagtaaatgtactgccacagatacttcccagatgttgccacacagaaatttcaggatagttccattcataccatttattcattcaaggaacacgtattgggtgttggctctctgtcaagcttgattgtaggtgttggaaaaatgtgaccaagctacagagtgtccctgcccttgcagggctcacagtgtagtggggaagacagacaagcaaatagtcaatggagacaaatacagtgtgaccagtgctgtaatagcagatgccctggaaactgtgcaagctcagaggagggcagctaacacagccttgaaggaccagggaatgctccctgaggagagagatcggctgggatcagaaaagtgaattaggacctggcctggcaaagaggaggacaaagagaatttcaagcagagagaacagctcatttgaagacaaagaagtgagaagaatggcaggaaggaagggagagagagagggaagggtattgcaaatgtaaatgtaaaagggcataactgtatgacatgcattatggctagagaggcatgaggtgtacctgaataggtaggcaggggctggcacacaaaggcattgaggtgtacttttgtgtatgaggatgaagagtttggatttcatttcaaatgcattggaaagcctttggagagtttcctgatgggaagccctgtgatctgatgtacatttttaaaaactctgtctggctaggaaggcagtgagaaagctgatgcggtgggtccaggctgagacttggtagagtaagaatgaagatggacaatgtctaaagatttgagagcactatccaggaattggggtagattgggttttgtgcaaataataacatgagtggtacaatgatatctcatttacttaagcgggagacaggagtcatgaatgatgactcttatgtttctgggatccagtcccatctctagcacttacaactgtgtgattgagcagtatcacttattctttgcatcttctttttttcatctcttacattttcccactgtgattgcagcctgattttcagtggtgattcataatgatcctaatatcctttgcttctaaggtacatagcagaccatttataaatattgcccaaataaatgaactggcattatgcagctacattcttatgcaggtatacttcctggttaggtgcagattagcctatttagtctttcttatctgtagcttattactgggaataatctaaagtggaaatcaaaccatagattgtgtgtgatataatggtcccctgtactggactgggccttaagaactcacatttttcccccttactttgctgttatcttgcctttatttagtgcaacagaaaatcacttatgtgctttatatcagtattcccatttgtaaaatgtctatgataatgccagatcctgactttagttttggggtgatattattaacaagataatagcttttaagcataatcatttagtgtttataatagacctttcctctaagaacttcctgatgtttgtcattggaggtggtgtaaggcagagaacagaagcccctgaagagctttttcagagaatctaggtcctaactctaccccacaccagcttcagtgggggcccattggtggacatgcacggtggactccggctgttatggaccttccctgctctgcatagtcttgtagcaatatggtcttctcatgtttcagaacatcaaatgtaaaagccaaaactacaactggcaagaactcacttagcagtaaaggggaaatgtataggaattggaactgctattgacaaaagttagattatatgatcaacatttcaaaggcacagagatttgcaataattgcatggggtataggtgttttctgaacaatagaaacaaaagccagtattatatagtgggttaaaagagacacttattatgctcaagtatacaaagtaacatgaacttctagctagtagaattttatggatttcatgatttgccataatgaagaaataaaaatattttaaaattttcctattgtttttgaaagcagttattgtgagtgtggttggcaagtattactatgtactcagcacccccttttcccatggatagctaaacgaattctgcattgttgggtctgatttcatgagttttgttccagtgcaaaacaaacttaatacaagtactttccaggtctggtttcatctgtatgtgaactagaactaaatcgtttacatgtgaggctaaaatgagagtcctcccaataaagtgtcctggaatgtgcatttgagtgttttctctaaagaagaagacagccatgttaagtcagaaatgaatcagcaaaagaaggaatgaaaaagattgttcattctgaaataacactcatggcttgtatgggaaaattttatttcaactttgaaaataaagatttttcatttaacattaattcaacaaatatttattgaatacctactatgtgccaggcagtgttctaggtataagtgatatagcaatgaataaaacaaagatctttgccctcctgggcttacattcgtgtgtgtgtgtgtatgtgtgtatgtgtgtgtgtgtagggacatacaataagcaatatatatataggtaaaaaagatatgttatctgctgacaagtgctatggaggaaaataaatctgggaatgtgtatgtatggtagtggtggtggtaaatggctgtagttttgagtatgatgatgaggtatggacttactgagaagatgatatttgagtaaaattctgagagaaagccatgcaggtgtcttggggaagagggttaccaacttttgcatgttgcctgggtaaaataaaagtgcacaagtataaaaatgtattacccacaagtcaggcagttagaggtgttttttattgaacaagggtaaagccctttctgcattcctgtgtaaattctgcaaggcagaatttcaaatgtagtctctggttatttgaatcttaaaagttcatgaacagctttttaaattgtactctctgaaatttctgtatatgcatacagatagcatttacatgtactaagttggtatgaacccatggatatacctgctttggtgttgaagctacttgatgatttgcaaattcaagcataccatattttcatttatgcaaaagaaagtattaactgttctgatgtctgggaagaatgagcacctctcaggaacataggttctgcttgagctactttagaccatttgactcctgaaagtaggagaaattatcagttagatagatcagcctctccagaggacctgcaaagtgcaagcaagaacagtgtggagccacttgcattgagtagtatgtgagtcaaagtcatggagaggagtggttgttgttcagtatttgctgtggattactgttaggactagtagatccatattctccctatttcctggtgttggtcattttgcattgctataaaggaattcctgagactggaagatttatacagaaaagaggtttatttagctcatggttctgtgggctgtgcaacaagtgtagtaccagcatttgctgctggcaaggcctcgggaagtttacaattatggtggaaggcaaagggaaagctgccttatcacatgatgagagggagtaaaagagagagggaggaggtgccaggcccttctcacgtgaactcacatctcacgtgaactcacagagagagaactcactcattaccatggggatggcaccaaggcattcatggggcatctgcccacatgacccaaacacctcccactaggccctcctctaacactggaggtcgcgtttcaacgtgagatttgtaggggacacacatccaaatcatttcactctctgaacagtgctctgtgtaactcttgccacttctaggtggataaggtggtgaagacccactaggtctggaagggcagagttgattctgtattgaggaggtcacagacctaatgtgaaaaattattgctccagcctcccttgtacaaaatttggacatgtgatacttttgacatgtttttggcgtgtcctgccagccaatggtgtgcaagtagacagagcaggggagtgaatccatgccaggacaattagctgttgtagtaaggggctgcagatttgcccttcccctttgtcttcagtgaagtgcccatctgttatataaatatttgaatgtggtggtgaggagggagggaactgtgtgtatttgtggaaagaagacaggaactgggtgcccttgagtgagcctcttaatctcaatgggtcacagttttgtgaaacgctacagtgagaatagtaacattaagcacccactaagcttgttggagtataaaaaagacatgatatgtgaaagcatttggttagcattatacatgtaaatgtacttttttaatgaatggacttgcttttccctagaaggcctttactggtagaatattgttcagctatcaaaaaacacggccttttatcaggaatttttcctaaattagcattattcacaattgaaactacatacttggtttctaagttttcatggcccagattattttattttgctaccttccccaccccatcccgagggaatatgtgaacaatttactattgacagataaaagataatgtgttgtgaaagtgacaggcccgaatcagcaggagagcctgcagttctcctgccttgctgtcattcagtgatgaaaatattacagaacgtttaatactatatgaactagaacaatacgcaatttcagaagaagccaccttatgacacttcaatttatttaacataaaagactgatggtcctattgaagttcaaagcttggaaaattttcaggaaggacaatttatactatttaggaaatgctctccctgagctttactgtttcatatttaatccagggtactacctaagattgcttataaagtcccttttgctgtgtggaccttcaacatctcatagtaaagagagaatatggtgtagtggttaagcatgcagagcttgtgcctttgttttcccatctgtaaaatggggataagagtagtacctacctcactgggttgttgtgtgtattaaatcagttaatatatacaacacatataatagtgacagacacagagtaagctctatataagtgtttgctattattattattacttaagttcttattatgaagattatctgcctagagtgtctctgtctaaaacaatagtctgcataaagtctgggttgtgttggagagggagaagagggtggtgaaggaatttttttcagtaaagaaccagcaatatctgctgcaaaggttcttccccacctcatccaactggaaaagccccgccagtcccttcaagaccctgttcaagcatcaaccctctccaccttctccacccttctcccagtggataattcccactgttatctcagcactttatttctgaattatatcagtcagtttctgaattatagctgttatcatactgcattatattatctgtttatgggtctctccctcactaggctgtgggctccttgaaggcagggactagtgtaattcaagcatagtgtcatggtatgcagtaagccattgatgctcatggagtggcagactatagctgggcagatttctctttcagagttgcccttccttgtgttcatttccttccctgcaggtctagactagagtcagtctcaaccgccctcaatttgccacttggccaaaggcctggactctctgcagtggggagctaaacatctgaatgaagtagtcatcaaaaccaaggtgagctttggagattgctatggcagaagtgaagagaagaggcaactagagtgacagtacatctttgctagttggggtcagtgttgggcatagctgttccctataactcagtactccagctagactgagatcaagagcatggctgagatcaagaacatgccctgtgttaccccttttgtgaggtcttctgagatgcccccaggcacacctaactgctagtactcctgtgcttcactgcaatttgaacatctctattaaaggactagtgattttattgcacatctgcttctcaccagactgtgagtcacatgagggcaggaactgtgaggtttcggttctgtagagctgctttaggtaaatggttgatgaatgagcaaatgaatcggtttgtctttctgatactacttcagtgatctgtccaaatgccgttaagaggcatattttgttacttgtttatcagtcatcttttctgcttgtttcaaccttcagtaaactgtggaactgttctctttcatgtagtacctggcacgtaggaatagtgcagcagataactattgaactgaatggcacctgagagcaacacagatgtagggttcttttattttctggatgtatttggaggcagggatataggtcagcaacccatagtgcagttgtcctttggggagggggtcagtgtgccaacctgtacagtttagatcggggactgtgaccacacacagtcaccagttaaatcaggcagccctattgcgcacatcatcatctccatcttcagttgtgtgtacagccaattgtaattactgaggcatataaggtagccaaatcatgtttgtgagcctccacttgaaaagtaaaagaaatatatgttatatgttagaatgagggttttttttcatacagagagaaacagaactaagaaaaaaataatttgtaatatttcagaaaactcaatttttgaggactctggatgatagaattcttacagtagctacccagctcagagcaatttgtgcatggaatacctttagggtatgtaagttccagaagatcatcatttagcttagtgcccagtatgatgccagtcattgtagaaaatttgacagattgatgatgcatggcctttgcccccaaagaatttgcattctaattgatgatctcagatgttatatctgcagtggtggtgagcagcttggaagagtataaaatataaagctaagctgtctattttgtgcgtgtgggaggcattcagaggagacatgccaagggtggggtatgtcaaggaaggctttatgataaaagcagtaggtgagtggaaattaaagtcaaagtgggagggtagggggacctgggaatgaaagtaaaagtgaacctgaggtgttagtaatggtgtatcctcactggattattcattaattcatcagttgaaatttatgtaactgactaccttgggccagacactatgatggatactagggacacagagatacacaggacatggtccctgcttttggcatactatggggacacccaaggagtgccttcctttattgaccatacagttaaatgactgacgagtcattcatgccttcaacaaacatttattaagtgtctgttttgggtcttactcagcattggatgctggggatacagaaatgagtcagaccagtccaagatactctcatactccaggtagatgcatgtgttaaaacatacaatcagctatttgctatttgcaaagtgcttctctcatatgaggcaggtttaatcctcatagcaatcttgtgaggttgtttctgttatattccccatctcacataatttgtgagattatgaactaagagattatgaaagtgagattatgagtttagttgataaactaaggcatagagctgttaagcaatttctctacgctcatactgctaagaagtagctgagctgagaagtgaatccaattcctctgcatgttttttttttttaatgtcctggaatcacaagagtatttgactcatactgtaggagcagaaataaaatgaaataaaatgaaaactgattttttgcgaaaagagaggcatcttctaagaaaatgaaagaatgattcttcgaatgggaaaattgccatcaactcaggggaagttatgaaaagtttgaagacatgtaatgggagagtgaacaaagtactaaaataagaagggaccacattggggtgtgttgctttactagtccactgtgagatattaagttggtgcaaaattaattgcggttttgccattaaaagtaataggcagtatcatggaatattggccatagagttaaatgttctataaggtgaaactattgttaaaaagtcacttgtgttatggaatcaccttcatgtgttagttattgatcttgccggcttgcaatttataaatgtatttttaaaagcaagagtccattatgtagattttctttctctttccttctttcctttcactgagtcaataattttaagataagaaaagaaatatataaaagatctattatagaacactgatgtccagtttaatcccttattcttttctgcaatcaaaagataaagtaggaagataactggaatcagtttgtgacagagaggaaaaaagaaattgactgtgattacaaacctcacaccaaaattattattatagacctgactcccaaattatgcagattgagaccacatgaaacatatggtgtattgtttttctacgcataacttgtttgatgtttgtttaaagaccttagatgaagaactggctcttgagatatcttgtctctcataatcacaatctgaatctgccttaccctcacttgaggtttacatggagagtttcaaactgaaataatgcaaaaattccttatgtgacatggtgatgtggagtgtgggctttggctctaagtttgtgatgggattggtgtagtgttcgcatggaaataatcatatacttggcagcattttctctgaggctattagacctgaatggacagaaatactgatgtttgcaaattccctctggcagtatggtgcaagtgatatcattcatatcctttctttccattttctatcttcctacactcagtgacctcagagatcatctggccattctttctacagttgatgaactcagtcctggagagtgtaaaggacctgctcaaggttttttggcatagccaagtatagcttctagaagtaatttccattgatcttattgcttgctcttcagaactatctaatgaggtggctggcaagatggccgaataggaacagctccagtctgcagctcccagcgagatcaacgcagaaggcaggtgatttctgcatttccaactgaggtacccagctcatctcattgggcctggttagagtgtgtgtgcagcccatgcagggcgagctgaagcagggtgggacgtcacctcacctgggaagcacaaggagctggggaagtccctccccatgagggactgtgctgtgaggaacagtgcattccggaccagatactatgcttttcccatggtctttgcaacccgcagaccaggagattcccttgggtgcctaaacaaccagggccctgggtttgaagcacaaaaatggctggccgtttgggccaacacatagctagctgcaggagttctttttcataccccagtggcaactggaatgcaagagagagagaaatgttcactcccctggaaaagggctgaagccagggagctaggtggtctagctgcccggatcccacccccatggagccccgcaagctaagatccactggcttgaaattcttgctgccagcaccaggcctgccttacaagagctcctgaaggaagcactaaacatggaaaggaataaccggtaccagccactgcaaaaacataccaaattgtaaagaccatcaacactgtgctgaaactgcatcaacaaacagacagaataaccagttagtatcataaggacaggatcaaattcacacataacaatattaaccttaaatgtaaatgggctaaatgccccaattaaaagacacagactggcaaattggataaagagtcaagacccatcagtgtgctgtattcaggggacccatctcatgtgcaaagacacacagaggctcaaagtgaagggatggaggaatatttatcaagcaaagagaaagcaaaaaaaaaaaaaaaaaaagcaggggttgcaatcctagtctctgataaatcagagtttaaacgaacaaagatcaaaaaagacaaagaagggcattacataatggtaaagggatcaacacaacaagaagagctaactatcctaaatatatatgcacccaatacaggaacacccagattcataaagaaaattcttagagatccacaaagagacttagactcccacacaataatactgggagactttaacacctcactgtcaatattagacagctcaatcagacagaaaattcacaaggatattcaggactcaaactcagctctggacgaagcagacctaatagacatctacagaactctccaccccaaatgaacagaagatatattcttcaaagcaacacatcgcacttattctaaaatcgatcacataattggaagtaaaacactcctcagcaaatgcaaaagaatggaaatcacaacaaacagtctctcagaccacagtgcaaagaactcaggattaagaaactcactcaaaactgcacaactacatggaaactgaacaacctgctcctgaatgactagtgggtaaataacaaaatgaaggcagaaataaataagttctttgaaaccaacgagaacaaagacacaatgcagcagaatctctgggacatagctaaagcagtgtttagagggaaatttatagcaataaatgcccacaggagaaactgggaaagatctaaaatagacaccctaacattacaattaaaagaactagagaagcaagagcaaacaaattcaaaagccaggagaagacagaagacaagaagtgaataggatcagagcagaactgaaggagatagagacaaaaaaaaaaaaaaaacccttcaaaaaatcagtgaatccaggagctgattttttgaaaagattaacaagatagatagaccactagccagattaaagaagaagaaaagagagaagaatcaaatagacacaataaaaaatgataaacgggatatcaccactgatcccacagaaacataaactaccataagagaatactataaacacctctatacaaataaactagaaaatctagaagaaagggataaattcctgtacacataaacattcccaagactaaacctagaagcagctgattccctgaatagaccaatgacaagttctgaaatcgaggcagtaattaatagcctaccaaccaaaagaagcccaggaccagacagattcacagcctaattctaccattggtacaaagaggagctggtaccattccttctgaaactattccaaacaatagaaaaagagggactcctccctaactaattttatgaggtcagcatcatcctgctaccaaaacctggcagagacacaacaacaacaaaaaaatttcaggccaatatccatgatgaacatagatgcaaaaatcctcaataaaatactagtaaactggatctagcagcacatcaaaaaacttatccactacaatcaagtgggcttcatccctgggatgcaaggctggtttaacatacacaaatcaataaacataatctatcacataaacagaaccagtgacaaaaaccacatgattatctcaatagattcagaaaagggcttcagtaatattcaacactctttcatgctaaaaactctctataaactaggtttgatggaacctatctcaaaataataagagctatttatgacaaacccacagccaatatcatactgaatgggcaaaagctggaagcattccctttgaaaactggcacaagacaatatgctctctctcagaactcttattcaacattgtattggaagttctggccagggcaatcaggcaagaaaaagaaataaagcatatttaaatagaaagagaggaagtcaaattgtctctgtatgcagatgacatgactgtatatttagattagacaaccccatcctttcagccccaaatctccttaagctgataagcaaatttagcaaagtctcaggatacaaaatcaatgtacaaaaatcacaagcattcctatacaccaataatagacaaacagagagccaagtcatgagtgaactcccattcacaattgctacaaagagaataaaatacctaggaatccaacttacaagggatgtgaaggacctcttcaaggagaactacaaaccactgctcaaggaaataagagaggacacaaacaaatggaaaaacattccatgctcctggataggaagaaacaatatcatgaatatggccatactgcccatagtaatttatagattcaatgctatccctatcaagctaccactgactttcttcacagaattagaaaaaactactttaaatttcatatggaatcaaaaaagagcctgtatagccaagtcaatcctaagccaaaagaacaaagctggaggcatcacactacctgacttcaaactatactacaaggctacagtaagcaaaacagcatggtgctggtaccaaaacagagttatagaccaatggaacagaacagaggcctcagaaataaagccacacatctacaaccttctgatctttgacaaacctgacaaaaacaagcaatggggaaaggattccctatttaataaatggtgttgggtaaactggctagccatatgcagaaaactgaaactggaccccttccttacatcttatacaaaaattaactcaagatggattaaacgttaagacctaaaaccatgaacaccctagaagaaaacctaggcaataccattcaggacataggcatgggcaaagatgtcatgactaaaataccaaaagcaatggcaacaaaagcgaaaattgacaaatgggatctaattcaactaaagagcttctgaacagcaaaagaaactatcatcaggttgaacaggcaacctacagaatgggagaaaatttttgcattctatccatctgacaaagagctaacatccagaatctacaaggaacttaaataaatttacaagatgaaaacaaacaactccatcaaaaagtgggcaaaggatatgaacagacacttctcaagagaagacatttatgtggccaacaaacatatgaaagaaagttcatcatcactggtcattggagaaatgcaaatcaaaaccacaatgagataccatctcatgccagttagaatggcaatcattaaaaagtcaggaaacaacagatgctgcagaggatgtggagaaataggaatgcttttacactgttggtgggactgtaaactagttcaaccattgtggaagacagtgtggtgattcctcaaggatctagaaccagaaataccatttgacccaccaatcccattgctgggtatatacccaatggcttataaatcgttctgctataaagacacatgcacacggatgtttatttcagcactattcacaataacaagacttggaaccaacccaaatgcccatcaatgatagactggataaagaaaatgtggcacatatacaccatggaattctatgcagccataaaaaaggatgagtttatggcctttgcagggatatgaatgaagctggaaaccatcattcttagcaaacttacacaggaacagaaaaccagacactgcatgttctcactcataagtgggagttgaacaatgagaacacatggacacagcaagggtaacatcacacactggggcctgtcaggggatgggggactaggggacggatagcattaggagaaatacctaatgtagatgacgggttgatgggtgcagctaaccaccatggcacgtatatacccgtgtaacaaacctgcacgttctgcccatgtatcccagaacttaaagtataattttaaaaacatttacatatatatatatattatatttatattcatatattttaaaaaaagagctatctgatgagacaggtgaggcaggttgttttgtatcaatttctagaagagacagtttagagccagggaggttaaaatgctggttaatggcccaagacgtagccagcagctcagctgggactaaagtccagatcttctgatttcttgtagcacaccatattgcctctgaattcttttctttcaaaacagatatttctgtccttttgggtttgtcaaggaatcacttcctatgttattcttttgacactggtattcgttggcacttgcaaattgccttagattggtaattaacttttaaaatttgtagatattttgtttctctaactatattataatctctctgaggattgagggccagccaggttttatactgcctttgaatcttccttagtacctagcttgtaatatatgcttgacaaatatttgtttagtgtctgatagtggaagtcagctggaggttggtgtatgtctaatataaatctggaaattaaagtctcttttggttcttggctcaggatataaaaagcatcatgggtaataaaatttacaagttttctagcctaatcaggtattatgtaaaatttgtatcctgatttgagaaaatctgtatctgccagtgtgttctgactgttggaacatgaatataaagattaatttgagattgcagagttctgccatagggtttggtgaaatactacctaaactgtcctcagagctttctgatatctatcaatagtggaaagttgatcttgtttctcctttaaagatttttgtctttagagctttgtgcaaaggttgaccagaacctcggaatcctaggatggatcgaatacctggtgtgtgctaagagctaggaaagtggaagctggattatgcacgggtagaaaatgaagagagggcaagaggaaggaagaaatggaaagtgtaagccaatgtgagtaggagtttggacgcaagccccatatttgaatcaggaaacaaggctgttggcagggctgattgtcatctccccagatgacctgctggccagaaagagttaactggccttacaacctgctgcaggaatagctcaagagctatcaaattcatcacatgtaacttttcactcagattggttttgggtcctgatatttacgagttaaaacatcttaacatcatttcaaatatttgtgaaagtatatgggaattttatggagcagcggggaatttaatgcaaataaagtagaaatatagagtcatatttgagtttttatgttgaaatcatatcttgatgaagttagttttaaacaactatatttactgaggacccactggggacaaaacacattcaaggtatttttttcagtttttaaaatttttgcaggaaagaaagaaccagtcacatcgaagcaacttgaatgtttataaaggaaaatcatagaagaatggacatcctttactcttgaaaagtttatgaataagctgcatgtcaaagcaatatcataatcacaaagtagagaagataatccattgttttcttgtataaagtcattagcattctaacttattcattcatttgtaaatcacacattgaaaagaaaacaattagcacactctttcacatatctgtgataagtcctcaggcctactcaggaagctgttgaaaatgggcatgctgatttgttattaatgcttatatattttagaaaaagcatccaatttagaaattaaattgatttttttttctttttacaaaatgaaagtcattactacaggaggtagggagacaagcaggcagacaaacaagacagcagggcagagccctgactggggcataggatctgttcacatcccatttctgttgaaggaagattatagcctaagagcatacagtagagggttggattagaacctcccatcagaagccatcaagaggtattctctttcccctgttctcttgcacttgtttctttcacaagttttttcagcatttttgggtactctgttgtacaacctaaaataaattaggcatctaataatagttttcttaaggaggcaaaaggaaaaaaaagtagaatttgtatttctcatgtttctaatacggattcttcttttaaaagtagccccaagaatgcatccttattctttcagcataagaatatgctgtcagctctggggacactaagatgaatagggcacaaccttacttgctaggttctcataatccagttggctgctcaggataagtcaagcataaagacattatcaaggccctgtgggaattcagaagggaggaaatttattcctgctaagggactcagggaaggcttcctggaagaggacaatcagagctggactttggcagataggtaggatctgcacatgaagagatgggaggagatggaggcagctgtcacatagttgagaaatcatgtgatgtgttggctaacagaacgcacttttttcttggagtctgaggcttgggaagggaaatgacgggaggtcaggttagcaatataagttgaagctagattggtagggacagccttgaatgtcaggccaatgtctttgggactttataggtagtgctaagacatatccagagaattagctaggcagtgtcacgaacagatatttatagcatattgtggcaagaaacatgagtgcaggatggttggaggccttgaggagggagccgctaagctgccaaggtgtgaaagctggagcatcgtcaaggaagcttgcatgaaagtgatgacattttgctgaaccttgaaggatggatatgaattccccagggaataggttgggaaaggacatttcaggcagaaagaatagcacctgcaaagtcccagtggtctatgagggaatgttatgctgaagaatggcaattactgtgatgtagagaatgcaggtatctgggaattgggtagcaagagaccaagctaggaagagggcaaagaccagatcccagcagaactagtaggcctggctgggtggtttcaacttcaagggctgtatgcaggaaacaattgtgatgtgtgcttttagaaatatcatgctagcagtggtgaggaggatgcattagcataaatgagaaaggcttagcttgctgagtggtagggtggcaatggaactaaaatacgtaaagaaacagtgtttggggcttagagagagtctgggcaagacagagggtggactgaaaggatttagggggaatggtttttatactttaattaatgctgtggttttcacaataggtctctttgtttcaaaggaaatcttacgcaaactccatgaaagataagggccaagctgcatggagttcaggtgggaattgggcttggatccaagcctgcttgttcccttgaaatcctgcaatttcgtgatggctcctgaggtacctctttgaaccctttgtagttcagcaaatgcagtttgaaagccactgccctgaaaagattcatgtgctccaccaaaaacccaggcctttgccctccatgctgctgggagagggaaactggcctcttgctgtcatggttgggcaccgaaaaaggcaggcttatctagggacaatgaacttgatctcttttagaggctctcactgatcctggtggctcactgatgaggcatctggagtattctttgatacctagggacattgtagttcccaaggcattttgaacaatcgtttgtagtccaatcaggccgaattcatgaaaggaatttctgggttctaggtagaaagcagggccagacgcagtggcttatgcctgtaatcctagctctttgggaggctgaggcaggaggatcccttgagaccaggagttcaagctgtgattgcacctctgtaccccagcttgggcaacagagcaagatcctgtctctttaaaaaatacaagcaagcaagcaggggataaaagaggtgcctaggccagagataagcaaggggagctggagacagggccattgtacagggatgtctggccctcggggtcagtgaggctgatattcagacagtgcttttggcagctgatgaggagctgcactcttccagagggattacctttttctaattcatagaaaggcaccttatgctctagcattggatatttgggaagatagcatgaagaggtggtgaagagcaagagataaatggggagttggggttggaatcaaatgtctgctcaacccttatgaggtgtgtgaccttgcacaacttccctaatctcttggatcatcagcttcattctccatgaaacatgaatgatactagtacctcctgttgtgggcttttatgaagattaaagaagataatttgtgtaaagtgcttaacacagtgcctggtacatagtaagtgttggataaattttggctgttaatattctttatttgtaatcagaacactgtctactccattacagcagtaacttcagacttcatatcttgatacatttctctttactaagaaagaatgcctctcagttcaacaacatgggcatgagcatcttatattttcagttatgtcctataaaagaaatacaaggaatgactactagcatggattttaaaaattactagatgtatttcagatacaaaattggatgctatggtgaataatccagggggtactcatggacccaccacttagcttagtaaaacattactgatgcagttaaagctccttgtgtatccctcactgatattcccttccttcttgcctggaggggaccaagtttctgaatttggcgtgaataactttcatgaatgttttaatattgctattacatttgtagctatctgtaaagaatgtataatttgtgttttaattattttagctttatgtagaagaccttttactgtattttttcttcaacagccctctttttccccctcaacatttacctaacataaacatatacttgttgctatacataaggtagggaagtaataaaaattgttatttattatggagaagagtgtcagctttttgttgtaaaataaaaaaatgatatatttaaaaatactaaatgtatttcaaattgactttctgaaagatctaggtagaaagagagttaggttttggaattttatctgatatacctacaggccactcataattatagggtacccaaacctgcaccttattaaaccttgatcgaatggttgtattgatgaaacatccacaattctgtttacataacacttgcttggatttggagacttggcatcttgactattaagtatgaaactgtcttgaaaaatcactgggttcatgaaaggttttaaatgaaatagcatgcatctataaaccattctctcatatttatccatttgagtgtgaagtagtatcctagttttcattttgaactccagagtcttatatttgtgaaatatgatgtcttctctttaactacaattgtatgatttttgaaagaatagatattggcatttatattctggtaaagttgcattgttatagtttgcaaattattaatccacagcacttatactttactgtttgaaaggagtcctatgcttttttcttttaaagcagaatgtggcatatacattaacacattgtcccacatttttgctaagtggaatgtgtctgactttgtgggctgatgaatgatgccatatttatttctgaatcaatcttatggcttatcagtgcagttatcacttatgtgatctgagacttttagctgggactccagagacattgatgatctttatcattctgtatcactcataaaggatcagggtcagttgaggttttgacacctggccatgtatttaatgttttggctttgttggatgtaactcatctggcacaatgttattaccacatcactgagtgagatgtcctcattttcagatgttgccaacattaatatctcagatttcaggaataaaaagttacctagggtgagttgagatgagtgacattgacatgtgtgtgtacctacatacatgtatttgctgacttgacttttgcttatctttatctctgtaattagaatatatcttctcttgattaaattaaacctgtcattttcccataatcatttatcaaatgttcctatacgccagctactatgccaagtacagggtatatacaagttactcttgaagagctcacagtccaataagggagacagtatactttgtcaggtgcttccgttgacttatgcacaatgtattagaggaacagaaaaggaaggagatattcatttatataaaataattgctcaagggaggcttctcagagcaggtgatatttgatgtgagtcttactgggtgaataggagtttgccaaattgaaatgcagagggtatatcatttgcaaaggcacagaagcataaaagaggacgatgagtttgggaagcatatgtgagggtaagagggaggctggaaattgagattgggccagatcatgaagggtctcatgtatcatgataaggagcttgggtgttatcttttaaggggaattgaaggagtgtttcatatggaaaagtgaaattttcatatggaaaaggttttagggaggctgtcttagtctattttgtgtgattataacaaaatatcagagactgagtgatttataaaggaaagaagtttatttagctaatggttctagaggctaggaagtccagtggcatggtgtctggcatctgtaaggccctcatgacctaaatacctccaattaggcctcacttcccaacactgttgcattgagaattaaatgtcaacatgagttttgggtgggggtattcaaaccacagaattctgcccctggatacccccaaatcatgtcctttttacatacaaaagacattcattccatccaaatagccttaaagccttaatttatttcagcactatattagtccattctcacactgctaataaagacatactgggtaatttataaaggaaagagatttaattgactcacagctcagtatggctggggaagactcaggaatcttacaatcatggcagaaagggtagcaaatacgtccttcttcacatggcagctagagagagaaaaacgagaaccaagcaaagggggaaaccccttataaaacaatcagatcctgtgaaaacttactatcacgagaatagcataggggtaactgcccccatgattcaattacctcccagtgggtccctcacatgacacgtggggattatgggaactacaagatgagatttgggtggggacacagccaaaccatatcattctgtgaccttcccctaccaaatctcatgtcctcacattttaaaacacaatcatgcccttccaacagtcctccagagtcttagctcattccagcattaacccaaaagtccaactccaaagttttatctgagacaaggcaagtcccttcttcctatgagactgtaaaatcaaaagcaagttagttacttcctagatacaatggaggtacaggcattgggtaaatacacccattccaaatgggagaaaatggccaaaacaaaggggcccaggctgtttgatacttcttttgaaatctaagtggagactatcataccctcatacccccacagttcttgcattctttgggcctgcaggattagtaccatgtggatgtagccaagcttaatggcttgtaacttccagagtgggagattgaggcacaccttgggccgcttgaaatccagctggggcaaactaggggacaaagctccagaacgtggggagcagtatcctgaggttgcacagggcagtgaacttttggaggccacccaggcctgttcccccaaaccattctgcccttgagagctctgggcccctgatggaaggggcagagtaaaaaatatccaaagtgctttcgggatttttctcccattgttctgatggctagcacctggctcccttctagccctaccaatctctttaacaaatggtcacttggccacactcttgcaagctttttcagtttttatgtggcaggctgcagattttccaaatctttctgttccgctactctcttttaattatgaatttcatctttaagtcatttctttccttttgcatctcactttatgtggttaaaagtagccaatcatcatcctgaatgctatgcttcttagatatttcttctgccagatatcctagttcatcattttctgcattccataaaatcctaggacatggacacaattctgccaagttcgttgcaactgtgtaacaaggatgccatttactacagtttccaataagttgtttctcatttccatctgagagtttgtcagaatggactttaacgtccatatttctaccagcattgtgatcacaaccacttaagtaatccctaagaagttccagactttctctagtcttcttttcttctgagccctccccagagtctcccttagtgccctattcacagcaatctagggtttttaaacttgctcctataaattcttttttttttcagtttggcaaccattcttattttatttaaagtacagataagagaaaataatattaagtagttcatttactattgtgatgattaactttatttatcaatgtggctaagctataagtaaacagttcttcaaacatcagtccaaatgttgctgtgaatgtattttttaatagaattctccattcatttatttatttatttatttatttatttatttatttgagacaaggtctcactctatcacccaggttggagtgcagtggtgcattttggctcagtgcagcctcagcctcctgggcttaagcaatccttccacctcggcttcctgagtagctaggactacaggcacatctcatgacgcccggcaaaatttgttattttgtagtgacaaggccttgctatgttgcccaagctgctctcgaactcctgggcttaagtgatccacccgcctgggctctaaaagtgcagagattacaggcgtgagccactgcacctggctagtggtacttttagatgtgatttgacatttaaatcagtagaccttaagaaaaaaagattaatctccataatgtacatggccctcatccaatcagttggaaaccttattagcaaaaactgaggttccccgacatagaaggaattatccacagaactaccacatgaaaacccattgggagatatacctaatgctagatgacgaattagtgggtgcagcgcaccagcatgtcacatgtatacatatgtaactgacctgcacattgtgcacatgtaccctaaaacttaaagtataataataataataaaaaaaaaaaaaaagaaaactcagcctgaatttccagcctgcaagcctgccctgcaaatttcagagctgtcagcccccaccttaacgttgtcataaatacttcggttttggttgttcacaaaatatgattccttatttggaatatttggggggaatattctagaggaaaaaagcataccaaataagcatgctgtgctcagttattccaacttaaattcatgatgctgcttgaacatactgtttttggatctctaatgcacagcatccttagactggattttcctaagaaaacttcaggaaaattttagagttgttgaattcatttgatagaaacagacattaacccaaataataatagaaataataatggtggtggtgatagtagtggtggcagtaataatagtagtagtagtagttattataatattgatttgcatacctgaaaggagtaaaagtagacctggcttcaaagctgaatgacctccaacaatgtgaccaggactccctcactatccttgagtttgatttctccagtgtacaacttcttcttcttcttcttttaaattattatgcttaaagttctgggatacatgggcagaacatgcaggtttgttacacaggtatacacgtgccatggtggtttgctgcacccatcaacctgtcatctacattaggtatttctcctaatgctatccctcccctaggcccccaccccctgacaggccccagtgtgtgatgttccccttcctgtgtccatgtgttctcagtgttcaactcccacttatgagtgagagaatgcagtgtttggttttctgttcctgtgttagtttgctgagaatgatggtttccagcttcattcatatccctgcaaaggacataaactcatccttttttatggctgcatagtataccatggtgtatatgtgccacattttctttatccagtctatcattgatgggcatttgggttggttccaagactttgctattgtgaatagtgctgcaataaacatacgtgtgcatgtgtctttatagtagcatgatttatgatcctttgggtatatacccagtaatgggattggtgggtcaaatggtatttctggttctagacccttgaggaatcaccacactgtcttccacaatggttgaattaatttacactcccaccaacagtgtaaaagcattcctatttctccacatcctctgtagcatctgttgtttcctgactttttaatgatcgccattctaactggcatgagatggtatctcattgtggttttgatttgcatttctccaatgaccagtgatgatgaactttttttcatatgtttgttggtcacataaatgtcttcttttgagaagtgtctgttcatatcttttgcccactttttgatggagttgtttgtttttatcttgtaaatttatttaagttccttgtagattctggatgttagctctttgtcagatggatagaatgcaaaaattttctccaattctgtagggtacctgttcactctgatgatagtttcttttgctgttcagaagctctttagttgaattagatcccatttgtcaattttggcttttgttgccattgcttttggtatttcagtcgtgacatctttgcccgtgcctatgtcctgaacggtattgcctaggttttcttctagggtgttcatggttttaggtcttaacgtttaatccatcttgagttaatttttgtataagatgtaaggaaggggtccagtttcagttttctgcatatggctagccagttttcccaacaccatttattgaatagagaatcctttccccattgcttgtttttgtcaggtttgtcaaagatcagaaggttgtagatgtgtggctttatttctgaggctgtgttctgttccattggtctttatatctgtttttgtaccagcaccatgctgttttgcttactgtagccttgtagtgtagtttgaagtcaggtagcgtgatgcctccagctttgttctttttgcttaggattgtcttgcctatacaggctctttttgtggttctatatgaaatttaaagtagttttttctaattgtgtgaagaaagtcaatggtagcttgatgggaatagcattgaatctataaattactatgggcagtatggccattttcatggtattgattcttcctatccatgagcatggaatgtttttccattcgtgtcctctcttatttccttgagcagtggtttgtagttctccttgaagaggtccttcacatccctttaagttgtattcctagctattttattctctttgtagcaattgtgaatgggagttcactcatgacttggctctctgtttgtctattattggtgtataggaatgcttgtgatttttgcgctcattgattttgtatcctgagactttgctgaagttgcttatcagcttaaggagattttggcctgaggcaatgggattgtctaaatttacaatcatgtcatgtgcatacagagacaatttgacttcctctcttcctatttaaatacactttatttctttctcttgcctgagtgccgtggccagacttcccatactttattgaataggagggctaagagagagtatattgtcttgtggccagacttcccatactttattgaataggagtgctaagagagagtatattgtcttgtgccagttttcaaagggaatgcttccagcttttgcccattcattatgatattgactgtgggtttgtcataagtagctcttattattttgagatatgttccatcaatacctagtttattgagggtttttagcatgaaggagtgttgaatattattgaagcccttttctgcatctattgagataatgtggtttttgtcattggttctgtttatgtgatagattatgtttattgatttgtgtatgttaaaccagccttgcatcccagggatgaagcccacttgatcgtggtggataagctttttaatgtgctgctagattcattttgccagtattttattgaggatttttgcatctatgttcatcatggatattggcctgaaatttttttgttgttgttgtgtctctgccaggttttggtagcaggatgatgctggcctcataaaatgagttagggaggagtccctctttttccgttgtttggaatagtttcagaaggaatggtaccagctcctctttgtaccaatggtagaattcagctgtgaatccatctggtcctgggtttttttggttggtaggctattaattactgcctcgatttcagaacttgtcattggtctattcagggaattgacttcttcctggtttagtcttgggagggtgcatgtgtccaggaatttaaccatttcttctagattttctagtttatttgcatagaggtgtttatagtattctctgatggtagtttgtgtttctgtgggatcagtggtgatatcccgtttatcattttttattgtgtctatttgattcttctctcttttcttctttattcgtcagtctgactagcagtctatctattttgttaatcttttccaaaaatcagctcctggattccttgatttttttaacggtcttttcatgtctctatctccttcagttctgctctgatcttagttatttcttgccctctgctagcttttgaattcatttgctcttgcttctctagttctttcaattgtgatttcagggtgtcaattttagatctttcccactttctcctgtgggcattcagtgctataaatttccctctaaacactgctttagctgtgtcctacagattgtgttacgttgtgtctttgttctcattggtttcaaagaagttatttatttctgccttcatttcgttatttacccactagtcattcaggagcaggttgttcagtttccatgtggttgtgcggttttgagtgagtttcttaatcctgagttttaatttgattgcactgtggtctgagagactgtttgttatgatttccattcttttgcatttgctgaggagtgttttacttccaattatgtggtcgattttagaataagtgtgatgtggtgctaagaagaatgtatcttctgttgatttggggtggagagttctgtagatgtctcttaggtctgcttggtccagagctgagttcaagtcgtgaatatccttgttaattttctgtgtcattgatctgtctgatattgacagtgaggtgttaaagtctcccagtattattgtgtgggagtctaattctctttgtaggtctctaagggcttgctttatgaatctgggtgctccttaattgggtgcatatatatttaggatagttagctcttcttgttgtgttgatccctttacgattatgtaatgcccttctttgtcttttttgatctttgttggtttaaactctgttttatcagagactaggattataacccacactgtttttttttttttttttgctttctctttgcttggtaaatattcctccatcccttcactttgagcctctgtgcgtctttgcacgtgagatgagtctcctgaatacagcacactgatgggtcttgactctttatccaatttgccagtctgtgtcttgtaatttgggcatttagcctatttacatttaaggttaatactgttatgtgtgaatttgatcctgtcattatgatgctaactggttattttgcccatttgttgatgctgtttcttcatagtgttgatggtctttacaatttggtatgtttttgcagtggctggtaccagtttttcctttccatatttagtgcttccttcaggaactcttgtaaggcagacctgctggtgacaaaatctctcagcatttggctgtctgtaaagtattttatttctccttcacttatgaagcttagtttggctgcatatgaaattctgggtcgaaaattcttttctttaagaatgttgaatattggcccccactctcttctggcttgtagggtttctgcagagagatctgctgttagcctgatgggcttccctttgtgggtaacccaacctttctctctggctgcccttaacattttttccttcgtttcaaccttagtgaatctgatgattatgtgtcttggggttgctcttctcgaggagtatctttatggtgttctctgtatttcctgaatttgaatgttggcctgtcttgctaggttagggaagttctcctggataatatcctgaagagtatttttccaacttgcttccattctccccatcactttcaggtacaccagtcaaatgtaggtttggtcttttcacatagtcccatatttcttggaggctttgtttgttccttttcattcttgtttcaataatcttctcttcatgctttatttcattaagttgatcttcaatctctgatatcctttcttttgcttgactgatttggctactgatacctctgtctgcttcacaaagttcttacgctgtgtttttcacctccatcaggtcatttatgttattctttaaactggttattctagttagcaattactttctttcagagatgccctgcccagagaggaggaatctagagaggcagtctggctacagagccattctgtacctggctccgcccagtttgaacttcttggcagctttctttacactgtgaggggaaacctgcctactcaagcctcagtaatgtatgatgcccctccccccaccaagctggagtgtcccaggtctacttcagtctgctttcctggcagcaagaatttcaagccattgaattttagcttgctgggctcaatgggggtgggctctgctgagctagaccacttggctccctggctgcacccccctttccaggggagtgaacggttttctctctctggtgttccaggcaccactgggatatcaaaaaaaaaaaatgctgcagctagctaggtgtctgcccaaatggccgcaccgttttgtgcttgaaacccagggccctggtggtgttggcacctgagagaatctgctagtctgtgggctgtgaataccatgggaagggcatagtatctgggctggaatgcaccattccgcatggcacattccttcagggcttccattggctaggggagggagtttcccgcccccttgcacttcctgggtgaggcaacgccccaccctgcttcagcttgccctccatgggctgcacccactgtctaaccagtcccattgagatgagctgggtacctcagttggaaatgcataaatcacatgccttctgcattgatctcactgggagctgcagaccacagctgttcctattcggccaccccgacagccacatcctgtaacttcttccagcccctacccatcatccagttctaaggctgcttccacattttcagatatttgttgtggcaacaacaccactttctggtactaattttctttctttgttttctattgctaaaacagaataccacagactgggtaatttataaaacaaagatgttaatttaactcatggttctggaggctgggaagttaaaaaccattacacctgcatggggtgaaggccttcttgctgcatcacaacatggtgaagggcatcacatgttaagaagggaagaacaagagagctagagagagcttgcttttataacaaagccactcctgagataacaaactcactcctgatagtgacattaatccctttatgagggtagaagtattaagtttccaacacatgaacttttggaggatacatttaaaccatagcagaggtctctcagatagcagtttggagtaaatttaaacaagatagaagtggaaggtggggctcattataatctgatctagtacaaagtgcctgggtctaaatcagaaatacctgggtttgagtccttgctttgccacttattagtcgtgtgacctttggcaaatgatatagcttccgagtttagtttgcttatcagtgaaataaggatgacaattcctacattacagggctatggtaaggaaataataataataatgataataatcagacttacagcatatttcacgtggctggcatatggtagatgctcagcaaatgtcactttcctttccattctcttcttatattggcagtttgcccttctaatggttcctggaatagtgtgttgtgctcctagattttctcagcggcctcttgtttggttcttgttttcctcagatgactttctgatgtttacttagtttccttagcgttttacttctcatttcaatttgacataaagcaatgacgtaaggaccaggtacatttttctcaccttcatttattgtggcccataaagcttaaacatgttggcttgtggactgcagtgtactttttctcaccttagatgttaagtatgtgccccatggtagagttactgaataaaaatttctgggagtgggctctgattttgttaagaatggtagaatatgttagaataaatactatcataagctcccttgattattcttgtgcatactgaagttggagaacgacttaagcctgtgggctttaaggttgagcgcctcggtttctaactggctgttggccagagaccacactcagtttcttgccacatgggccttaccaataagactccttgcttattcaaagccagtaagggagtcacttagcaatataagggttacattttgatgcattgtaatcatgtacacataatcaaattcgtcttatcaccttggcaatgtcctgttggttagaagcaagtcaggatcaaagggaggagtttatacaggggcgtgaataccaggaagcagagatcatgggggccaccttaaagcctgtccccatagaatgtgaggggagaggggaggtagtaagttcagttgtctgcatgtgacatttaaaaaacttgtgggcaaaagtgggtttataatgaatctaaagaagttttgggtgatttattttctctcacaggagaagactctgctgaccagggctcaaccctgacaaaacaattttatgttcatcattttgtattccattcctaaaaagagtctctgaaattgtataaacttgaagcctcaccaaacattgactttccctgcctgtgggaaagcttcctgggtctggagaatattctgctgcccagggctcaccctgaaaaacagccccgagctgtggcttgcatatccctggcctagcagcttttaccaggaggtggccattagcaatggaaatccctaaaccatgatcccaagcactttctgaagagtggggaggacaagttccagaagactgcttttgtatcaggtctattgttctttgggagctcatgttaagcagaggagaaaaattgacttctcagacaagcatttccctactcttctgcacccaccgtcagttcactaggcatctgcatctccagggcaaacatgcctctgaagactgctggagctagtctcctgtgttgtggccagtaagaacttttgcacatttctgcctttcttcctgtccccagaaacttacagtccctaccctagaatggtgagtcaaagtagtccacggttagctgcagtgtcctgaagataactcatggagacaaactaaaaagtcaaagaagttgtatccctccacctgtcatctgagtgttgggggatttctttgcttaagtgggtgacttgggagactttctttctagtagatacttgttggccagcactgacctggaagggcctatagagagacagagctggattaggctctaaagcgtcttcagtgctgggtctcatgttattgcatgtaaattagagatccccaatatcaaaatgtagctattacatgacaattccttttcattaagaagcaattgcttttcattaagaagaggcttcaagacacaggagccatgcaccctgagggtatgggggtgtcattaatgcttaaggtactaaatatgcacacctagttttagctatagactaaatgattaatatggcctgtatatgtgctcctgtttttcacaagtatatgcatactcttgtgatggcaggataagtaataagctctggaaccagactgcatggtttgagattctccatctagaacatacaagctttgtatgtatgtataatgatgctagacaaattgcttaacttctctgagcctcaacatccttgtctgggaaatgaatataataatagcatgtacctcaaaacgttgttgtctaccttatattaaatatttttttaaaaatccttagaacagtccctggtacaaagtaagtgctgtatatattaacctttattactactaatatacaaattaaaagaactacccaagacatggtagctgcttgcagtttgttgttttctcaatcaaaatatattgaaagcacaactgctgctgtgttccttaaatgagcgcagagccagggacagggcctagggctcctgactacacttgccgcatcatttttactattgcagattgcgtgttttgtctctttgcttaatgaaaagcaatcacaccttttgttgttattaagggcttattgtcatttaatggctacattttgctattggagacttttctaatttacaagcggtaattgttctggacacgtgactctcatttagtatctgctgaagagcccttgttcataattattgcttccgtggttatgttatgtatttatccagccctttctttagacaattgatatgttgtcctggatacctccctgttgctgatttggagttggtcaatccatcgcttcatcagtgctcttaaaataatgagttatggcatgctttgtgatcagcacataatgttctgagtggaaaaaactcatggcgactctcaggagtgctattttttgtccccttgcccactcctgcacacatgcttgcttctgtttagccagaacctcatcttgctaatagtggtcataggaaattttctcaccaatgggacctatgtgtgcatatacaagggggtagtcatggggtgttagatttcaggtaaaatcagaagacttttttgtgtttggtcttttctcaagatggtatctgtgtttatttcctagaattgttgtaacagatgactacaaatttgattccttgaaacaacagaaaatcattgtctcatagttctggaggctagaagtctgaaatccaagtattagtaggactctaggggagagtgcttccttgcctcttctagcttctgctggttgctaacaatctttgacattccagtctctgcctctgtcttctcaaggccttttcccatgtgtgtgcatgtatttcccctttctctatgtccaaattttcctctacttataacgataacagtcattggattagggcccaattaacctagtccactatgacatcatcttaccttgattatatctgtagagactttatttccaaataaagtcacattcacaggtacttgggagttaggatttaaacgtatctttttgggggacataatttaactcacaacagtggcttttccttgtctctcttatttttcctagtttttaaattttaaagaagggaaaactcccttccacccagtggcacaggaatgagttgatttatatggattaaaagtcatagatgttagaagaggaggaaagtcctagaagaaattgtagcccatttctttcaccaactgaggtctaggggagagggggctatttggctaaggtcagaaatctgataagggatagagccagtcgtcagacttcatttcctgattctgagattaggataggacttttttttttttttcattatctcttcataaaggtactggcaatagtggttgaaaaaccatgtggcaacagacattgaggcaaatttctataaaaccagaaatagctgggaaagcggaagccaggttggacctgccaatagttggaattcttggctgtctgtagagggtgaattgacagccaaaagccctaccaaggtccaaatctctcttccacccatttcagttcaatctgatcaatactttttattgagctaataaccagaagtaggccctgaggattcactgatcacaagggtagagattatccctgcctttacggagctcacagtacagtgagcacctaaacagtgctagactccaattgcctacttatttttctgagtgcagtaagagaaggacatagtaggggcatccattttgaccttgggggaagggaggtaggagtgggggaaggtcaaagagctgagatcccaaaacatgagtaagagttacccagtaaaggagcagtacaaaaggctgcaggtgaaggagtattcctgacaaagggaaggctttgtgtgagggcttggcggtgagagagagagaaacacatggtggaaaaacagcacgaaattcagtttgcctgaagcacagggtctggggggcatcaagaagagctttgtaaactttgaagagatttgatttttttcccctgggcagtgggaagtcatttcaggtttctgggcatggagtaggcattcagactggggatcccaagtcccatatgatatttaacggagctttattctaaacaaataaggcttcagggatctccattctgggtagatccacctttccaacctttccccccacatatttgttgattcacaattagccacagtgcttgatcgggctctagaaccagagtcccttttataatgttttcaggttttagtctgtggttgaaggccactgttcagtatgtatatttgtgcacctgtgtgctgggcccacatcggaggcccagtacatactggcctcgtcgtttttttttttgtttttttttttaacttaatcacatcggtaatcgccccggggcctcctccgttttttttttatgacagttcgctctgaatttaatgtttgtctggatctgcttttacctttcctgcacatgatttgagctatggtttgctcttctcttgtcgatctgatcccatgtgttttccatcttcagggaattcctcaaattctagtacacagaggcaccctcctgttacccagtctctgttaatggtgttacagttagctctcattcaggcaatggagattagcttatcttaatgtttctcaaggctttttatttttcattattgctcccctaaggagcctttctggacatttttcctaattgtaggacattttaataccatgacattttaataccagagatatactatttatgtgttgtacctatatctgtcctttatatagaacaaggataagtataaggcctacttactctttttataacatgaaggattaagaatgactaacgtttgcagttaacaattaagttaaaaattaaaaagctattaacaattaactttgtgtgtatttgctgagtacattttaatttaatttatttacttaaaaattccagtgtatcaactacatataaaaattaacaatttatataaatttgtaatatttaatagcaaggtgcttcaatgtttaaaaaattcatccaaatctgctctttttccggcgaaagtaaagtaattgaaaaaattaaattagcttcttaaaaaattttactgaacttaacatttaactactgcttgatatgggaaaataacttctaatttaactagctgctagacagtcattcagatcttgctaacagtttttctttatatttgacataattaataatgggctgaataatgttattagaattaaatgataacatataaactgaagatcaaatataaaccacattgacaaggcagccagtggcagccacctctgccatttaacttttagaatgggcgatcaatggagagaaagtttccaatcacagtcatctattcaccgtagttttctagtactgatctggcacacattttgtatgtctactatgaagtcaaggtcagtgttactagtatgatacccaagaaaacacaacaggagaaattaaataacaagctgtaagattttgttgggtaaggttgagctctcgagagccaaaaaccattgtaatatgtaagttttttttttttcttccctcccaaagaaccaacttcaaccctttggagactgtattgaccctttgagaatgcgtggcttatctgattgtgtcctcttaggagtcttaacttcctaacatacggggcccaggagagctaagtattaaaaggatatggacagagtatgagaaaagattcagtcatgagacattgctgtgggtgtagcaccctttgtgggccgctgaaacaagtggcctaggctactagcatgaggttactacagtaatggagtcaaagcagaattaggggctgctccttggagttcttgtatctcttaggttcactgcatctcagtgcttatcatacaatgagtagttggtattttataagttgtctggtctatcagctctgtgcaggcattggctgtttctatcttgttcctattgccagttatctagcacagtgcctggcacatagaaagggctcagtaaatatttgttgataggatagagagaaggcactgcaggtggactcagcctacttcacaggctagatgagggctagatacaataacaggaaaaagaagattcactatttgaaaagaatcccaagccaccacctccaaacaaagccttctctttaacaccacctcatctctttgagcaccagggagggagtcattgtggataggtgggtttgaccatttgccatttagatagcaaagcagttttaatttgaaaagttttagtagtgtctttttaaaatgtgttagtcactactttggttttttaaagcaaatactgctgaatatattttatcttttgttggcaacctagaatcttcctaataagtatcagttcttgaggtacggggatcactttatcctgcaacaaatggtctgagaccaagaactttttgagttcttgggctggagtttctgagtttttctgtcttcttccctggcaggctagcagctatcactttgagttgttgttagaggcctactggtagcacttgctcactgtcctccctctcatttggtagttctaggatattcagatggagagaattagccaaccctgtaaaaactttgtgtaaagtaggagaatggaagttcctagtgaggagttgaggagttctcctgtaaataacaatttctgaaactttgtgtgtaggtgtgggtgtgggtgtgtgcaattgtgcacctctacagaatctgttttgcccttcttcccattatcacctgagttctggatgggtgacatgcactgataggttttgtgctggataagcaagtgattagtatcatattttctcagaagagtttatggagagtatgtacatgaagtttatttttgtcttaatggactgtccaagattcctttaatgggggctcacctttaaataagagaccacagatttccaattaatagaaaaagtaacctatggggatctaggttgttttgtacattgtggactggtacctgctcaaataatcttattcagtagcactatccaacagtgttatcaagaagtgctaattaacttttggttggggaaatgtaattacttgaatgggaattttgacccagatacttacctgttattctcaggacattctaaacttaaacacagttttctttcaccaaacacactttagtaagagataatatcagtagctcttataagtgtgaacagtaccaattttcagcatatgtgaagattaggttcctatgtacatttaacaaagtatttccaatgtaacatggcatgtggcctccctttgatgtcaattccatatttctgattttaaatccttaatctaatgtattgcaatagtacatattatgtgcacaggtctagaaatggaaaacctttgaaatggtgcaaattaatgatgtgttaagtatcacaatttgaataaagcagtgtgaatatcttgaaagaataaagggagagtaaagaatagaagaaaaacagggagggaaaaggaattctcaagggaaataatagggttgtgtaaatacttcaccaaatcgccaagactgacagcagaaaaggtcaaggtcattttaaaattgcaggagactcagttcaagttgcctttgagaagtaatgatgttttgagcaactcaaaactgaatttaagatttggtattgggggcaaaaggggatcacagaaggactccaggcctgctacctcattgtctgacaaattcctatgttctgggtctggggtcaggaccctgcccatcctgcccccattattgtcaccatatttcccaggcatccaagcctctgtgagctggtagggtttgttatgcacttacagcaaaactgacattaggagcacactcagtacagctaacagatcaagtgcaggttcctaaatgtgggcttgttgaacatccctggcctttcagtgttaaagatggacatagaatatttacttgtatctgttttttcatgaaggcttttgatactttgccatgatatttcatgtttttccttttttttttttttttttttaaaccaatggctgctacctggcattagaaagccaaatcacattatagcattttggatcagagctagttgtgaaggcatttttagagtagtttttttcagtcattctttcccttttattcattttaaaaagctggcctttatgatttattatgtaggctgcacacaacaaacattccctcactgggatattctatactcatcactgagaaattttagcaataaattatattccctaagtgtaaggaagcaattcctgggtagtgtatgaagttctactctgaataggcaggtgtgtgttctgtatggcactgcccatgtgggtgtggagtgaggaaacaggaaaaaatgaaggcagagcagtcacgggaggagggcaatggctgagaaggaaaacagttatcatccacttctgtctctcattttccttccagttgctcctacttggttggtaagtgtctaagtacaaagccctccataagcccaggttatcctcctgggaaaggggcctctgctactcttctacctttgtagaaagaaaggaggatgttcacatgagcctgtcacttactgtgtaccttcacacatgctctgtatactgtgctgagtggtgatacatccaccaaaattcatgtctacccagaatttcagaatgttgccttatttggaatagggtttttgtttgtttgtttgtttttgtttttgtttttgcagatgcattaccttcaatggcaaaaaaaaaaaacccagagttacttttgcaagaacctagtaatcaaattaatacaaggtcatacttaattaggatcaaccctaaatccaatcagtggtgtctttataaggagaaagagatttggagacgcacggagacataccaggccatatgaagacgagggcagagattgaaatgatgcagctactagccaaggaagcatgtctctgttgacaacttgatttcagacttctagcctccagatctgtgagggaatgcattcctgttgttttcagacatccagtttgcgattttgttatggcagccctaggaaaataatacactctgttgataaggacttatggcaaccctgacaggtggatactcttagatgccttttatgtctgaaggtcttactgaggaagctgagtcttactgaggaagtcctgcttcccttgcagcacaggtatgtggtaagaacctgtgatgggcttggtgctttaaggattataggtggcttaagtgtaggccttgctatcagcaagctccctgcagatgtgtgtggtggggagatggaacacggaggaaatcgacttttccaataggccctgtagcactaggctgcttgccctaggctgtcttcatctgctcatagacttttggatccctttttttttttttaacttgtttttaaattttttatttccatagatttttgggaaacaggtggtatttagttacacaagtaagttctttatttttattatattttattattattatactttaagttctagggtacatgtgcacaatgtgcaggtttgttacatatgtatacatgtgccatgttgatgtgctatacccattaacttgtcatttacattaggtatatctcctaatgctatccctcctccctcccccaccccacgacaggccccggtgtgtgatgttccccaccgtgtgtccaagtgttcttattgttcaattcccacctatgagtgagaacatgcggtgtttagttttctgtccttgagatagtttgctcagaatgatggtttccagcttcatccatgtccctacaaaggacatgaactcatccttttttatggctgcatagtattccatggggtatatgtgccacattttcttaatccagtctatcattggtggacatttgggttggttccaagtctttgctattgtgagtagtgccgctataaacatacatgtgtatgtgtatttatagcagcatgatttatagtcctttgggtatatgcccagtaatgggattgcagggtcaagtggtatttctagttctagatccttgaggaattgccacactgtcttccacaatggttaactagtttacagtcccaccaacagtgtaaaagtgttcctatttctccacatcctctccagcacctgctgtttcctgactttttaatgatcgccatgctaactggtgtgagatggtatctcattgtggttttgatttgcatttctctgatggccggtgatgatgagcattttttcatgtgtcttttggctgcataaatgtcttcttttgagaagtgtctgttcatatcctttgtccactttttgatggggttgtttgattttttcttgtaaatttgtttaagttctttgtagattctggatattagccctttgtcagatgggtagattgcaaaaattttctcccattctgtaggttgcctgttcactctgatggtagtttcttttgctgtgcagaagctctttagtttaattagatctcatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaaaggttggatcccttttttagtgtcttttcttgattcaaagaagattaacaggagacaagtcaatctgaggaaattcagatagaaatgtgcccccgctgctctcacctgattccttcctgacccactaaagttgaagaaacaatagcttaattttcctggaagagggtgttgggatctaggaaagctttttagggatgatgacatttgaggtagattttgaggaatttatccagttggagaggagggaaggtggagagtggaggcattggtggggaaaggattttaggtagaggaagggatgagaggaaaggtgcagaaagggaccggtgctggtgggtctggggcaccactgttagtaacacacagttggagtgtaagttttatggcttgaaggggagtagaggcagagggggaagaaagggaggttgacgtcatgatgaacagcatttttgaagcttttttctcctatttttaaatagctttattgaactaattgacatatgacaaatagcatatacttaaaatatacaattttataagttttgacatatgtatataccatgaaaccatcaccacaatcaaggtaatgaaaacatccatcactctcaaaagtatacttgttcgtttttgctatccctctctcccagcctctctgatttgatgcccatttgatttgatgctgatttgattcctcctcactagagtccctttgagggggtctgcaaaatcctgcctcttctaattacatatctgtgtaatactggagtttcttcatgtacctcagctaaaacaaactaccataacaaatcagatgcagaaacaaacataagaatccagctgtcctccattaacccagacattaaagagatttgcaaaaatacaaaaccgtgttgttttgacctacatttttggttgttttgaaaaatatggttatgtttcataaaactttagttatttttcttaaaaatatgttacttatgttaccatgtaattatattatttatatgaacatgttgttggtttattattgtgaatttcaagggaattgatacctgaatatttaaaaattttttgtttttatttataattcaatatatattgacagatgtagctcacaaaatataaggtctttggagtactgtttttttcccccaagaaatcaccctttttttctctgccacatctcaattatttttaagattctgagatcgaaaagcttgatgatcgttgctctagaggctttggtaacatgctaacatttgtggaatttctttccttaactaatggggacctgttgaagatcttttcagcagaggaatgaggggatctgacttgcttttagaaggaggactttggcagtataaggatgggggaagactgggcagggagaccaggaaggagaccattgcaggagtccaggcaaggcagaatgagtgcctgactgcagtgcatgtcaggggggtcttctggagaaagtgatatggcttgaggaataatcaggacaggaggtacaatctcagggctttgtttctcataggatgtgaatgtgaactggcttccccaaaaggggagtgtctcaggcagtggttaagagagaagcaacttcttgtctccagggtttctggcttgggttgtggtagaacaccatcagagtagaggaaaagggttggcaagggctgggctgaacttaaggtcagagttcttttcacacaggccaggagggggttcaggcttccctgctcaatgggcactcaatgcatagagtgagactgtggtgagggttacagctcagtgagtacgccatcccaggcctgaggctagcagtgccagtgagaacaggaagggagagaaggaggggagtgctgcaccctgccagggctacctttccttggctttggtgtgtgtgggcttcagcttgcatgttggtggtctgcagagctggccactgggaagggaagtgaactaacagaaatttgggggtggcaggtgcatattagggtagcaagaagagaaaggcagtcatttgggcctggaaccatactagaaggcagttaggagactggagagtttgatttatgtgatcagctagtatgtaggtccactgtgcatggaagtcccttgggactagattttgatgcatccccaatctgtgctcaaaggctccagcaatgccctagtggagtctggttggagcccaccttggagggaagcagtcttcatcacctaaaacagcagcgccttatttaggttagtttgtcttcaagtccagagaacattttgggggacaagcaggtccaaaatgggatgaatgggggacatcttccctaattgaacagtgagagcgcatccacagcgtggggaagacagacaacacagagtgtactgaagtacttccttttgaactttgttaaacctccgctaatttgaatactagtaatccaaataatgtccattcggataaaaccagggctataatatttacttttgtaattatgttatatatttgttaacatttaacatttagtcaggcctgtgttgcggttgctgtgtggaagcttatcagtttttgcaaagtgtggaacacctgtaaatgatgataggcaccttgttgatgactgtgaagcactggggctcttccagactactaggactattaccataggcatgagtaatatggaatcagtaacccagattaccacataaatatccaaacacaaatgagcttagagacttctggctcccctttcaacatctttatagcctgattttcagaggcaggatatttcccactggtttttattctcatgagtaccttgcattgcttatcctggttatcaaacttagggcatatatagtgttcacagtgctaagccctatctttgacagtgtgctgttataacattttattttgtatggccttagatgattctccaaatgctgagtcttttcattaaaaagtctatcaggacctctacttgcaaatatttctttttgtgatatgtggatgatgacatatcaaccatccaagatggtgctggatttgaacctttttctaatagcagtgggaagtcattaaaggattttaagcctagggtaacatgattcaattttcagttacatgcgatatgtggatgatgacaaccaccaccaccacaatgaaagtaagaaaaaactgatcagtgctttttctgttcttttcttatgttattgcatttaattctcacaacaacttttgagacaggcattaattttactcttctacagatgaggaggaaaccaaggctccaagaaataacaccacttgccaaagtcatatggcttgaaagtgaccaagccaggaattgaattcaggcaggctggtggcctttcttaaccattacattgtacccagaaattgaaaaccactttttcccccaaactgttaagaattagagagatttggtactctgccagtactacttactggcagattttgaaaagccgtgtacttaattaaagttttcctgaagagagtactttgctattctctgaaagtttacaccttccctatttttattgtctgtgatgatgccatttatgtttttatgtggtggtatttttatctttttctttctgttagctgtcatttttacctatagaacctgtggccaattatctgtgccattttctcacttgacaactaaaatattgacaataaacatcagtcattgcttgcagcttagaaaaaaatgcagtgagacacatttatcataactgagttttggaaactagctgtctttatattcaggtgacagacacacttgtaaacaactgatgtttacagcaccaacttagatctcacaggaggaatggggtttttttcacttgcctatgtattcttcaggcagaatgtgtaccttaagtgtttgagcccggcaatgtcttcagtctgcctgagctccaaggttctctttttcggcttcttaggctaatcagtgtgtgggtcctagggcacacaaaacccatgacattactactttcatagatgttaatgtgatctgagctgtattataaggcacttgcccttagcagttagttaagaaatattcactgagtacctattatgtgcctactggaaaccagagtattgaatagaatatatatggtctccatgttaatggtttattcagagaaacagaacattgaagaactaaatatacataagttaataagagaagtaggaagaaactgcaaaggagatgtacaaacctgacggacttttccaggaaattgacttttcagctgggatggaagaatgtggaggggtcattatatgatgagaagggaggagagctttgcggttagagggaccagcatgtgtgaaggcttatcagtagaataaacaataccatgatagagaaacagagaaattcagcagggctggagcagacagagtgagtggagggtggataagacggtgctggatttgaacctttttctaacagcagtgggaagtcattaaaggattttaaacctagggtgacatgattcaattttcagttacattttgaaaaggtcaatgcagttactattcatttcacaggtaattattgaacatttactacattccaggcattgtcctcggctctgagggataagccaaataataaaatagacagtgaattccttgcttttgtggattttatattctagtggagtggagtttggagatagtaaagaaaccaacaagtagaacatatcacatggtgaggagtgctatgaaagcagcaaaggtccaagagtgtgcccttggggaaagggtgccaattgtgtgtgtgtgtgtgtgtgtgtgtgtgtgtacactcttatctatctatctatctatctatctatctatctatctatctatctatcatctatctagtggtgaggaaagacctcgaggaaaagctggcatttcagcaaaggcctggtggaagtgagagattgaccatgaaggaaaagagctttacaggcagagagaagagcagacacaaggcccttaggagaaaggagaattggcgtattcaaggcccagcaacaaggccaatgtgacagaaatggagtgagcaaggaaatgcggtggaagatgacatctctgagatagtagggacccagatcatggagagcattgttagccagtgtaaggattttagttttcatgttgagtgagatgggaagacattgggggaatgataaaatgcacatgaagtgttaaaaggattgatctgattgctgccccatctcccctcccccatactgcctggatgctccgttgaaatagaccctaagggacaaagtggaagcaaggaaatgatgacttggaccaggggcttcttgtaaaggtggtaagatggaatgacttactacagaacacatttgaaggagggtgagaatagaagcagggagcagcctgttgcagtagatacattaggagactggaagaaagctgatggtgttctggaaatgaatatgggcctggagatggagaggtgtgggaatatcagatagttagttagaacacagagctgacccacaggactttgccgatgggtagcatgtcaggaatgagggtgagggaggagtcaaggatgacttctgggtgtctggctggagcactggggtgatgtcatttattgggaccactaggcacatactagtttggtggtgaggtgagtgaatgactccactttgaactgggtttgatttggaaattcctatgaaatgtgaaaggggagaaacagagtagatcattggatatatgagtctggatttcagatgtttgacccaggctggagatgtagatttaaaggttaatgaggaggaagatatgaatgggaaatgaagtcctggattatggatgatcttgttgaagagtagagtgagaggagaaaaagatatgaactaagttgagtaacacctcttttaaaggttgagaggagtagaatcagtaagagacatagaaacagaatatttaaagacatagaaggaaaatcaagagggcatgcttcagacaagccatgtatagggtgtttcaaatagtaattgtcaatagcaatcaccatactctcttgcctctgtgcctttgtacgcatttttctcagtacctagacttcccttctacccttctctgtgtttttctcttacggtatgctttatttttcctttcatgcctagcaactagtatattgcttagcatgtagttctaagtaggtatttgttgagtaaatgaatggatgaatctataatggacccataaagatgacaggtcttactacatttaggttacctttttctttaaggtatatttgaatcattttaagataagtagaacaaataaattttccccgctttcaatccatcaccattgtgcaatcctgaaagcttgaacattcttggtacctttaactggatgccttcctttgtgtagtctcctttttaagcctgtaaggaatttaacactttgtttaatagacttctttaaaaatatgctcatgttttgttggactttgagtgatctgttaattcccaggtaagcatttctgtgtgcacatgaagatgcataactcatacctatttttgtggactcttgggcatttcatacagttctctgcagatagtaaggcactcaatacgtctttgcctaactagcttagcagtgtagtgatgggtttatattaattaataacaggtcgggcatggtggctcgtgcctctattcccagcactttgggagactgaggcaggcagatcgtttgaggtcaggagttcgagaccagcctgaccaacatggtgaaaccacgtctttagtaaaaatacaaaaaaattagccagtcatggtggtgcccacctgcaatctcagttactttgggaggctgaggcaggagaatagcttggatccgggagaaggaggttgcagtgagccgacattgcaccactgcactccagcctaggcaacagagtgagactcttatctcaaaaaaaaaaaaaaaaaaaagataaataacaagtgtgagctggtatagacaaactggtttagaatcaaaagacctgggtcagagtccacgctgtgtctcgtacagattgtgtgatattggcaagtcattggacatccttgaacctcagtttcctcaaatcagaagtgagaatcattttaaaaaggttgccaggaggatcagatatgaaagtgctttgtaaactggaaatccttcctctgtggtagggaagcttgccattgaaaacccatccaagcattctgaggcctggggtacatgatctgtacccagtctatgctgttgtttcccctgtactgtgtgtctgtaagatatgggtgtattattaagtgagctctggtggctgccttaagccctctgtgtacttgggtctctgtggatggagttgttcatgtgaaaataactgatgggctgtaggtcacagacctgctctttgagcctagtgtggacctgcaatgagcagactttttgtccttggtgcagaaatagcctctgacttgggagagaggggcagagtggccaaatcctgctgtcttacttcttcaattggtttctataatagcttctctaaggtagggagtgctatggttaagaacttgggctttgtagtaaagcagaagtgggtttgaatcccactgctagcacatatttggtgtttgggcttgagaaagttacttggttcctctaaccttccgttttaccatctgtaatttggggataataagaatatctacctcacagggctattttgaggaataaatgagtgaagcatgtaatatgcttagcatagttcctggtgtacccagtaagtgcttcataaatggtgtgtactattgttattattgtttatgatgattccagtgggtcctttcaactttgcattgacaaaggatagtccctagtcaatcataggatatgggaacaacggaaattccactttttaaccattactctggactctgtctgcaaagatgatgattggatcttgttcatttctgcattctcagggctgaggctagtgcattggccagtgagcaggcactgaatacagggcagagaacttgaactggccgtgtgaccattgcttcacggtgatctaaaatgctttccctaaacatacacacaacacctaactcattagatgagttgttgaagtgggtttagcctgctgttgcagtctcaaaactccatcagtgggtgccagagttgacacaatcaaaatatttcttgaggaaagaataattagcaaaagtgagtgttcctcaattagggcctgagggttctggtgctttgattatttccaactactcatcactaggctggatcccaagtggaatacttgggtgggcttctgtgtgcttagccctaatgagtgtggcagtacatctggtacatgcctgagttctaagtggtgaagaagtctgtaacttagcaattgcacagttaagtagctgcctctggagagtggatggaatcaagaaaagggcccagaaatctctgcataaggtactgcaagaatgcctcttgagaacttttggaaatttggttggtatgtgttctacaagttcagttgcttgtttgtgtgtttgcctaaccatgcagtttctgctgccttgttttacttatatgctgcttatataatccccctgaataggcaattgtggtaaagtgtaaaaggcgtgagatctagattaggcagctaaaatatcaaatcatagccctgtttaattgactgtgattctgggcatgttgtttagcctctctgagcttgtttctgtctgttaacaattagaataataatgcttatgttccagtgtgattgtgaaaagtcatgggataacataggtgaatgacctatctaaatgtctggcagtctcaggcttaatactaggtgtaatggattgtgcagaaaagagttagcagagtaggcctgactgctatctgttgacatggttgggccttggctggcatctgggaattcgtctttcaggagggtttccaccattctttaattgataaagtgtctcttggtgcctaagccatttgtacaaacactgtcatttttaccaaacacctgctttcctctggggtttttgacattttggtatgtgcttggcagaaagtgtctacatgaccaactctctccaaaaacccttggcactgagtctaatgagcttccctagtagatgacatttcccatgtgttgtcacaacttgttgctgtgagaatttagcatgttttacgtgactttactgggagaggactcttggaggctctcacctggttcttcctggactttacctcatgtgctttttccctaggctggttttgctttgtatccttttgttgtaataaattatagttgtgagtgcaacaatttgttaaatccactgagtcttcctagcagattattgaacctgggcttgatcttgagaacctaacacattgatacagatttaaatgtagaacacatgtgttgcccttcagaacactcacactttactgcaaaggcatacagagtcatataatggactttagagactcagaacggggagggtgggggggcagggataaataactatacattagttacagtgtacactactcaggtgacaggtgcactaatatctcagaattcaccactatagaattcatccacgtaaccaaaagccacgtgtacaccaaaagctatttaaataaaaaaatatattgaaaaaacaacactcatacttcagatagaaagcccaacatgtaagcatataattacaatacaatgagtgatgttagtgcagagggcaagggtagccctgaagagtagccctggggatctgggagaggtttttggaagagttaacacttgttaaatcttgaaaggtaattagaagttaactatctgaagtgggaagaaaagagattatatacctttaaagtataacatgctcttctaaataattttagatttaactcaccgctttcttttttttagcattatttaattttattttgaaattttgacatgatgaaggacgtgataggactgatgaagacgtacagagacagaacccccatagggtggcagttgagtggatcactgtgcagatatgaaagtggaagtaaaaacaattctttgagcccccaaatattaggaattggcagtgatgcttttagcacctccatatactatcagtcattttaaacatctaagactcccattgcagaaacatggcacatagagtcaggaaactaaggttgtatagatatttgcaatctgtaactgtcctagtgtcaagcacaagaaattcagtaggtgcctcacataaccaagcactgatcattgataccaagaccagatatgtgatctaaattagcaaagacacactccatgctgctttgaaaagaattaccatagatattatgcttttacatgatcatctctttcagcaacaccaaattgctctatcacccttcaattcagatctccgcagtaaaatgtttttaaagcaatttgcagcatttcactttctgtggaccacaccctgcctggacagtcacttttacaatcatcactttcttatggagctaaacaggtgaggatcagccccaggatactagaatcttgaacaaatggatatatagccactctaaaattgcaggtaggctctttcactcccactaatacctacaagacattgcaaatagaaaggacagcaggactggccaaatctatctttggctttctaaagtcagtctcactgtgcactgctctctaccagagtaagactcaaggataaatgattttagtgaattaaagagtttttaaaaataaagtaatgaattaacaatttaaaaagaatgaatgagcagttttttttttctgccattcatctgagctcctgtgaaatagttccaatcaaggttctgcccagttaaaaggaggaagagacctcagaagttgtcttgacaggccggttgcagtggcttacacgtgtaatcccagtactttgggaggctgaggtgggaggatcacctgagatcaggagtttgagaccagccgggacaacatggcaaagccccatctctacaacaatacaaaaattagccaggcatgaggatgggtgcctgtaatcccagctactggggaggctgaggcaggagaactgtttgaacccgggaggcagaggttgcaactcactgctttctttacaagggtttaatgactctatgtttaatcattcatcaaacacgggttgagaactatgccttaaactactctacgttgtgtatcgggctccaataatgaacaggaatggtccctgctttcaaggagagtctggcagtttatgggttgacatggttggattttgaggaaaccatgatgcaaggtgatgcaagggacggggtgtaaggtaaagcattctgtgagagatgctatctaggcttaaggggaggtaactttctaccagcacaggagaaaggcgttccatgaagaggaaacagcatgtgcaaagtcccactggcaagagagacctgatttcttctgagaataataaatagttatgtggatctgcagaatggcagatgaaggggatttaaacaggtgctatattttgacaggtagtaaaatcaagcttgaggaaacagatgaaaggattaaatgagctgtattgaggaatgggaaagaaattggattaggacacatagtattagtacacaataatgttgttgagcatggttgaagacccaagtgaggttggacaatataactagtagtgccaggccatatgattccatgacatatgttctgccatgttgatctggagttagggggttgccaggtgggaaaaatggaaagaagaggcaaagttgttaagaatattcgtaaaataattattgaagtcagggaccatggtatccaagatggaagacaagtgtggcctgatcgatagacttaatggagacttcatagcctcctgactcttctagtttctaagttccagaagagtgagaataaaaggccgaggaaactagtgctcagaaagtaggctgcttcaatttaagatttcagagttgaactgttccaggtgagaacaaactctagtggtcaaagtgggtatgtaaaggtaaatatctttggagatgaagagagcaaggaactcagaggccggaagttggatatgttgtccacatgtgtgttgaagtcacctggggtgaaggtggggcttgtggccaagaggaaacttgggagtcaggtaccacagcccccagtgaatatgagaaggtgcctgtgaggcctaaggtgacagtgatgaggagagagagagagcactataattgcatagttgtgaacctcaaaggagaaaagatacatttcttacaatatgaagccattcttcttcctttgctatgttaagtggagtttgacttgggacagtctatgctttggcctttggatgtataccctttgaaatctgtacaacaaccaccaggacattcctctcactcctttcccctcatcttgggcgtttctcaccagtcttctggtgagaatttttttttttttttttttcacgtggtcccagcttgagtttactgagcctcctccaggctcagatatgtgcttgcctggagaaactgcttccaaaggccaagcagccctgcctttggagagctgcttttgttacttacaatagtgtttcccagagtgcattccatgaaaatattagtctttcaacatgctgaacaatgaaagaatccatggtcaaatcctgagaacatatgtccctcttttagagattcataaggtacattagtatataaagaacctaagagattttgcagtaagaaatcctttgtgtaacctagcattacccaaatgtattttaccactgaagccttttttcccacttactctccatcaatacccagtggatatacattggaaagtgctggtcaattataagaaaagaagtatgtggattttatttcccttgacctatggccatagaagaggtacatattgcaacactggtgtattttcactctactaaaatgagatcttactatgttcctgagtttaaatagcaagaattactacatttggttagaattaacacattaaaatagtttgtttagtctgtcattcttatgtttaagtggcaatattaggaaattaactaagagcatttcattttcctttggaagaattcccatagtcaagattagaatcttaaaatgaaaatatacatttttcaaagtcctcttgctcttattttaattaaaaatgacagcatagatttcaaactaatcacattatttgctcttaaggtagtgataagatttcttcacagatgtgtgcatatcattcataaaaatgacatacttggacttagatacatactttgtaaatgttaaaagacaaaagtactaagaaagcattttgtgaaactacaataaaatgagaaaaaattaagggaaattaccaacatgctctcttacataacaccttgattttgatagaagtgcagatcctaataacctagacattttaaaaagcaaaacaagcataaatatgaacataacaaaatagtgttgtatgttgccaaagtggtgcttggaggaagatacattactctagatgtttatgtcttaaagaaaggaaggccaaatataatgaattaagcttgcacctagatgctttctaataggaagaatgtcagaagccagaaatggtgggcagaggaagtagtaaacgtaaaaccagaaataaactagagaaaaagctattaaatactacatcttgtctttgaaaaaaatgaacaactgtttagctaactaaaaaaagagaaaacacaaattcattacattagtactgagacaggagatcagatgatgaatgtgaaagatttagaaatttgcagagaaacaataaccttctgtatgtgctaataaatcagatgaaccagagcagaaatgaatgacctcctgcaaaattatataaaactcgtgcaagcttaaacagaaaacatgaatagactggtagcaaaggaaggaataagaaaaataattaaagtcctatcataaaatccacacaaaccatgggtttttggctccaatagattaatagaaagaattcagacttctagagcaacgttgatcttttttatttttattttttgagacagggtcatgctctgtcacccaggctggagtgcactggcatgattatggctcaccgcagtcttgatctcctgggctcaaacagtcctcctacttcagcctcctgagtagctgggaatacaggcatatgccaccatgctcagctaatttttaaaattttctgtagagacagggtctccctatattgccccagttggtcttgaactcctggtctcaagagatcctccaatctcggcctcccgaagtgtgtgagccactgcacctagctctgttcatcatttttgactgcctactgtaaatttaatcctttgcacacacacacacacacacacacacacacacacacacacacccctctatattctaatccatacaacaattatatatgggtaccattagtaaaaccagtttacagctgatctaataggctcagaaaggttaaatggcttgcctgaatccctcagcaaataagtgatagagtggggatttgaacccagatttatctggctacaaagtttattatcttttcctatgctatactttctaccagaataaaaaaattctctcataaactgtttttaaatgttgaattgacactagtttacccaattcctaatttacattttgaggaaacatgatttcaatcctcaaattgggaaaaagtacaaaaaaaaagaaaattataggccaaccttatttatggatattcattcttcattaagaattataaatagaaaaatcattccacttacaaatttatctttaagtggcatttaatctaggagcacaggatacgatgataaaacaaaaattatgataatcatattaatacgaaaacgtaattaaaataatatttttaaatagatgttgaaaaagcatccaataaatgaaacaactattcttggataatttatttggcaacccaaaaacgagtatgattttcatatattttggtataaaatctaacactatttcatggggaaaagagaaagtccctatgaaaatagaaaaaattacagatgacaaaaataggactaaggctctaccattttttaacagtatagtagaaatttgagccataggcattaataaggaaaaagtaatgccatcagcaaagaaagccaaacctttcttaataggtctagcacctaccgtatgccaggcattgtgataggtactggggatacactccagaaagactgtgcatgtctaggacacagaagactatcaaatattagttggtataaatgagctcagcaatgtcatgtaattcaaagcaaattaacacatgtttttagttgcaaacaattgaagaatatagtgagtaagataattcatttgcaatggagacagaatacattaaatactttggcattaatttaatttgggacatgagatttatttaaataaaattatacaatcataatgggaagaataaaagacattaaataaatgaatggagagatgccttgttccagatgaaaagacaaaatataagaaagatgcaatattccctgagttaatatatagtgtcactacatgccaattaaagtcccagtgggttattttataagatgtgacaaattgctagcaaaatttgtatagaagaataaggaggcagaaatactaaatagtttaaaaattgttcatttgaagttatacttctgtcacatatttgttcaatcttttgttagttccttgttccctattcattcagttcttactactgtccccgcttcataaaaggtactccataaatattggttgaaagcagaaaggaatccttattgaaggactttgaaaatgggcttgagacggacaagtggctttctccgaaatgtcagagaatcgataaggtggaacatcagggacttgccctcattttaaacaaataaggcaggagtggtcacagtgagaaaggaagagactgttcctgggtctagtagtgtgtctgctgacattttcaagcaaataaaggatctgcctcctagccctctgcctggactttttctcagcatgtgtttgtgttacagatagggccatcatgacacttgggagctcgaactcatcattatcttcataaagaaatgtgagaattttgaacttgggccccagtctggtatctcctagctttcttttgctgctttgggtcttttcagacgcaagagatctgtcatcttttggggcctgtctctaatatgcaatctttctcaagtgccccttacaaaaaatgcctcttcctcctctgcacttatgcatgcagtagtttatttgttctacaaagggcctaaagaaggccatgctaacaagggtgggatttaggctgtcttctccctgttctccactgcatcagtttctgagctgggctggttatcagaatcacttgaggagccttaaaatacacatattcttgaccctggtgattcagatttagtagaactgaaagtgtaatatgtgatgaatatatcatatgatattataaattacattatattaaatatttcattatattattacatattatattaattacataaattacacacacacacatgtgtgtgtgtgtgtgtgtgtgtgtgtatgtgtgtatgtatgtgtatgtgtgtgtgtatatttccctgattattttgctgaagaaccaggtttgggaagaatgcctccatagcatcagccagagtagctgcacagaggagctcccccctcccccaccaccacatttattgaatgaagggattaaattaggaacaatgttcagactgattatagtgttgctatgccaaccgttgttgcaggtgctgaaatagactgcagaaggtctagtaaacacttaaaatgaaatggtccctgaccagcattgtcattattataactaatatttatagataattatttactagtttccattagaatgttaataccagagagcaccactctatctcctattgactgattagcacagtgcctcacacatagtaggcactcaaccatttatttaatgaacgaatgcaacgttttcattaattttcacaatgacattataaggtgggcaattttcatattatcatttcataaatgaggaagtcgaagcagactgacttgttcaaggtcatacagctagtgagcagttgacctgcagttttactccatgtctttgtcatgctaaagcagaggctatataggagaaagagcctttggactccattgactaggcagaggccagaccaggaagggcatggatgtagacagcaggcaccccagacaggatggcacaagcactggggagaacaattagcctcaaggtcttggaaaaaattcagagtatgagatccagagaaccaagtgggcctaggggattgtggtagtatataatgattggtgtcgtagttactgccgagagtatgcattctaggcctttagagattaggaaagaataagataggtatccaggcctttaggaactgggaaacagacagctttggacacagaaacaaaacaagaaacaagttactgggtttggaagatgaggcagggatctcactctaaggaagaaggataatcccggtaatgagaactagagtccaggaccagggcagcacctgcatccctggtcctgagcgtgatcctggtactgatgctgtttcttaagctcttgagtttcttaagcttctgggcaaattgttttccccatttgagcatagtccaggattcaggcttaggtagaataatgcctatgagtcctggctaaggaacatcagaagtggaaagagaggcagactcatgcagtgaaccaagaacctcccttaaactcaaaggagggtgaggttctaaagcgacatcagcctgttttcctagtgatgggatgtggttttgactcctggtatgccaggggttggtgggataatgattataagtatactcttaacccttgtattggcttacttgcccctgaaaggtggtcatatgtcaaagttaccaacatctgctcaagcacaatttcctaagtatgtgctgaaaaataagttaaggggtatttggcatgtcattctccttagcccttgtgactgccaagagtgctggccctgagttgcctgtggtggccagcagcctcagctgtttcccccagcatgccatgtacgattggcatgctgtactaagtgccatacatgaaaaaagttgggaaacattactggagccccattccttgttggcctcttcattactacactacaatgtcctcttccatttgtacaacaccagagtggtggttgtcaacccctttcctgcctcagacctttgagacacactaatccgccacaggtaaagatacctcacccagctctcattctcaagaggtgaagaccttgttctagatcttcccagggctggatatagttggagaaagtactccaggtggctctgaaaaaccttcttgtggaagggggtcatgctcctatctattgagaatcacacatcttagatggaagaacattttcactcctatgatcgcctcccttcctctgaccaggtggtgatatcatctccaaattgtgaataaggaaggtgaggcctaagttgctcaaggttctcacagtaagaaagtggaggaacctgtagtaacacctgggtatggtgctttttttctgcggcactgcaccctccattcctagtactaagattaatacctaagaagaaaatgatcaagtgaaaagccaaggtccatagccatgctagtagatggtgagtgaagtagtacctaagacacattggttgtggtgtcgcgagttggggattggccaaagttgggtgtggtgagctgaaatgaaggaggtaagccctttggacaggcaagaggacccagtggactgggatgtggctcagacaacagacccctggtgaagccattctcagagctgacatttgagtggagaaagatttggaaatagcttttgggcttgaggcttgcagggatgaaactgcccagcaggagcaggttgtactctcctgctgactttcttcagccacacctgtctactggagcacagctccctctagaggtcattattcttgccgacgggacatgactgtgacctcatctaagtgccaaggggattattgaatgctgactttgtgtgacattaaaaatacaggccagccaagcctgttcattgaagcaggatttatttggtaccattttccaggccatgccctgtgttctgggtactcagaatccacagatgaatgagccatcccacagagaagtcactgtcttgggtttcagacagatatttccagcccagtgtgattcgtactttgataggggcaggaactgagtgcaaagtggaggtggagaggaagggttagattcccgatttctttggagcactgacagggcaaaaggtctgggaaggtttcctaaaggaggggactcttgagctgaatttttaaaaatgagtaaggcttagccaagtagaaacaaaaggggaggacgttctatgggaagggtcagtgaacattttctgtaaagggccaaatagtaaatatgttaggctttgtgggccatacagtctctgttacaatgactcaactcggccttgtagtgcaaaaaccacaacagacaatatataaatacatgacctttactgttgtagccatggctgactgctgtcatgtaaagtataggtacatttatcatccctatttgactgtgaagaaatggagtctcacagcggtgaagtgacttgctgaaggccaaccagttgattgtgtgttaagcacctcatctgaacagatgaaacccaggcactggtagcaggggttgagggtgtacatgggatatggcatgtaggtgagctgcagtagatgggcatggactgagctgtgagaatctagaatggtcctagcactctggatctattttcaccctctatccttgtccgttccacctaccagactatccctttctaaggccttggctctgctgtagctgtgtgcttgtcagccatgaatcttcattcttactgtccccctaacacagggccaggcactgagcagatgcccagaccacgtctgcttaactgatttacctagcattcagttaagggctatgggtcctttaaataactctttttaatataactggtatcagattcttttgatatttccatttgttttaattgctgcaacttaatgttcataaaaactaagacatacaactttatggaactgcatcacaaccataggaactgcatcacaacaatgggaactcttccagattatactggagcttccccaaagagaaaaaaaatagttttcattcttaactaattatttttaagtgaatggcaggtggaacactacaacatccataattttgcaagctgagaaagagctgaacgtctttttattgccaaaaaaattgctggtgttagtgacaacagtttttttctggatctgattgaagacatttatgaaaaatcagtcctaaatatgaatattcccataaggaaactgcttctaaggagacttaaaaatactcctgaagtcagatgtgtatcaatttctatttttgtgacttccccccttaacttccataattgattttaattgattgggtccttgttccatgtcgtgaacatttgggactcataattttgaaaaaaaattaaaagattttcttttggtttcatggacagaagcaaaaaacatatattatgtgattttggtaattggactcctgttttggaggctgagaatgtttgctgtctatgcagctgggatgggagttagcagtcgcaccctcttcctaggggaaccatgtgagagagctcccatttggaagcctaggctggttgtactcatcctcaggccaccctcagcctgctttcttccccaaatcctggtttacttctgtggaacatttgtctttcttacttgattatgttaataatagcaactgctcattgagtaccaactctggactgcactccatagagatgcttttgattgagcctcacaaaaaccttacggggaacttattgttatttccacttttccagatgaggaaactgaggtgaggtaacctgtctaggttgactcagagtggaagctagagagctttgatcagaccccagaattgtctaattccaggatctgctgttttcatttcagtggtcagcccacatgtggagagaagttcctatgctcacttgtaggccctgtgttgcaaggcgggtatgatctggacatcaaaagtagtgtatgaggatggagagggtctgggagtcaagacctgtgagggcactgaagggactggatgatgtttatcctgaagaagaaaagacttagagggaagtgagagctaaattcccatatctgatgggccttagttgtgaaaagatttctacgttcattcatacaatgtcttacttgcctcctattatcccgttgttgagggagagattcatgtcatggggttatgtggatggctgaacacatgacgtctgtcactgaacagacaagactgacagcagtttattagccacatatactcacatcccagggacgagggcactacatttcatgcaaggacacatgggggttcactggtgaacaaagagaaactcctgaagaaattgaagcagcagggtctgtgggaggcaggctttgtagtgtcaagagagtggggttccccgttccctgggaagatgtgattggtcggtttgaataactccacactctggcagggaactgaaactccctactcgtatataggcaacaattgtgcctcgtccccttgttaaggaggattgtttggctaggggaccttatctacaagagtagagtgggaaagagaacttgtggttatggcattcaaggccctcctaattttaccacctgcgaaggcagcacataatactgggccttaatttaggacttagatcacatatattcaacacattgttattcaacacattgttattcaacacctgctgtgtgcttagtaccattcttagtggggaggatacagtggtgaacaagacaaagtgcctgccttcatggagctgacattctaatacagaagacacacaataaacaagtatataataccaagttgtgataagtgctttaaaagaaaaaaagaagggaatagtgcctagagtgctgttttagttatggaagtcctctccaaggaggtgacatttaaactgagacctagatatggtgagtgagccattgaacaactggacaagagcatgcctgggagagagaagagtaagtacaaagcatctgtgctcaagatctgcttgttgtacctgaggaccagcaaggaggccatcatggcgggagtgagggggaaggtggcaggagacaaggtttaagagataggcagaggccagatcttgtagggtcttgtaagccatggtaagaacgcgagcatttttaaaaaaatacaataagaagcttttagaaggttttgagccaggaagtgacatgatttgacttatgtttttaaaggatcagtcgatgttcttttgagaataaacttgtgggaggcagaggtgggaacaggaacactgtcctactccaggggaaagctggtggtggcttggacttgggtggaggtggtgagaagttattactttagggcagtggttctcaacgggggtgattttgctcccgccaccctggaacatttggcaatatctggaggcattttttattgtcataatgtgggtgcagggttgctacaggtgtctagtgggtgtaggtcagcgatgttgctaaacattctacagtgcacaggacggcctctcacaacaaagaattatgtggctcaaaatatcaatagtgcctaagttagacaaacctaccctagagatacacacatattttgatgatagagtttgcaagatttgctgatggattggatgcaggtgtgggagtaaggaggagtcaagaatggtcccaaaaagtttggtctgagggactgagtaaatgccagtccttttactaagatgaagaagtcttaggggaaaggtttggatgggagtaatcaagaattcaatgttgaattttgagaagcctgttatatatctaaagattccttagaggagaataagaaggagtagccaaggaggaagaatgtgaatcaaaagagtgctggttacagaagccatgtatagaaaagatttcacgtgtcaaatgccacagaaaggttgaataagatgagtgagaattgcctattggatttggcaatgtggagatcattggtaatcatggtaagtatggtgccagtggagtggtagagatgaaaacctgcttggagcaggttcttgaatgagaatccacctccttatgatttctgtctaacagctttacttctatgtgttctggaatagcacagagaaacttgcacttacaaatatgatatttactcctcaaaataacttcacaccatgattaccatccccaattatagagaagggaattgaggtcttgtattaatcctgtcttttattttctgtattctgatgctttggcatcttggggccttactgaccctgaagggaccacccctcctggtgttagccacttgttagagatggaaaacaattcagtttgagtgtcttttcttatgcaaaccaagcaatacaaagcctataccccagctgccttcattatcagaatctcatggtctgtgtcactatcttcttgcctaatcactgcagggctaggtaccagataactagggacagactttttaccccagagtccacaaaattattcaaactagccgatcctaagcttgcttaccttgccttacccgtgtcttcctgcagaaaccacaataaatgctcttgctcacattttctctcacatcctctgtctcctgactggccttggtgcttccccacatggccctatgtggtgtggtgtgcctcctgcttctagggacctttgagtagtatactaaacccctttcttctgacagtcatttccatgtctgtatacccgattaaatacctgattaaaacaagtcctcagtttggggtggtgactcatatctataatcctagcactttggtaggccaagacgggaggatcacttgcacccaggagtttgagaccagcctaagcaaaatagccccatctctataaaaaagaaaaaaaatagccaggcatggtggcacatgcctgttgtcccagctactcaggaagctggcaggaagagagtttgagcacaggagttggaggctgcagtgagccatgatcttgccactgtgctccagcctggatgacagagttagaccctaaatcaaatatttggtaccattaaacatgactagaaggatgactactttgctcacgatcgtataggtagtgatggagcaacttctgaaatccaaatctccaaaattaagatgcatgctctttcttttaccctgtaaaatttgcttattttacaaatggtgtggagatacaggtctcaagaaaacactataaacatttaaatcctgtctgatcttttcataaagaatgagaattgctaacattttgtgacaagctctattgaggaatagaaagaaatgtaataaattataatgatgtcagaatcataacattggaagcccttaggggaaatgtaaacaacaataaatgattataggcttctccccataccactttctactatattaagtggtcctattgcatgcagagagtcatccttacttgtcagcagagtgccacctgaaattattcgcgagtgaggtcataattgtacgtttatggtttaagaatgagtaacatgcttgttattttctctgcctcctctgccttcattattcatctgtatttcaatagtgaatctggttgtcactttaggcctgacttcagtctgcggctaaggaggcagggacttaagtcctctggctggcccacagcccacagtgcctgaaggcgtaggaagcccaggctctgaagctatccatgggacatgtcccaaactaattgaggtcagttcccatatagacctggggggaaacctgttgggggcctttagcagtgtggcttgaaaatacttttccttgggctcaaacctactgtttctggtgggtggtttaataatggacccagcttgggaggccccagacagcttatcactggttaggggtcatagtgtagaggttaagaccactgaccgtggagccagactgagtggattccaatcctagctcctcttccttttggctttgggacctcgggcaagttatttaacatctctgagcctcagtttcctcagctataaaaatagaaattatggtacctaccccatggggttgatgcatggattaagtgagttagtatacaagaggtaatacaatacagtgattaggaagacaagggacagcatgggagcaacattgcttaagttcataaactggctcaaccactaactagttgttattagtctgtttcacactgctataaagatactacttgagactgggtaatttacaaaggaaagaagtttaattgactcagagttccccatggctggggaggcctcgagaaacttacagtcttggcagaaggctatggggaagcaaggcatgtcttacatggcagcaggagagacagcgagtgagctcaggggaaatggcagacacttatcaaacaaccagatctcctgagaactccctcaatatcatgagaacggcatgggggaaactgcccccatgatccgatcatctcccaccaggtctcttcctctgggaattacaatttgagatgagatttgggtggggacacagagccaaaccatatcactagttgtgggacctttgtcaagtgccttcacctctttgtgctccacttgcctcatctgtaaaatggggatgatgatgataatagggatgttgctaggattaaataagttaacctatgttaagcaattaaaagagtgcctgctttatggaaggactatttaaagtctgctgtcattactattaatttatatcattaacaaaggtaacatggaccacaagagttacagaccctgtgtatttcagagttcagagaaacaagggagctcagagagctgggaactcaagagaggcatcacagagcaggcaggccctaggaaccttgcatagcatgatggaaagcccttagccatgagcctacaagaactaagtttgaataccggctcagccacttgttagctgagtgaccttggacaacttatgtcacttcgctgtgcctctttctctgactacaaaatggagaggatgatagcacgtccttgggaggattatgtaaagtaatacagacaaagggcctagaatagtgcctggcacatggttagtactcagtaaatgaagatgttattcacgaattactactaagcctcatagttgtaatgaatacaaggagtaactctcattattattggcggactgcaagctcccagtgcgaaaggtaaataaggatttgggtaaataaggacttgggaggagaggtttaattcattaattaattaaagacagagtcttgctctgttgtccagacgggagtgcagtggcacaatcatagctcactacaaccttgaacctctgagctcctcccacctctgcctccagagtagctgggactacaggtgcatgccagcatgctcagctaattttttatttttattttttgtagagatggggttttgtgttggtggtctctatgttttgtaaagatggggtctctgtgttgcccagggtagtcttgaacttctggcttcaagggatcctcctgacttggcctcccacagcaccgggattacaggcatgagccagcacacctagctatttttttatttttatttttgtagaggtggggtctccatatgttgcccaggctggttttgaacttgtagccttaagtgattcttctcgcctagcctcccaaagctgagagggagaggtttagatactggcaaaggcaggaaggtgaaaagctctcagggagttctggtggtgatgaacagaccagtttgtatcctttaacaggtttctgaggagggagatttggtttaaggtagggagtgaagggcattggattccaaggtagggaatttattttttaatttctctagtgatagcctataaaccattgagtagaaggcataaagggttacagtaaggttctgttgttttgcttaaatgtcaaaagctataaaactacgatggatctggggcctccttttctgtctgtttcctcttttgtggagtctcctcatttcctaattcagagagttcctaacttatgatggtttgacttacaatttttcaactttataatggtgtgaaagcaatacgcatttagtaagctccttaacttatgatgaggttacgtctgcataaacccatagtaagttgaaaatattataacttgaaaaagcacttttgacttacaatattttcgacttatgttgactttattgggctgtaaccccattgtaagtagaggagaatctgtatgtacatttctataaaggggcaatctgctacttgcttttggccatggagaatgcctgctaccttttctatgaagtgttctctcatcatttaaactgccatatgtactcctcttctcctgtgttcccctataggactgtgcgaactgcagagattcttatcacagcatacctggtggaaaattcattcattacccactccatcccctaccagccttggagtccctagtggacctggactgtgccttgttcttgagatctccttatcccctacgcctagccccagcttagtgccttgtaccaaggagataatatgaagaggatagaatatgtgaggaagcatgaaagaggatccttcattgagcaaacaagtgggtagtgattgaggaaggacaggggactcactgtatgagtcctgagcaacagggaggtattaccccaggcatctgtgagatgtaatgtgtatgtggggagtggggtggtgaggtggatgatctcctctcttgtttagatagctgtgcttctcatttaaaactaatgatagtaacaggaattaacaggagagtgtgatatgtatttctggatagtagtgggtttcttggaaaatggaaggaacacctgcatcagttcctctgagaatacctggggactggagcagtgattttcacacttttaatgtagcaggaccctttaagtgaaattttaagctaagcccaatagatgcctacatgcatggatggatagatagataaaaagataggtccaatatatagatgacagatagataagaatgaccttggataagacacacatccctggaccttgatctcctctgtaccataaagtatagagcttaattgagatttctgaactgctgatattttggatttgttaatttttttgctgtgtaggaccgtcatgtgcattgtaagatggttagcagtaatcctggcctctaccaactctacaccagcagcacctccctttccagttgtgacaaataaaaatgcctccagatattgcccatatgttttctgttgggaggtacaaaattacccccagttgagaaccactgggttaagtggtctctggtgccttccttttttttacttgagtgattactcctaaaaggcctttagcacagtgtctggcacatcttaagttctcagttaatggtagttgataatactgttatatgcttcccttcagtagtattgatagcttggctattcctcatgtcatactgtgactgatatttttaatgttcaacttggtagcacagcgcatcttagaaagccaagtgggctgctttactttcttgttagcagtccccagggaagtatagtcatcagtaatcaggtggttgctatggcggagatgggaacatggtcaccctgtaccattctccctcctgctgtatgttcttcaatttggcctttccttccctcactaatattccccctggtgttcttttctctttttctggtgaacatgacacagtgctaaatggatttttttccccccgctctcctttttcttttcttcaccaacttgaaggagcaggattcaaccttcagcacaacttccagagtgtttccatggaaagacaattaaaatgagcttttaggtttgcaatgagaagggatatttgcttttttcatattaatattcatattttctcaagattcaaaaaatgccaaaacaatattcatgggaagaattcaactactagaaaagacaaagctataatagaattattatagtctgtaatatgttaattacccaaaacaagttggtctttgggataaattagaaatatttgctcctgcatttctttttgacttagaaggaaaaataccaatggaaataaagtatgccagaaatgagcaaaataaattaagaatactaaacctgatgtcataaaatgaacatcccactatgttggaatttatacatttttaatgaaaattagcaatgatcactcattgtatatttcttggtaagatttaaaagtagcccacaataagggtcgggttgcttttagttttctattgaaatcaagacataggttttgtatgacatgcttgaactgaacatttgggaacacttccctttagtctcctgcatagagtctggcgcctagtaggtgctcaataaaatttgttgaactgtattcacagaagtgatcctggagatctatgtatttactcattgagctaaagagcccttcatgattccaaaaacgggagtggcctggtgtacccattatatatcaggtattatccaagacatttgaatcactcatgtgaaaatatttattaagcttctattatgtgccaggcacatgctacaagatggtgaaccaaacatacagtctctgtagtcatggagttcacgtttctagttgagaagacaaacaacggaacaatagaacactgaaagaaaatgaacaattattgaaagctgttgagaaatgtatgaagaaaataaatatttgacctgagaatttgtatcagaaagtcattcaactctagataacagaaatctttcgaagtagtagcttaaatatgtttccttcaagtgaaagatgtctggaggtgagcattccagggtagatatggtagttccaggatatcaggacacaggctccttctggctttctgttttccagagttggaatggggctctcatccttaaagtcactttttggtccaagatgcctgctggccttccagtcaggaaggaggaggatggcgatgtggacgcaaaatggcttgcttaccatataattcagtccttttgaagagcaatccttggaagcctcacctagtgattgtcttttacatatcagttagaaaagaggataggacatgctatctgttagccagatatgtagtcacactgaataaaatgggagctttgttagtaagaaagaaggcagatatggatgttggataatcaactagcagatttgaaacagactggaaggatataaagagtaggactgcatggtaacatttactgagatggggaaggctgggaggaatgggtttagaggaacggcaagagttccatttaggacacattaattttaagatggctgtgagacttccagttgagttttcaggttgacataccactaccttacttctcctgtcaaccccaggttttcataaaagaaggacttatgattgaaagggagagctcagagacttaacatgaaaatgtatctgtataatacatacacttttatcttaaattgtattttaggtatttctaaaaatctcaaagttttctatagtttcttctttcttccagaactgtctaataagcatttagtataagtaaagcactgttataggttttggggatatatatttagaacaaaataaagatctctttcctgatgtagagcattctagtgaggcagacagacaagaaataattaacataaaaataaatagattagttaagtcatcatttatataatattgagaaaacatcatgagcactaactatcattatggatttttattgtgctcagtttcttcactgatgtccttattgaactctcatatcagtcctatgaggcagacttttttttcctcgttgaacagatgaggaaacaggctcagagaagttggataagtccaatgccttgcccatgtgttatctcctccaggaaagcttcctgtttaagtgtttcttccactcacaagccagtgagatcttcatgggcagctactgattgtactgagtttgatagtcctatcccctgacctggaacctggcatatagtcaatgctcagtaaatgtccaattgttgaacacaactggcctacctagtttacacacctagcgtttatttgtcagagccaggatttgagtctatccgtgtgtttgaacagttgcctcctgattcatgtattttgtacatctagattttaggtaattgtattttcagaagcagaaccagttctcttttttgcataatggagcttgcttactttaaggcaaaataactcagatcctccaaggcaaatcattctaaacaaagggcattttttcatgagcttgaattttcccattccctttagcaagccagcttccggttaaccaggccctgaggccttagaaggagacctgagctctctgttttactcagagtagctcatgatgaagtcacttgatgacttgccatcgaaggctgtaaagacattaattattgaaattaagtgggtgttaagagaatccgaagtcacttttgctttgcctagagacaccggagaatctgagaatattggagccagaatctgagaatattggagccagaagggcgcttagtcatccttgtttcagtcttcctcattttccggaagaggaagtagagattcagagtggcaacaggcacttggccaagtcaagcatttagtggcctcaccatctgcctcccactccagtgctctttctattctatcatgctaccacttattcaacaattaaaaggtattctcatcatgtataaggaattgtgaacggacttttactaaagggtaaagaggtgatttgttaaaatgtaaccacgtattttaagtgataagccaagtataatccacccccaacctggtttgaaataacaacatttgtgattgaatattgaatgattattttttagtagtgtttttctatctttgtgttacctgctaccattgcagaatacacaaagagggagtatacttttctttttaattcctgaagaaacattaataattctagcaaggtgggaatgtgctgtagccaagaggtcataggctttggtgtcaggtggcctgtttttaagtcatggcttcacagtctactagccttgtgagcctttggtaagaaccttcttggagctgttggagaacctggcaggtgtaggtacatacacttgaagaatatgagaaggggtggtggagagacagatgatgggttgatctggagctcttgaatgcgactgaatcccacgaggtctctgtggctgaatctagacagggattttgataatttggagcactgttgatagacacagcctccagttggcattggttgtgaacatttacccttttgttttcatgacttagtgtcttggcactactcaaaaagccactttaattttattttctggaatagaacctggtctaaatgaaaacacacacacacacacacacacacacacacacacacacacacacacactacataatcaagtaattaattcactaaataaatattgtgcttactatgtatgaggcactgttccaggtcctggagatgcattctaatggaatgatgtgaaacacaggtaaagaaaaggaagaggaaaataagcagaatgtatgaagaggaggatagcaatgaagatgcttgccatttatctggtgctccctatgggccagacattagccggtactgtgtatacattgtgtcactggattcttacaactggcctataaggcaggtattattatcatctccctcttacagtgcagaaactgagagctggtaaagcgaagcagcttgccaagggttatgtagctagtaagttgtagagcttggatttgagcccagttgtgactggatccagggcctaaggtcttggcaacattttatggggattaaaaaggactgctaatgggtgcaagcttttgtttctgggagacaataatatcttaaggttagactgtggtgatggtttcccagctgtgattttttatttaatatgaaaaatcattgaattgcatattttaaatgagtcaattgtatagtatatgaatggtatctcaatgttgttattacaaaaaaagcagggtaacttgatggttaatgattatggagagcctactatatgttgggcactgtgctaagagttttacaaatactattttatttcatctcacagcagccctgtgaagtaagtgtatcataacccccattttacggatgaggaaataaggactcagaaagattgagagacttgcccaggatcatgtacatagtaagtgtgggagccaggactcaatcccatgtttgtttgactttaaagattatgctttttctgtctttgtaaaataggaaagtgattgattttctttttggtatcaaataaatatggccctggtttttattggtcttagaatttatgaccatttctactactaaatggtcatggaataaaactttgcaatgtttctgccacatcactacccacatgttttatttttccacatagaaacagcccaggctgggggaggaggttgttcatccagcaatttaatgattaagttttaatctattaggcaaaaactaaggaataaaaaatgcttcatgtataaggaatttagaatagggaaaatatattaggtattcgttgtgctcattttccggcagtacagaagcattttattttaaatgtactgttcattttgggtgttatgttttgtttctcttatgtaaactttccccgtttatgagaagcagcagcgtgtgttttttctagaaatagatagcattcataaactgaaacagtttcattggggacattttctgtggcactgcaacagaactgtcttggcagaaatactggaatcctataaaatagagttaatattgatatgctttaatcaaaaatttctgtttagaagcaataaagttattcagtattaggcagcctcggttctatctttatccttactgctaaaacatcttcatctttagagtatgttgctataactatatatctccagattttctttccccagttctaaaagagaactcttaggagttgtgatgctactgaggatctcccagctttgcctcatcggggtggtatgcaattatatcccgtcctcttccatgtctgataacatgatcacgaagttcattttggtgcatcagttcctattgaacacctttgccagacgtgctgtgattggccagaggccgcttctcctcatggtcgcctgaaagtatgctgcatatacctgatctggctgttcccaccagctgggatgcatttactctccctccactctatctctgccttttgagatcttagccatctgtagcagtcaacattcatctgtaggtaccataagctaaaataggtattttagtgctgttaattaggtacttacaaaatctatggggtgggtggaagtgggggctttaggctgtgtctccaggaatgaaacctagaccaccaccacaaaactggccctccaaagggagctgcagctgcttttacgtgcagagaggtggggagttgggaagccaccactggaacgctagatttcaggacgcatagctgatgccgcagtccaaggggaagaagccaccaccactgctactgcaattgtctctcaacacctcaaaaataagtcactggatgctcaaatattgctgtgaatactccatgtctccacaactttgcttaccaggagtaaaaagctaaacagctggagacgtgggaagataatctttgccttactcttgtttataaaatatataggcacatgtattagtccattttcatgctgctgataaagacatacccgggtctgggaagaaaaataggtttaatgaactcacagttccacgtggctgggaaggcctcacaatcatggcagaaggcaaaaggcacttcttacatggcagcagcaagagagaatgagggagaagcaaagtggaaaccgcttataaaaccgtcagatctcgtgagacttattcactaccacaagagcagtatgaggggaaaccgcccccgtgattcaattatcttccaccgggtccctcggtgggaattattggagtacacgtgggaattattggagtacaattcaagatgacatttgggtggggacacagccaaaccatatcagcatataaaaatgaaagatatatatatctttttatgttttatatatatacattttatatacatttatatatacattatatgtacataagatgcatgtacacatctatttatagtatacgaatataaaatacataaatatttgaaatataaatatatttacataaaaacaaaaatatatgtagcttattatgttccaggcagtggtctacaaaattgttcccattttttagatgaggaaactgaggcacagagaaattaagtaacctgcacagattgtaagcatcttcttctatgagacacattttattccatccagcagtgttttgcccagatgctcagtaagtatttggtgaattaattgaaaataggtgtgtgccattggtaaatgatcttttcctcttcgaggctgggtcttcctttgagaaatgaagggcttggactcaatgatctctaaattctttccagtttatatccctaaggtctccttaggttgatttgtatagggcaccctaaagaagagctactgttatggttctctaattatgtgccaggctctgttctaagcatttaacatgcattgtttcacttgagcctctcaacagccaggtgaagaagttttggtcattattcactactgtttcagatgtgaagaaatgggtgctcagaaaaaagtgatggctggtctgtggtcgctccgctggtgagtggctgagctcaaatgccaaatcgtgtctgcctgactttaagcccatactcttaatagccgagaaagccctagttttctcaaagagaatgacatctagggcatgcatttgtcttcccttccttttctcctgccatgtcttctttttcattttcgtcatcatccaaaaacatactgcagatactttggcatacattttatgattctcatcccctttgctggtaataaagtgcttactccacatgtgacatgtgttgacatctgagagcattttttgttgctgagttggttgttaataaacactaatgagttggtcgcatctcccagagcaaggacagataccacaggaacaggttttaatacctgtcaagagaatacaaagtagaaaactttattgtggtgccctcaccatattgtcctggttcttccttgcattcattatttaatactttttattttataaaacttgcttatttttgtgataaaatattctcactctttaaacaacataactatatgtcattgctgttttaaaaatccatgtgtactttgcagccataaaaaggaacgagagcatgtcctttgcaggtacatggatggagctggaagccattatcctcagcaaagtagcacaggaacagaaaatcaaacatcgcatgtgctcacttataagtgggagcggaacaatgagaacacatggacacagggaggggaacaacacacactggggcctgttggggggtggggttgggggagggagagcatttggaaaaatagctagtgcatgctgggcttaatataataccttggtgatgggttgatctgtgcagcaaaccaccatggcacacatttacgtatgtaacaaacctacacatcctgctcatgtaccccagaacttaaaataaaagttaaaattaaaaaaaatatatatataaaaatccatgcatacaacacagaatgagaacttcgaatacacactagagggtattaaccatggttgtctataggtagtacagctacgacatattttagttgattttattttctcatgtatattctgagatttttctgtcatgggcttgtatgacttttgtaagaatgataaagtaaaatgttgaccatggtcttaattggtatcttcttatagctgagtctcttacgttttttcctctgtgcctctgcctcccagtcaatcagacacagcactcttctatgtcagctgcccgggcagagctggggtttcgagacattagggttgcatcagatgcctgactaaggcatttataagactgcccatagcttagaacttccagtgatctggaccctctaaatttgggactgttgacctttggaatatattttcttacataggtttctgtgtcttatttgatgtggaaacaacaagaaatccgtaccttactgagatctataactcacgagggacttcaaaactgcattatgtcaaaggcaaacagtgttccatcattgaaaatacaattatgaaaaatgataactaacttctgagtggtactttttagagtttacatgggctcttcacttccatcatctcatttggtcttcacagtcttcctggtgggtaggataggattatttcattttaaaggtgagaaaactgaagcctgatatggacagctagggagtggcagagccaagacttgaatccacattttttttttctttttttacttttgctgcttcactacagtattttcatgaattaattgaaataatcctagatatccaataaaaccatcactaccgccactgctgcctctcctctcctcttccttctcatcattgtgatcatcaccatcatcttttccttctgttcaatatccttctgtcagttaatattttatattttgagggtctgaatatccgatcatgaactagtctcataatccaagaggggtcaaagtcatccctcttgcatcttcttctctccctttcctccctctctcctttccctcctttcctccatatttctctcattcttcagttactttcataaatatttattttgaactgttcttcacaatattcacttagccctggcagatggcctgagaggtcagctttcataacctgatccttctcttttcagcaatgaaggatgaatatttcaggatcagcatattttatcaatgacctaaggctttctgattactttccatctgtggggtctacttcattttgttgcctgggctatttaaaaggtttcttgcatgtagtgtattcatgataaataaccagttgcttttgtttcagggaaagccatcttaaaggagcaagtcacaatatgcttctactctcacaaccataattttaggcattaacttactctataagcattattaccaggggccaggtgcctcttataatagtggctagcatgttgccactcttcatcacacgttatcatacttgtcaatttacttgttcacacccctcctccctactttattgtgtactccttaaggacaggactgtgtcttaatcacttttatatccccagggtctcatacatattaaaagtatgaaacaatgaaaaaaaaatagcatagctttggcacaaaggataattacaagcttctgaagccttccggagatatccggaggctcgctttcctcatctgttcagtgggggtaatagtggccttacagagatgctgatcagacactcttgctttcttccccctagtttcttagaatcttcttggtctcctctctggccctcatggcactggttgcataggcaaatctagactcttacacacttggctatgaagagtttaaaacccctttgtaaagaatgtcaaaactacatttgaactttatgtagtattttcattggtacatttggaatcctaactagatcttagaagtcactgtctttgctcacatattctctgagcttaagcacaagaaaatgattcattaaaatatttaaatcagctactagaaacaataatgaggataaacatctcggaggcccaaatccattattctgtgctcccattccatctgtgaaggctggtactctatccagcactaaaaatttataaatgcagggtcagtaagaccatagtcagcaggaaattgcaaaactctgggctcctgcaagcaaagcccaacttttcttcagaaattcatgacattggaatggaacaaaactatgcagaaggtatagtgacaagagtaacactgaactttaaacgccaactctgtggctgcccagctggatggccttgggtaagtcacccaacttttctgtggctctgttgagtcatttgacaaatgagcataatcaatcttgactgcctctgtggagttgccaggaggcttaagggcgcctctgtgtgtggaatgtgctctgtcagctggaagatgcctgtcatgtacatgggagggactcattttaggatggctactcagagatttttgcattagaagcacaggtttgctttagcctcagtttgcaaatgtacaggattagcattcccatgcagtgtcactctatctctggaatgctgctattgccaacagaagtcaaccaaatgcctctccacaatctgtatcaagcataccatatgtttttacacaatggaagtgatcttaaagaattgaataatattttcttgagggaagtttactttttgcaggaaacctgtgatgaattatttggtaagagaaaaaagccctattgtaatctcttctaatctatcaattctaaaagtttaggttcttttatgtaattttttctagacatgccagccaggaatgcattctaaagtattgtagtgttaacataatgtattctaaaaagatgatgatgtcatttagatatctactaaataaatagtgaatatttagtaatagtgctgataattacttgtttattgtttgcttactatgtgtcccaacctgtgctagttgctttatatgccccatcttattggatcctcactatttaacagatgaagaaactatgtctttaagaggttaagtcatgtatctgatgtttgagagcaggccaaataccagtgtgatggtttacatccaggcctgcctgacttcaggataggagttcgtgagcatgaaggtagattctggtagtttatattctatagaatttggaacctgcatcatgaggtcagacgagaacataaagaatcttaggttgcaaccagaagaggactctgtggtctagaaagaaaaaaaaattccctgagttattaaaaaagttagtggaaaggcctaggttcccactcagcacctgttcctccataccacattgtgtctgctacacacagcacctcatggtctatagatgtcaattgtagcatggccattgagggtatggaatgaattgtaaacaggccttatctttcaaagcatccagcagccctgagttccacgactctttatacctgaggtgagagttggccagatagggaattgatcctatgtcctactgaaaaccagtgttggtattagcaatggtcttggtaaaatacaatgaagaagaataacgattttaaaatgaaaaaaaaaacttgaaagaaatggaaaattataaaggacacagttgcaggctcaatataacttaaattaggggttgacagactttctctgtaaaaggagtggagtttgactgaatgtttgtctcccctacaaattcatatgttaaaatctaaccctcaatgtgaaattattaggaagtgaggcatttgggaggtgattgagtcatgtggattgagccctcatgaatgggattaagtgcccttataggaatagagcagagagctagctccctgcctttccttcatgtgaggttacaaggggtagttgtttgttttcaacctaaaagagggccctcaccagaatctgatcacgttggtaccctgatcttcgtcttcaagcctccagaactgtgcgaaatacatttatggtgtttataagccacttagtctatggtactatgttatagcagcctgaacagactaagacagcctgtttatgactgctttgggatatgtattctctttttatctggcaggcaggaaatggccaagcctgagtaaaggcagagtagtccagtgctgcccaatattcctggttacctttgggtagccaaaggccacatttctctgagggtatttcttactgatagactggctattaagtttcactcttctgcttggaaacccagcttaaaagctattttgggcagtgaagttccatcagctaatatgtattccaatgacaatgacaagaagtcccagcctaggtttcatcaaataccaggccctacagactgctcctctgaatttaaagcttcaccctctctattattgtccatgtttgttcaaaagtatttatgaataatgataatgatgatcattatggctaacatttattgaagatctcctatgtgtcaggcattttacccaacattaatacatttttatcatccaattcttacaacaactctatgaggcagatactaccattgccgccattttgcagatgagaaacttgaggctcaaagaggctcagtgacttgttccaggtcactgttacttagtggccgaggcagatctgaagctcatgctgggtgataataaagtctgctgtttaccactctgccacactatcatccctgtttaaggttctagaaggcacaaggagcctgcctttctaaagcagacattatctccatcttcctttcagtctagttctgagaatgtgttctcacttctccctctcccatgttattcaattctcagtctcaggcctacagtaattcacacttggataactgcagtagctcttaactgtttcttttaaaaacaactatattgagatataattcacatatagtaccatacaattcacccatttaaggcatacaattcaatggttttagtatattcacagaattttgccaccattaccacagtcagttttagaacattaacatgtcaaaaaagaagcccaaacccttcagctatcatgccactatccctgttcactgtgacttccctccccaccagccctaagcaactgctaatctgctttctgtttgaatgaatttgcttattctggactttcataggtagacttataatatgtgtccttttgtgattggcttctttcacttagccttagtactgtttataattctcacatgtagcacgtatcagtacctcattccgtttgatgactgaataatattccattgtatggacatgctacattttgtttatccagccattagttgatggacatttgggttgtttccatcttttggacattatgaactaaccagcctcttaactagattctgcacagcactctcagattaattttctgaaagtacagctctcattatgtcttccctccaattagaagtcatcactggtttcttattgcctctaggacactgtttaaacttttgagtttggattttattgtgggaaagtgcaaggcatggagtgagcacttatactggggaaggaatggcaagggaactgtgctttactgagcccttgtccttaccctgccttatctcccaagatcctcaacacaaactctctcttatatttacatggatctaggcatcattcttcaaatatgtttctcattgtcttatctagactctgtttctcctccttgaaatgcctttctgttttatggctaagtcaggcccttctaaaccctgcttgtccatggagcctttccacgttgctgcggccttcagctagctctcccttccctttcatcccctaagcctctcaccgtctgtacggcccatttggccgtcagcatgtggggctgcacaatgagatggggctgcttttctatctcattttctttggtggattgggaacctcttgaggccagggatcaagtatgacttattatcatgatcattagtataagagtaatccctatcatttgtcctaggcattgttatgtgctgggtcttttactacatccttacatttgttaacaagaaaagacgtcagggtaggagctgttattccagtttcatcaaagaagaaacagactcagagatcctaaataacttatatttggtgtctcagcaagtaagtaatagagcttaggtctatctgatgccaaagtgcaatttccacaatgctgtgctgacaatgactttttttttgctcatcctgtcccttctcttcctcttcctcctttgtcatcacccagcatcattctcattttgcagatgaggaaattaaggttcgtacaagtttggtattttttccagagccacgttcatagtaagtaataaagcagggatgttaaaattaaaacttctgtctccaagcacaaatttattttccttaccatgatatttgtgtatgttggggcctcagcaggctgttttataataattatcatgctataaaacaatagggaggagaagattcacatacacaaacaactagaagaactataagatactgtattgtggtggggattataaatgtcatagaaattttgaaaaaagtcatgacaacttcttagatgaaggaaggctggtgctagaccttaaaggatgggtgaggttagccaagcacaaaggagagaggcaaagagaaggagagagacaaagacattcaagttttcttgtggagccattctcccagcccagtcctccacatcgactcaaattctctaagaaagagtgtagacgctggtcttaaccaccattgggacagctgttagaaggaaacaaatagttgcataatattgaaatggttgtgtggctttgtaatatgtttatatttatcaaagggaaaggcaaggacattatacaattcgatgaagtcctgatttaaaaatctgtattttcacttactacagtgtgaaaggggatagattgaggcctttatttattcgtttaattgcagacatatttaatatttattataaagattttatacttcctcaaattcaaatttttattttccaagtatgatagttcttttagtttttgtgaaaggcaaaataatacccaatccgtcgaatattctttttcaaaattgcaaatctgtttcacacgtaaaaatataataccaagtctgattataaaccacaaacaacaaaatgtgtttaaaaacaaatgctgtagttggaatagcagtaagataaatcacacaggtttttaggtatttgcagcagactattcagtagctgttggcttcaaggatgattaaaaagtagatttattgatttctaacgaaaccataatattaataatctgtggagggatagtagactattggctttttgccagaatggctttgaggagagtatggcctttggtactaatagcagcttctcagcagcagtcagaattgggtctctgagtccagtgcattaatggttcagcagcaaagttttttcagtactcaaatatgacttatgcccatcagtccctgatgaacttgttcaatttaaatgggcataagtcatatttgagtactggacacattcagagcatctcacccttacaaatgattgctcttcttgcttgattttttgtgtctttttgagatgctaagccatagcaactgcctttattcattcatggtatcacaggagaagagtagataatggatgatattaatagtatatccatttcttatacttgggccatggaaagtggaccacatagaaaaccacctacgggaccacgtaaggttagtgatcccgctttccctgttagaatacaagagattgcatccgtgaaccgaggccctgggaatgctgtgatgtcttcttgaatgtgatgcttggcttctgagcttttacttttcaagaaagtggtaattattacaaagcttttcacctttcttggctagtggaggaatcctatcatttgcaggtttccacatttttcaaaggaaaaacgctttttatcgtctttgttgtattgtagctccactgaagagttctcatcatggtcctttaaacgtaagtttttttttcagttggtagtctgcctttccctgagttgatcatcttttggggtttgggcttcagatcaaattcctagtgttgtttatagtcagtgctgcacagagcctctcattcttgttcatatctgcctattatcgtctctactcttctccttccctctctctttccctttctccatccttccctcctctctctctcccaccatctctccattcctctcacttttaagtgctaacatgttcttcctgaggtacatatttgatagctttacctcgcctccttaatctgctcgtgtgtccttggtttgtggcctgttgtacatggtaaagcaatgttccaagctggggccatctgctttgcaaattccaggtcatacctaatctttctgatgccatactattacaatgagttccagccccagagaagttattttgcctccctggcggttactgaacatgtgtttatgtgtgtgtgtgtgtgtgtgtgtgtgtgtgtgtgtgtgtgtgtgtgtttgctttccccagtaatgggaaggatgacccacatggccattgcattatttttggggttgtgggtgggccctgatcactttcaattctgcctctcagttgctgccaccagtatttcaggctatggttctggacttaactaatctaaaaataaatcgccatttttatgaccagaagtctactaatgtagcagttttcacaccttttaaggtttgttttgctttgttttcttctaacagtaattaaaaaaattctctctgaaatcttatgtaaagtttagtgtttcaaacaggtcaaattgtagttgctgtgcttgagatgttgatggagaattcagagttttccttcctcctccccacctcagctacagttctttggagcagactttgatatacccttggattggttctcttttctttcaattcataggtgagaaccagagacaaggacaggggagaggacagtaacataaaggctcaagggcagaaagttgaagtaccttgtgaccagggcctggtcattggtcctgcatgaagcaaaaggacaaccattgatcctacctacgtttgtcagtactctaacaactgtccagccagtattgaggcttagcaagtagagtttttgttttttctttccttttctttctttttttttttttttttttttgagatagaaacctcttcaccactattctctgcagccacaagcctcagacagaaccagttgtggatagcaactcgacaggttgccatgcttttaatagatagtttaagtaagttctgttcttataattaggttgttatttctaacttttattctatgtgaggctaggttagtcagacccagtaaatgcatatttgtttgattcatttggctacgttattttaggccatggctaagatgcgtgtgtccataggcagggagtggccagaggaagcaaaccgaggtgagatgagaccatcatttgtagccatgggggccataagagatcagctcccattttctcctagcaggggtacagagggagcaggctgtcaggaatgacgctctgtggcaaaggttgctaactcaggggagtcctcattgctagataggtgaagagtggctctgtcttgccttatttttgtttatttttgctgttcattcttttctttttaaattttagattcagtgggtacatgtgcagatttgttacatgggtatattgcatgatgttgagatttggggttctattgaacccatcacccaaatagtgaacatagtacttaataggtaatttttcaatctttgtccctctcccttcctcccctacttttggagtctccagtgcctattgttcccatctctgtgtttctgcgtacccagcgtttagcttccacttacaagtgacaacatgcagtattggttttctgtttggacattaatttgcttaggatgatggcctccagctgcatccatgttgctacaacaggcatgatttcatttctttttacggttgtgtagtattccatggtgtatatgtaccaatatatacatgatatatatgtaccaatccaccattgaagggcatctagtttgattccacgtctttactattatgaatagtgctgtgagaaatatacaagtgcatgtgtctttttggtagaattatttatttttccttgggtatatacccagtagggggattactgggtcaaatggtagttcgatttttagttctttcagaaatctcaccagtcagaatgaccattattaaaaagtcaaaaaacaaaacaaaacagatgtgctaccctattcagatccctctcgctctctccatccccttctgagctcagaggtgggggtcatgggcttcttctaagagccctaacctggcccatgctcgctgtcactgatctgtttcacacccttttctccctcgcctgaaatagtagagcataacactcatctttctgcctccaaactttttgtttgtgtgtgtgtgtgtttctaatgtttatggtgaaagatgcattcaaaaagtgcatatgacacatccatgaagattaaaaataattataatgaaaaaataaaatgaactcccatgtatttaccatatagcttgagaaatagagtgttacctatacttaaaagcctggctctggcaaccttgttaaattctcttaataaaattctaataatttgtaacattcttttattctatatagtcaatgatatcatctacaaataatgacacttttattgcttgctttctgatccctatgccatttactccattgttttgccttactgcactggttaagacctgtagtccaatgttgaatcagagtagtagacactcttcttttcttctagacttttaaatggaatactacaatattttattctgtgaatggatgttgacttttatcaaatgcatcttctgcgtcttttgagatgatcatatagtgtaatttatttatttttctctctcctttaaccctttttttttgccaccttttcctttaaattcagggagtacatgtgtaggtttgttacctgggtatattgtaggatgctgagggtttgggccatcctgaatgcacccgatctcatcctttaatcctttaaagcaagcttgtccagcctgtgggccatgagccacatgtggcccaggatggctttgaatgtggcctaacacaaattagtaaacttccttaaaacacgagattttttttgtgattttttttttaggtcatcagcaatcattagtcttagtgtattttatgtgtgtcccaagacaattcttcttctttcaatgtggcccaggaaagccaaaagactggacacccctgcattaaagcaatatggcactttacattcatagaacttttaaagtgaaacttaaattcctggatttaatctgagttggtcatgatttattttgttttctatacattgctggatttcatttcttaatattttatttagtatttttatatttatgatcacaagttatgctagtatatatttttcctttctcatgttattgtctattttggggtgacaaggtgagaatagctccataaaatgagttgggaaatattcttgtcttgttttctctggaagagttggtataagattggaattatctgtttctttaatatttagtaaaacttgactgatgtttgcttaatgggaagtttaaaaaaatttagtgcttataagaatgttcttgagtcaattaaaaaattttttttctactaatgtcgatatcttattgaaattgttaaatttatgggtgtaaagttactcatagcattgactgatcttttttattatctgctacatctgtagttatgacccttttaattctcaatattgtttatttgtgcctctgcttcttgtattactccttttatttcaaagtccacataattgctaaatcaatgttattaaacatgttattagtcatataattatcttcctcacttacaaatcacaggaggactttcagtgccctttatgatctagctccagcctagctttccatttacaaaacacaatttttctacttgtgattttgagttccagccacacaaaactagtgtacttctcctgatatattcttaactttcataacctggtacctttgtttatacccttctcaccattttgaccaccctttcctatatctttatcctttgaaatactcattgcttctcaaggctcatcgcaaattctacctgatccatgaattcccccagtttcccccagacagaatagataactcattctcctgtgtttccagcacacattccctcagactttttcatagcaagtattgtgttgttttattttaatgagttgcttacatgactgcaaactagtaggttgtgagcctcttgaaggcaaatccttgtctttttcatgcctacattctaaacacttagcaggggactactcagaatctgttcaattcaattggaatgaattaaagtggaattgaacaggcattcatactggagtaatgtgaagatttccttaccccccagaattcccccttcaccatctggctgaagtctgaaaatccactatttgaactccactaatttttcttattgtgtttctttcttgttaaaaatgctaactggtcttggaaagcagaggaggccctccctggcattgcaccctacccctcacagttttccctgttacctaacaaatggtagctttcctagatcttttcctgagagcagatatacaggcaggacatggaaaaggaacatccctaagggagaacaaagatgcagaaagtggtgggtacatatggttgttgttcttaatttagtatctactgtattccaagtattgtgccaagtcacatgtaatcttcacaccaaatcaaagagctgggttccattatcatctccagttttaaagatgagaaaactgagactcagataggtagaacaattaggccgaagccactcagcctgcaaatggaggagttgagattcaaagtgaagtctgatagactattattctactacccaagctatctcttctctatgacctcatctcaagacctcagctatttgtcaaacacctgttatgtgagtaacctctgcccggctccacactgttccacagtcagtttttcaggtatttattttagtggtcaaaagtgacctcatctctgctgattgatctctgaagctgctggaatgaggcaagaatgtgtgatgtgtgcaattcctttggctgcttcttgtccctacagcatcttactctgctccctgagcgagggcttttgggttttgaaaggatctggaactttttttcagaaacaagtctctgctttgtcaggtagttccaaccccatctgtaggatcttcctgaaggctgagcacaccaacatccagctgttggaaacaacagcttcctcaattaaagaagaggcagacaactatctgaaaggaagctgggaacaaaggttatcctcaggagattgctcaggaggccagccagagggcatgaatgtttggtgacagcatatatttgggggcaatttgtactttgctgtttcaagacagagctctgctggctaggagagcacattttttcttcccttactccactaattggcagcgccatttagggctgtcacagcaacagtcttacagatcttgtggtccagacccgtcactgtgtagataaaaagctaaagaccagaaaggaggagtgtctcatccagagtcacatagcagagtgggagtcaagcctgcatcaagactcaggacttttgatggaacgtcccaggctgggaaactttatttggccctcagtttagactaccctttttatcagttatcttttctatggaatatgttctttattttcagttagtccttaagtgccttgaagactgaaaacatattttgtaattgatttttggctctctaccatgatttgtacatataggggtttgttggtcaggtcagccctctcctcttctgactcttattaaacatgactcctattatctctgtatggccttgcccttgccactatgcagccctcaactgtatgcaactcctctcacctggatatggctcctaagtgtgctgaacctcagcttttccacagccagtagctccattagctctagttccttgaagtccattccaaactctgtttctaattcatgtaggtttgaaaacagtggttttgcattgtgtacatacagtttgtatagttttcttcactgaactttagaactacatgatagttcttcatgcagcaccattaacagagatatatagctctgtctaccatgttcataagatgcagagtaactcacttctcaatcttagttttctgggtcctgccacatttttaagaaaggaatcctctcttgggatattcatctaaaaaaacaaaaaggcactagagacggcctgtatgacaatgtgatatctgaaaggcatatcagatttgctagtcttttcttcattcacatttctgtattaggctgaggtgctatccctggcgtcctctaccaagcaaagtgactttggtcaagtcatttcattgctcccagtctcagatccttcatctgttgatagagataaaaaccctgaccatgaaatgttgggagaatctaataaagtaatgtctgccaaagcacttggacatgatgtattcagttctctgaatagtagcattacacttgttcgctattggagggctcagttatatggggggtgttgtgacagcagagatactgttgtactcttgcacgtgttcctaagcccagcgtcctgagtgctacccaacatgtgcatcttggctccatggaaatccagcaggctggaaccactagcatccccagtagactgaggccattagtagtcctgcccaagaagagcagcttgtaaaagtaataccccagtgtagattctgggatcacatcttcctttaacatccagaataatagatgaccaaatcctgaagtaagtttagagcccacttcactatctctggaagtttttagctctctagtgggaggtttgagtttatctctttttcttgagtcagttccatctgtcgcttgcttctccactgacccttggttcttctcgcaatagcagatgtttcaaagtatgtatgaccagctctgaaagcagcttccaaggaggagctgtctgaaagttgcatgcacaggcagggtagtaaattagaatcaggatgggacaaatttgaaggcaggaaatcacatggctgcgaaagctgaggtgtgattgtgacaactatccccagtctcctagaaccataccctccacctggtgtgttgcagaaagctgaccaactgactaattttacatctcttttcatagggatgattttgctcgccattggttctagtaaatagtgctccacaggtatttgcagcatgccccagtgctcatccctgtaaggctgatgcctccttctttattattcttttccctgctgatcactccaagctcttttgcttgcttgtggtggttccatttttagtctttgtgaaagttgttaaacagactttgttgtagtaagatttgagatgtgttctgttggtacagagatggctttactgagtattattgccttaccctaagatcagtaacttatcttagtggagaaagtcaaatccatctagtttatttttagcagatatcttcactgaatggtgggaggatagtgcagattgctctgagtaggtcaaaagtaaacatgcagtgccaaggactaatttctcttgtggggcttttggggttcttggaatgtctaagaacatggtggagaattaatcagggatctcctgccctttgcctcccagctacttttgaagcatttcgattggtaaatgctagtttctgaatgcacatatcaaattgccaagtagcgccgatcctgagaggcagatgccttttgttgtttgaggattggtgcagcaagaagctccaactagaagctaagacccagaaaagcagtggtcacagacaatgggatgcagttgttgatgtgatcacagtttaagggctgttgtttgaactggctggcttctgcctgtgcatcccacttcgatacttttctctgacaagaaagaaagcaatcagtaggaatgtgttgatgagatcataaaatttaagatttgagaatgttaaaaggtgttcaattatgccagagtttgaccaaatgcaggctggaatagaaggactgaataatcagaagctatttagtgagtcacatccttttagggagcaaaagtatctaaggaataagatgggtgtgagttgggactaggtattgcttcaggtcacctgggtgccattcagcaattaagcatagccttaatggaagagaagcaaaagtgtagctggcagccacccctcctttcctcttcccagggcatttctctatttcatttaggcaggcactcgatacctcttgcctgtatattgcaacagatagcctcctagctgttcttcagcttcccatgccttccttctctggcctcttctctttccagcatttaacataaagtggtgccaggtacctctttctaaggcttagttctatcagcttcgtcctgtactcagactacgacagctaaggaacagaatctcccctccctagcttcttgtccataggctttccaataaactgagcagcctatgcccctctgttctccttcatgtgcgctcatttccagcagaactagaccccttacctcttgctgaacacaccctgaagttttctgcctctgatatatagcagtttacctaaatgtatttctccttcttgtgattttacttgtcttttgtcagtatcatctattttactaagcttcttttgacaccctaacaccaaatgaaagggatttacttcctcagaactcacattgtctgtgtgattgaacttctctcctggcttaaattcatgtgctcatgacttgtttgtctctctcagtggacagtaagctccttgagggccaggacctgtgccagatgcatgattgtcacattttgcctctgggccctacagaacccatgataaatgttgtagtggccttaccccaccagactccaaagcttgcaaatactttgagatcctgtgggagatgataaactgcattgctccaaattaatattttcctgatcctctccctcctcccaccctctgcttgcagagcttgcaaatactttgagatcctgtgggagatgataaactgcattgctccccttctcaggacttcagctttctggactacaaatcagggggtttgccaagtttgcttttcaaggccttggctagttctaggattctgacccaagtttccaggaagggtttgtgtttgtttgtgctctacttagatcccaaattgttcctctgcagcatgggcttttgttacctttgcttccttctttagacaaagagagagagcaagagatagcctctgctttttttgcatcttgacaccccagttctctcaatatttccagtgcctttctaatttataaccctggaaaccaagaatacactgtacacagtctttttttttttttttttttttttgagacagggtctccctctttcacccaggctggagtacagtgacatgaacatggctcactgaagcctcaacctcccgggctcaaacaatcctgctgcctcacttccccaagcctgctgggactgcagccgtgcactagcacacccggctaatttttgtaatttttgtagagatggggttttgccatgttgccaagactggtcttgaattcctgagctcaagtgatctgccccaccccagcctcccaaagtgttgggattacaggcgtgagccaccacactcggccttagatgcagtctcaatgcacgtttaacagcacacactggggcctatcggagggcagagggtgggaggagggagaggatcaggaaaatattaataactaattggtattaagcttactacctgagtgatgagataatctctacaacaaacccccatgacacaagtttacctatgtaacagacctgaaatgtacccgtgaatttaaaataagagtttgaaaaaaacacattgggtattgcttactacgtaacaggtattaatgcctgttatgtactaagcactccatgagtctttgctatttttgttatcattattaatagtcactttccagtaagacagacctgagttcaaatcctgactttatgatttactagtggtgtgtgactagtgatgtcaggttcttgatctatgggaatctctactggaaacttactttgcagatgcattgttagggttaagcaagttactttatgttaaaacagctgctgtggtcatggtgcttgacacattatagctcaaaaatgtagcttattattagtagtagttttatgtgcatttttatggtataggaacttgataaattcattcaaaagccaattttaagtgcctactgtatcctgggagctatgaaaagcaccttaataataatgttaaaagccaggtgcagcggcttacgcctgtagtctcagttacttgggtggctgaggtgggaggattgcttgaggagaagagttcaaggccgcagtgagttatgattgcaccattgcattccagcctgggtgacagaggtagatcccatcaataataataataatgatggtcacaaagatgatgttactattacctatcagtaacacttattgagcattttctctgccataggcaacttgaagagctctacaagtatcttttctttaaatccttaacaggcctaggagagaagtactattattatcttcattttatagatgatgagagcaaaccatagagaaattgaggaaatttcagatagttgctccaggatttcagttgagatgaagaaactgaggcatataaagctagtcaatggcagataaaaaaaaattgagtccaggtcttctgtctctaaaatccatcctttatatcagcccataaccattgaatgaagttaatcatgtggaggctgacatgggcataaacatgacatctgaagcatagttttcaccccttcataagagtccagttgggtaccacataaatgtggccacaagaaagttatgatacttaaaaatctcataaggataatagtattttttattcaagtcagttattttaaacagtgcaaaggactttagtatgtatgcagtccaggagtttccaactttgatttaccttttgaaataaattagagtctatgagccacctgatttcctgtgtgccaagatttacctggagtacttcagccacctgtcctcagctgcctcattgccttgcttcctcccactttctctccaacacacatgcgtgcacacacacatgcacacatgatttatcataatctgggtaaccacctgtcttagtccatttgggctgctataacaaaataccatacattgagtggtttagaaataacagaaatttgtttctcactgttccagaggctgaaaagtccaagatcaaggcactggaagatttaatgtctggtgagaccccactttctggctcatagatggtgccttctcactgtgtcctcacatggtggaaggattgagggagttctctgtggcctcttttataaggacactaatcctgttcataaggcctccaacctcatgacctaataacttcccaaaagccatgaacttcgaggctaggatttcaacatatgagttttgtggggatgcagacattcagactgtagcctcctcgatggagtgtgttccttgcttgtgtgtcactgtggaaaaaaaaatgtggaaaatcacagcagtcaaccttctcattttatccctgaattggagattgtgagaggggacatatcactggcagtcctttcaaagtttggtctacatctatctatgtatagtggccaaatttagtgtcaatgatcatttgttttgagtttttttttttttttttcttgcaagtaatgctgagtgaatccaactgtagctgactttgttgaatctgcctgggaaaactcttgttcccttgcatcagaagccccaccataaaattggccttggttcaaaattgattatttgcacagattgggatatgttaacaaatagaattccttctcctttctttcctgctcaagttattacttaccaagtcatcaaccgttctctgataggcaagaaacaaactgaactccttaatcttgtttgttctaaagcttaggaagtgattttgaatcactatatagggtttcactgctaagatgtgcaatgggtaaacccccagaggctgggatacagattcaaatcagatcattcgctccaaatgtatcagaactcctaacaatgtcatagctgcccagcatgttttcgaaaacctgccattttgcaggaataacatacttcacgtcagactccaaatggccgcatggatgtgttgcaaagctgaaaattaatgacatgaaacttaacaaggtgttccagaaggtccttgctgcctccctcatgtcaatgctcctctgattccaaataggagagttcactggcaactgtactgttcaactgtggagaaaaatttgaaagccacatgatcataggctttctcagaaattaatctatacaaagatcaagtaaggtataattttcttggctgttgatggaaatatgtttttgtccagcaaataaacaatctagctgggttttggaatcagggcagtgtaaggggcacagacacagaaactgctgtgttaatgatagtgcttttgagacccagataaaacctaggtcttcagctttcccaggaataaagtggtagggccgagaaggtgtggagcattactgagtcaatccaaaacccatcacctgcttctcacaactgaaataactatatcaaacaaggatgactttgctcaatataaccatcaaaacacatggcgtatgtacagtttatcgaaagattttgggttcacaaagcaaattctggaaaatggcatgaaggcagagaatctgatcaaagagtaaatatttatttaaaaaataattcttaaagaggcccagaaaaataaatgaagaaaagactagctgtagattatggtggaaagaatgctgaacagggacacttgaattctaaatctgttattttaacttacttctgtatttaagctttttgttctctcacctaagtttcttattcttttttttttttgacggagttttcactcttgttgcccaggctggaatgcaatggcgcgatctcggctcactgcaacctctgcctcccgggttcaagcgattctcctgcctcagcttcccaagtagctgggattacaggtgtgcaccgccacgcccggctaattttgtatttttactagagacggggtttctccatgttggtcaggctggtctcgaactcccgacttcaggtgatccacccgccttggcctcccaaagtgctgggattacaggcgtgagccactgcgcccagccagtttcttattctttaaaatgaactggctgagctgtttttcagttctgacgttctatgactatgataacaacgtgatgaaatctgcatattggttaataacatacatctctccccagcaaagtgaaaaggcttctgttaaaattttggtctagttgtgcaggtgtttacatgttggccacacaaaaacttaagaggcaaaaattttcacatgaataatcaagttacctgcacttagttggtgacttaatttttatttttttattaaagtgaaattcacgcaacacatattaaacatttttttccatttttaaatttctaattattatggatacataatacttgtattttattaatggggcacatgtgattttgatataagcatgtagtgtgttaatgatcaaatcagagtacttgcggtatccatcatctcaagcatttattattttattgcattgggaatatttcaactcttctagctattttgcaatatataataaaatagtgttaactgtttctaaatgtgcaattcagtggtatttaatacgttaacaatgttgtgcaaccatctgctctatctagttcccagacactttcatcacaccaaaaggaaacttcatacccatttaagtaatcactcctccttgtgctctttcttcctgaatggcataatttttaaaatttatattttgcctttatttatctgacacagtatgtttggggggcagtaggtaggtgcctgcctgtgcttactgggaagctcaaatctccctgaaaccagcacgtcagcctctgaaaccaagttttggctactttgagagacttagagactaagggctagggatgctatctgtcatgatactgaacagatacaagttcattgttttaaacaaattattaaaaacaaaaccctgaaagtttttcaactaagttcaaagaagaagtaaaagtcaactaagttcatgttatccaggcataatcaccatttcctgtaatatctttgggaatcttcctctgcattttaacatatatactatgtatttgcaaaagtaagatcatatggtacacacttattttatttacaaggtaaaaaattgttcaaattaatacaagataggtttataaaatagaaaatagaacatctgtttcccaatcttattttttgatggagagtacatttcagacatatttttgtgtcaataaatatagtttcagagcatcattttaattgctgcctagtagtctattgtatgtagatgttacagtttcctcaactaggcttttttttgacatttaggtaggtaccatttgtcagctatcataatgatgctacagcttgcacctaaatttgtgcctatatctatgattatttcctttgaacaaatttgaatatgtgacctttgctcatgatgataatgatgcaatataatgaaactaaggctaaaatgtagctgctcacattagagtcacctattttgcaaacacactttgggtggctctttttattttacatagcatacccacacccatcatttcatttaatactatcagtggctaatagctaatatttattggacacatatgtgccaggcattgtgctatgtgctttagagaaaggtaccttattcaatgttatttgttatgtactattattatttccattttagagatgaggagagtcaggaggctcagagacattatgtaaattgcccaaagcgcagtaagtggtaaagctaaaattttactttggtcttttgggttctagatccagtattattcctagtgtatgacaagtcctttttttgaattgtaaagtattctgagcctacatttgggcaagggatttagattccgcaccagttatcttggaaagatttaacagtaaggaagcaacatggtgttcgtagactgtgccccctccatttctagtctaggctggcttcctctggggatacctgcctatagttaatttctgtggaactgtaagtgtagttcttgtcatgctggatcctttcccaaagtaagactagagtggctgtggctaagacagcgaggtgtgatttatgaaagttcaaaaggggccaggagcagagattgggagaggcctcatttacattaagagttactgtgaattaggttctggggcaaagtgctcaaatgaatttatcattaaagagccaataaaaagtattaaaggacaaattggctgaatttcattggaccgttttattctgtgcagaggaacaaatgatagcttgtgctatttattttttaggaaaaagaactgtaaaataagatacacatcagcaagcccccaggaccaatgtttttctgggaataaagctggggactatgggaaggcagctaaggttcccattcatggactgaagtaattttggcactgggaatctttgcctgttttcaaggacatctgctaagtccccaaactgtgtcccggttggccttgatgcttcgcggctccactgacccagatcacagagctaaacaggcgaatgcaaagattatggacttaaagaggtcagagttgtgcaggtccttggagagcatctaaggagtgaactcctcaaattgactagtggggaaaccagggcctaggcaaggaaagggacttgtccaaggtgcccaaacaagtgactgccagagtgtcaaaagtttagtggtcacatttgcaatcttctgtatgttatattcaccaatgacatgtaggactaaatgaacgatttctcttccttctcattttctccctcctttccctcttctaccttctccactccttctcctcttccccattttctctttctcctcctcctgttttattttctttttctccattatcatattcataacaacatctctggtatgtatcacgtatgctagctaactaacaagctactgttacctccattatctcatttgatccttcatgtatcatggctgtagtgctcagaaactgaaaatcttaccctgatgcagaatgtgcaagccaacacaccagtcccccatctcggcaccccccgactgaaaaggctgactggcttcctgagcactgtgcagatcctgtatacaagccatggactctctccctgggatactttctttctttcttttttatttatttatttttttatttgagaaggagtctccgtcgccaggctggaatgcagtggcgggatctcggcttactgcaacctctgactccctggttcaagcagttctcctgcctcagcctcccgagtagctggaactacaggcgcatgccaccacgcccagctaatttttgtatttttagtagagacggggtttcaccatgttggccaggagggtctcaaatctcctgacctcctgatctgcctgcctcggcctcccaaagtgctgggattataggcgtgagccactgtgcccggccctccctgggatactttctataggtgtttgagggttaccacattctctggcataatctcagactcagtggcaaaaaaggaaggaagtcaagaagctttcctgtcattggatccaggtcttaaatcaagctttgcttgacaagcatacttcccatatttcctggctggcacttctctgttggaaaggcctcactcatcggcactctttagtcaagaccaggttctatctaaggcatcatcactcacatggaagcccagtttctgagcactggggcacgatacatgaagagtcaaatgagataatggatgtaataatagcttgttaattggatagcatacatggtacataccagagatgttatgaatatgagacgggagaaaaataaaatgaaataggaggaggagaaaaagaaagggaaagcagggaaagggaacatcaacttttaagaacctagactcctggggcattagatttctctccaaaaggtaagagggggaggagagagagagggagggagacagaaagcgagcactataagcatgcaaaacagaatttcacacatagtgagaaattcatgtttttctttccttgttcattttttcattcactcaggtgacattcattgagtgcctaataagtgcccagcactgcttttatctccatgatacagcattatcctcaaacatttatattctagtgagggagacagacagtaaacaaatagacctatattatattatcatgtaattgccataatgccataatgctatgaagaaaaatgaaacaggtgtagtaatttcctaggatggccataacaaattaccacaaattggatggcttaaaataatggaaattttttcgttcatggtactggagattagaaatctgaaatcaaggcatcattagggccatcttccctctcaaagctctcaggaatcctttcttgacttttcctagattctggtagttactggtaatcctttatgttttttcacttttgtctgcatcactctaatccctgtctctgtcttcacatgggcttctctgtgtgtgcctgtacgtcctcctctcgtcttacaaggactccagtcattggatatagagcccactttaatgcagcatgacctcatttaatttgattacctctgaaaagaccctctattttctaaataagatcacattctgatgttctacgtggacatgaagtttgggtggagggaggcattaataaactcactgcagatggggaaagagaagggataattatggttggtctttagatagaatggttaggaaaggcctttctgaagaggggacatttgaggagagaactgagagaagtggagccagccatgcggatatctgagggaacagcactctagacagaggaaaggctaaatgcagtggctgtcaatctgaagtgtgcttgttgtgctagaagagaaacagagatcagcacagctagagtgcggtgtgaaggcatggagtagagtggtagggaatgaggtcagaggaataaccagagatcagatcatacaggaccttaaagatcgggggaagcaatctgggtattatttcaaaggcagaaagaaaccactggaaacttttgagcaggagattgatgtaacctgacttcaatttgaaaatgatcactgtagttgttgtgtggacaacagtcagtcacagagcaagggtagtgtcctaggagcaaatttggagattattatagaaatctaggcaaaagatgatggtgtcttgaagtagtgtagtcatagtagaggtgatgaaaagtagtcagattagttacatcatttgaaaatagagatgaaaggatttagtgcaacacataagagagagagagagagaggaattaagaatggctccaaggtttctggtctgagcacactcagtggcgttacttactgagttggagaaaactgcaaagcgagagggtttgcaggaaaaaatcaagacttcagtttcagatgagtaaagagtgagatgcaaattagaatgcagatgcaggtggcaaataggtaattggatatacaggattggagtacaagggaaagactgggatggagaatataaatctggaagccatccatagagatatgagactggatgagatcataacgaagtgtagatggaaaagtgataaagtctgagcattctgttttgggttactctaacattaaaaggtcaggtgttaagaagaagccaacatagagatgagaaggagtggctgatgggtatagatataaaattaagagagtgagatatcctagaaaccaagaaaatatttcaggggtgaaggagtaatcaactctatgaatgctgcagagagttgtacaatataaaggtaaaaattttctcctagatatcacaacagggaggttggtgatcttggttagagtatttttagtagtgtagtggggatgaaagattgcttggcagggcgtggggggcatttcaaaagagaatgggaggaaacgaattggagcagtaagcatggatggacaactttttcaaagagttgttttctaaagtggaagggaaggataaggtggtggctggaggagggagaatgcgtagtcaaggaataggtttatattttttaaagatgggagttattgtaatgtgatgaggatgatgcagtggtatagacatgagagggagtaattacaggggcaaagtctttgaataattaagaaaggatgggagactgtattgtacagatgctgggtaaatgtggtagtgggaggatgtagaatgtcttttctaattgcttctatttcctcactgaaatcagaagcttggacatcagttgagacaaaggaagagggaaggataattaaaaaagggaaattatgaaataactatccaagagaatagatggcagacagcaccgatggcccacacttggggtatgaggccttcagtttaaatgagaacagacagcatggttgtgtgtttttctagccaaaataagctgcttgggagcaggcatgaagtcatcaaagggttggacttaactcaaatttgggttttgccaaagatacgtgacagaggaagacaggagcctgggaattgaggatgtatacaaacctcttcttggattcatcttcttcagcctcattaatgtctcctccttacctttttgtgccttctcttattttataacatgacagataatacttctacacaagtattgaatgtggagtatgttccacttgttacaaacaggtatggaagagagagtgaggaaatgacacagtcccagaagaagcacatgtatgttaccaagagagattggcatggaagaataaaaatttttgcctaaatgtcacagcaaggaggttggtgatcttggttagagtatttttagtagtgtagtgaggatgaaagatttcttggcagggcatgggggccttgtagaatatttaatattaagaaactttataacatgtattttggggaaaaactcactgtggttctactttgtgtgtgtgcgtgtgtgtgtgtgtgtgtggtaatattttctctattttggtcaatgtaaaaacctgatcatttgatgatgatgatgatgatgatgatggtgatgatgacggtgatgttgatagaagcaactaacatttgctgagtacttaccatgaagaaggcacttcactaagtgccttcatttgattcagtaatttatttaatcctcatgacagtcataagaattcagaaccattactcccattttcagataaggttaggtaatttatccagtgtatgactaacaacattcaaaattagattttgaacccagaacattatgattccatagtccacactcttaaccactcctgcattgcctttcagtgccaaagactttacatgttaaagttggtacacttgtccatctccctatcccttcagtagaactgtcccaatgtccagtctctttgctaagtgattgtgttagttgctagttggggcaaaggtgtgggtgaagttcagccccaaattcttcatcatttttgtgctcatatagggattctgaaagaagctagagggaggatggtgtttgtcctgcaaagctgttccagagacttgtgttctgggctcataatatatattctgaagacaaagcctttggggccattcctcttcttccttcatctctcagacctagttttatcttctgttttttcttgatccatggatattaggcaactgtcttgttctccatattgtgatcccgtctcttgcccctgccctctctataagctctcacctttgtctgagacctgctcctggctcccacttcatcaggcttggcgtgacaaattgccttcttatcatacttaatgccagcctgtaaaatagggtatgctttctgctcacatgctgtcatcatctcctatatccatctagatccaggaggcctatttcatcaacataaaatccacagaagcaacacacgctgcgaatcggtgctccatgtcagagctgatgaggatggattggtgaattctgtagatcacatctgtcctaagcagcaaattagctatgcttgaattcagctactacattttgcctgctgtgaacttgctttactcttctatgaaatgtattttgtagcagtgcagaagaaatacacaagattgattagagttggcacgatttgtgcatacttctgcagttattattgtagtagctgctttaaaagactaaaaagattctttcaccaattttgttcctctgtaaagtttcatttaaacgttagcgggtatatttatgtgtaaatcggatcagcttccaatgatagttccttattgttagcgttttgatgttctgtttgcctgagcagattgatttgccattatgagagaacgtttgaactgaaaaagtcctctgaactttgttcactaatcttatcaaagaaaatagaagcagaggatgtagacagaaacctgcaaattaaatttacttttccaattcaaatgtatttgatctgcatttgttatggaactgggacagtagttgcttcttgattgtgcaatagcactgaagtttagaatatttttcaaagtcttaacaaattcagtgggggaaaatcagcaatgttaactgaaaatagcatctacccttttgtattaagttagtacagcatgtagatcatgtcattgtccttgtactcccatctatcaggcttagtgagcactgtgcaatggtaccataaatggctggaccatctctgctatgaggtgacagattgtttagggcaagccgctggcaacagaagtgttagcatgcttgatttgcagcgaagtgagggcccagtatcttctgcttgattcacatggatgggttatttcacatagctttactcagatttggagaactgtgctaatggcctgagcagtttgcttccttcttccctccccatcactttctctctctctcatttaaatcattccgaatttctgactcaagtaggcatatgaatcagaatcactgtggaaactaaacaaacaaacaaacaaaaatccaccacaagcttaagctctggctctggagatgttgcttgaatagctcaagtaggtgtaagacagtagaaaagtggaggacaaatggactttggtctgactcctgattccatcacttgctagtcgtgtgcccttgggcaatcatttattttctcctagcctcatcacttttttttcatttttcaaatgggtaacacgatagccctgctttcattaggttatgggaggagtgaatgagaaaatgcaaagtgactagtaatcactaaaaaatatacttagtatttgagtgcttcctatgattcactcttatgtggcaatcaggcttctgcattttaagtttacacattatctgcaggtcaatccccactgagaatcactacacttaaaagattcttaaaagctaagtatatgaagcacttgtttcaagtctgtgttcaggggctggttccaattttatgctatggtgccacctcataaaagtatatatgtatgtgtgtagctactggatatttatgctgtgcctggcaccgtgctaggtgctgaggacccagagatcatgaatcattgtccctaaccctaagaatgaaattgcctaataccacattctactctgtaataaagtggcacagtattgcaaatagagtataacaaaaattccctgtgacattcaaaggcgaattttatttcaaacaaacctaagcttctccaaacagaattgtcttagaaactaatcaataacaaacacttcactggtaatctttattttagttatcttccattggcttttcaaatagcgatacattttattaaagcttaactggcatttattgaatgctaccaaggggtctgatggcaagtggagtttactagaaagcagtgacatcaatactgaatcaatgcacttgaacggaagctgtgccctaagtgccattcagcatcacactgtcccattcttttgcagaacactgaattgatccccaaaacagtgcaggtgcagtgatacaggacaaacagccctgcggttccccaaaacccacctcttcaaatctgaagagaacattctttcttttctttgtcatcaaataaacacacctgtactaggtgctggtttctccctggaccgtagtgtagtgggagatagactgaaatacctcctcttatacttctgggcaaacctcagatacataatttgtgcatgggccaaatggccctcaagatattgggttccctaatagagctaccaaaagatcagagaatcataaggtaaggcactgagaaaaaatgaaactttccttctttcccaacgtcaaggtgatagccagattccagcctcagttgagcgatttttttttcagttttccagtgtttagttgtgtgcattattataactcagaaacattatggtagtatagcgttgcattttttcagatttctatttagtattcttatttcactggtcaatgaaatgacagaagagaaaatatcagctcattaaaattaaaaagacaccacccactaatgttgattgctttaaagcaaattaatctctatacatgcagaaggtgctatggttccctgttttgtgtgtgtgtgtgtttgttttttttacctttttagatctggtgaatgcgaaaaccagatactcttgaaagtaagtaagtatccaaataagtgcaaattgcacttccataccagtgtatttactccagtgattgcatggattttatttgaccatgtgataattagagcacattcaaatcacaaattcccattttacactttttgagtttttttaaaccagaatgcactaatggcctacagagtacttcagtgttaggtgatcagagaaaccatttatatgatgttcttgctaatggggaactttaaatgtggggaaggctatcgtcatgcatggaggctctaaatggccagaaaagggaaccagtataatcatcagagagcagttttacatgtgggtgagttgaatgattgttatagattcaagctatataaatgaaggtactttaagaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaatacacatacacagacacacatacacacaatttgctattggtttggtatggacaaattaatgtacagataatatacaggtttaaaaattaaaatacccattctgcactaatggcaaatgggaaaatagacgggaaaagagaggcaggtttagcctgtggacaagttgagagccttctttttctcctccatttctttttatttcagttccttctttcatctgtgcctaagcccactctgagccaggtgaagagaatggactcataaaaatgttgactctgaggtgtggacaaggcaagtgttacctttcccacaataggcttataaggattttgagagggatatatggagacagccattcttattggatggaacaatatcctgatggtgacattttaagcattagcaggtaattgcctcttctgtgtatgaggaaagctctccctggacaaagatcagttgccaatgtgtgtttagatgaaactgagaatagtccccactgagccaccagtgggatcgggtagtgcctgttgtgaggagaccactggccagacaagttggggacaaaggaacagaggagtggagaaaagcagaatgggaagatagagtctgggtaatgggagagaatagggcggggatgaatccctgggttcaaatcctggactactacttaactaacgatcattttgtagcttaatacctagtcaggaagtgagttgttaatcaagttattcatatgttcaccaaatagctattgaacttactatattacaaacatggtaggtgctatgaggaaaaagtacatgtcacgagagacctgatctagtctggggcatcagcgaacttcactgatggagcttcacattctgagacagtgaaactcgagttgaggtataaacaaggaatatgaaaaatgaagagttatttagacaagggtatgtgaagggaaaattcctgaaggaaggaagagcaggcttaagattcctaaggcataacaagagaatacagtatgttctaatgcactgcatgaaagccagcatgtctggagcacagcacataaaagtggagaaagctgaggctgaggagttgagaagggggcggagacttccaggtctacctgtccatggtaaagcacttgaacattagtgtaaggacaatgggaagccattggcaggttttatggaagatggtgttttaaatagatgtttctggaagtgtaaggtggacaatggattaaagtagacaccacactgaaggcatggtgactatttaggcagctgttagcagcagtctggacaaggtatgatggtttcttggactaaggtagaatcaaggagaaaaatgaatggattgtgtgaccttgaacaagtagcttcacctctctgagcctaattaagcttattttctttcaggtttggcctaacatatctaatgaatacactgggttttgcctctcagattatctgctgcgcataacctcccttatacgtgttaactattcaaaaaaaagttttatgtccacacttgatttatgaatgaaacatagaactagcttggagtctttagaatttattcagaattgtattaaattacttcctttaggctgctggtctggatgagttatacatttttgtaataaaaattggctttcaaatgaataaaagaacactgacatgccaccacacatgttattcctctcatcctaaagtactgaacaaaaggaccaatagaagactccccagcattcagcagtaattaaatacagatacacttatttaggaaactggtaacaggaaagagaaatttagcgccagctatctgagaaaagacagcccaaggactacattttgttctgagagttacaaacacttccaaacagaattaaaaagaaagtgcctttcagggctataacatctttccatacaactttgaaacttggcaaacatttcttgccagctcatcacactaaaccctgtaataattttgcacggtgtccaattgtgataggaaactagtagctctgtgagtgaagatttctattctgggtatccaaataacattcccagtggagaggagaaaaacactgaaattagatgcctatgtctttcaaatggttcagttccatttgattgatacgtgttgtggtacatgttctctgggcaagggcttgggctagatatcttcaaagaaggtagtcatggggctgtccaatcacttccttatcccacttgactaagcaagaatccttttgtctaataggaaggctaaagttagaaaccagggatctgtaacacaagaaagagagatataattaccttaacaccttaagaaagggaaaagagtgagtgaaataggggtgattcaaaggctaatgtttattaaaatcttctgtacaccacctactttaacctcattttatcctttgggcttcataacagctcttatgatattattatttttattattatcccttactcacaactgagaaaactggggtttccttagttgtgaagcttaagcgacttgtccaaagtcattccctgctctatctgatttcaaaagatatgctctttgcactgtactgggaagcctaagccaagtgttcgtgagttttgtagagaaaagtatagaaaactcaaattacaaaccccatggggaaatggagggagcaatgtgagacacagaaaaggggggggggaaaaacagctccaaactagaaaaaataaaacaatacaatgaaacgttgagacgattaactagataaaggaaggattagaaatgctaatgagagaaagtatacgatgacaggtagatttgaaaagaaataaatataacttctagaaaaaaatgatgattgaaattttaaaagggaaggtcaaaataatatttgaagaaatcacgcaaaatgcaacacagaaacataaaaagatacaaaagaggttcaaggacatggaagtagaatgaggaggcccagtataaatctaagaaatgttccagaaggaaagaatcaagaaaatcttgaaagtcaatattcaaatagataacagctccaaattttctagaattgaagaaagacttggatactcagttcaaaggagcccattaaatcctaagcagagtaacaaaaacaaataaacctagacatattgtagtgaaactgcaaagccctgaaaaagaaaatcttaaaagtcagagagaaaagagatgacctattagaagattgtaagttagaagacagtggacctgatatcagcaacaataaaattatcttccaataggtgagaaaaaatagttattaacgtagaactttatatccagttaaagtcactgtattagtcttctaaggctgtcataacaaaataccacatcttgggtggcttaaacaacagaaatttattttctcatagttctggaggctagaagtccaagatcaaggtgccatcagagagggtgtctggtaaagtctccctttctgacttgcagaaggcttcctattgctgtgtcttcacatggactttcttccgtgtgtgtgtgtgtgtgtgtgtgtgtgtgtgtagagagagagagagagatatttctgatttctgttctctcttccttttcttataaggacaccagtgctattggattagggccccacttttatgaactcatttaaccttaattacctccccaaagggcctatatccaaaatagttacattacaagttagggcttcagcatatgaattttggggagggggcacaattggttccgaaacatcactgttgaagcaggagagaaaagagaaaaataaaggcttttttttttttttttttttttgagatggaatctcgctctgtggctggagtgcagtggcacaatctcggttcactgcaacctccacctcctgggttcaagtgattctcctgcctcagcctcccgagtagctgagactacaggtgcctgtcactgcgcccagctaatttttgtaattttagtagagatggggtttcaccatgttggccaggatggtcttgatctcttaaccttgtgatctgccagcctcggcctccctaagtgctgggattacaggggtgagccaccgcatccagccaataaaggcattttgagatgaaaaagctggagaaattctatgaataacaggtccttaataaaaagtactattatagggtggactgtaatggaaatttattaaaacaaagaaagtgtgagttgtaagaagcaatggggaccagtgttattgataaagtacataaatcttaataagcatgggctgcataaacaacaataatcattactttaagaaggttgaaataagaaggaataaaactcttggacaacagtaacatggaagatgaagagaggtaataagatttaaaacattctgaatctttgcgttttgtaagaggaagatgaagatattggtcaacttcatgcttttcaaagttaagtattatgtaaaaaacttgtgtgtaccactaaaaggatggtaataaaacataaaacttccaaaccaatagaaggcataaacgaaaaaatgaaaattgtcaataaaatggtagacagagaagtagagacaacacggtaaatacaaaactcaaaattaggtcataggaataatcaggaattataataagtatagataaattacttggtttaaagataaagattctcagtgttggattttcttttttattattattatactttaaattatggggtacatgtgcagaatgagcaggtttgttacataggtatatacgtgccatggtggtttgctgcactcatcaactcgtcatctacattgggtagttctcctaatgctatccctcctccaccccccagtaggcctcagtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgtaaaggacatgaactcatccttttatatggccgcatagtattccatagtgtatatgtgccacattttcttcattttctttatccactctatcattgatgggcatttgtgttggtttcacgtctttcctattgtgaacagtgccacagtaaacatatgtgtgcatgtgtctttatagcagaatgatttgtaatcctttgggtatacacccagtaatgggattggtgggtcaaatagtatttctggttctagatccttgaggaatctccacactgtcttccacaatgattgaactaatttacactcccaccaacagtgtaaaagcattcctatttcttcacatcctctccagcctctgttgtttcctgaatttttaatgatcgccattctaactggcgtgagatggtatctcattgtggttttgatttgcgtttctctaatgaccagtgatgatgagctttttttcatgtttgttggctgcataaatctcttcttttgagaattgtctgttcatatccttcatccactttttgatggggttattcgtttttttcttgtaaatttgtttaaattttttgtagatcctggatgttagccctttgtcagatggatagattgcaaattttttctcccattgtaggttgcctgttcactctgatgatagtttcttttgctgtgcagaagctctttagtttaattagatcccacttgtcaattttggcttttgttgccattgcttttggtgttttagtcatgaagactttgcccatgcctatgtcctgaatggtattgcctaggttttcttctagagtttttatggttttaggtcttatgtttaagtctttaatccattttgagttattttttgtataaggtgtaaggaagggatccagtttcagttttctgcatatggctagccagttttcctaatgccatttattaaatagggaatcctttccccatttcttgttgttgtcaggtttgtcaaagatcagatggttgtagatgtgtgttgttatttctgaggcctctgttctgttccattggtctatatttctgttttcgtgccagtaccatgctgttttggttactgtagccttgtagtatagtgtgaagtcacgtagcgtgatgcctccagctttgttcttttggcttaggattgtcttggctacacaagcactgttttggttccatatgaaatttaaagtagtttttttttttaaattatactttaagttttagggtacatgtgcgcattgagcaggttagttacctatgtatacatgtgccatgctggggcgctgcacccacgaactcgtcatctagcattaggtatatctcccaatgctatccctcccccctccccccaccccccaccagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttccagttctagatccctgaggaattgccacactgacttccacaatggttgaactagttgacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatgatgagcattttttcatgtgttctttggctgcataaaatcaatgtacaaaaatcacaagcattcttatacaccaacaacagacaaacagagagtcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaacatcgtgaaaatggccatactgcccaaggtaatgtacagattcaatgccatccccatcgagctaccaatgcctttcttcacagaattggaaaaaactactttaaagttcatatggaaccaaaaaagagcccgcatcgccaagtcaatcctaagccaaaggaacaaagctggaggcatcacactacctgacttcaaactatactacaaggctacagtaaccaaaacagcatggtactggtaccaaaacagagatatagatccatggaacagaacagagccctcagaaataacgcagcatatctacaactatctgatctttgacaaacctgagaaaaacaagcaacggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcatagcaaaagaaactaccatcagagtgaacaggcaacctacaaaatgggagaaaattttcacagcctactcatctgacaaagggctaatatccagaatctacaatgaactccaacaaatttacaagaaaaaaacaaacaaccccatcaaaaagtgggcaaaggaaatgaacagacacttctctaaagtagttttattcaattctgtgaagaaagtcaatggtagcttgatggggatagcagttaatctataaattactttgggatatatggccattttcacgatatcgattcttcctatccatgagcatggaatgtttttccatttgtttgtgtcctcttttatttcgttgagcagtggtttgtagttctccctgaagaggtccttcttgtcccttgtaagttgtattactaagtattttattcttttagtagcaattgtgaatgggacttcactcatgatttggctctctgtttgtctattattggtgtgtaggaatgtttgtgatttttgcacattgattttgtatcctgacactttgctgaatttgcttatcaacttaaggagattttgggctgagacgatggcattgtctaaatatacaatcatgtcatctgcaaacagggacaatttgacttcctcttttcctaattgaataccctttatttctttctcttgccttattgccctggccagaacttccaatactatgttgaataggagtggtgagagagggcatccttgtcttgtgctggttttcaaagggaatgcttccagtttttgcccattcagtatgacattggctgtgggtttgtcataaatagctcttattattttgcaattatgttccatcagtacctagtttattgagagtttttagcatgaagaggtgttcaattttatcgaaggccttttctgcatctattgagataattgtgtggtttttgtccttggttctgtttatgtgatggattatgtttattgatttgtgtatgttgaaccagccttgcatccgagggatgaagccgacttgatcgtgatggataagctttttgatgtgctgctggatttggtttgccagtattttattgaggattttcgcatggatgttcatcagggatattggcctgaaatttgctttttttttttggttgtgtctctgccaggctttggtatcaggatgatgctggcctcataaaatgatttaggaaggagtccttctttttctatcatttggaatagtttcagaaggaatggtatcagctcctttttgtacctctggtagaattcggctgtgaatccatctggccctcgacgttttggttggtaggctactagttactgcctagacttcagaagttgttactggtctattcagggattcaatatgtgtccaggaatttatccatttcttctagattttctagtttattcgtgtagaggtgtttatagtattctctgatggtagtttgtatttctgtgggatcagtggtgatacccctttatcatttttcgttgtgtctatttgattcttatctctttccttctttattagtctgggtagtggtctatatattttgttgaccttttcaaaaaaccagctcctggattcgtttttttgtgtctctatcgccttcagttctgctctgatcttagttatttcttctcttctgctagcttttgaatgtgtttgctcttccttctctagttcttttaattgtgatcttcggatgttgattttagatccttcctgctttctctcgtgggcatttagtgctacaaatttccttctaaacactgttttaaatgtgtcccagagattctagtatgttgtgtctttgttctcattggtttcaaagaacatctttatttctgtcttcatttcattatttacccagtagtcattcaggagctggttgttcagtttccatgtagttgtgtggttttgggtgagtttcttaatcctgagttttaatttgattgcactgttgtctgagagactgtttgttatgacttccattcttttgcacttcctgaggagtgttttacttccaattatgtgggcaattttagaataagtgcgatgtggtgctgagaagaatgtatattctgttgagttagggtgcagagttctgtagatgtctgttaggtctgcttggttcagagctgaattcaagtcctggatatccttgttaattttctgtctcgttgatctgtctaatattgagtcgggtgttaaagtcccccattattaatgtgtgggagtctcagtctctttgtaggtctctaagaacttgctttatgaatctgggtactcccgttttgggtgcatatgtatttaggatagttagctcttctggttgtattgatccctttaccattatgtaatgcccttctttgtgtcttttgatctttgttggtttaaagtctgttttatgagagatgattgcaacccccctttcttttttctttttcttttttttttttttgctttccgtttgcttggtaaatattcctccatccctttattttgagcctatgtgtgtctttgcacatgagatgggtctcctgagtatagcacatcaatgggtcttgactctttatccaattttccagtgtgtgtcttttaattggggcatttagcccatttacatttaaggttaatattgttatgtgtgaatttgatcctgtcattatgatgttagttggttattttgcccattagttgatgtagtttcttcatagtgtcaatgatctttacagtttggtatgtttttgtagtggctggaactgattgttcctttccatgtttagtgcttccttcaggagctcttgtaaggcaggcctgttggtgataacatctcaatgcaaggaagctaacaaccttgaaaaaaagttagaggaattgctaactagaataaccagtttagagaagaacataaatgacctgatggatctgaaaaacactgcatgagaacttcatgaagcatacacaagtatcaatagccaaattgatcaagaggaagaaaggatatgagagattgaagatcaacttaatgaaataaagtgagaagacaagattagagaaaaaagaatgaaaagaaacgaacaaagcctcaaataaatttgggactatgtgaaaagaccaaatctacatttgattggtgttcctgaaagtgacagggagaatggaaccaagttggaaaacactcttcagcatattatccagaacttccccaacctagtaagacaggccaacattcaaattcaggaaatacagagaacaccacaaagatattccttgagaagagcaaccccaagacacataatcatcagattcaccaaggttgaaatgaaggaaaaaatgttaagatcagccagagagaaaggtcgggttacccacagtgttgtattttataaagaactctgctctatggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaaaaaagaaaaaaaaagaactctgctctatgcttattaaactggacattactaaaacataatgacagagaaatgttgaaagtaaatagatgaaaaaataaacaccagacaaatattaacttaaaaattttggtttaggcaatagttgacaaaatatatattaatgaccaaagcatcattaaaaataaagaaggacattacttaatgatacaatgaataatttcatacacaaaataaccatcctgaacctggttcatctaataacataccttcaaaatatatgcagcagaaattgacagaattataaggagaagttgatgagtacacagtcatactggggaattttaacatactgtactcgtataaactgatagatcaagcaaacaagtattgagggtatggaagatttgaataacaaaatggttaaatctgatccaatggacctgtatacagccctgcacccaacaataaggtaatacaaattcttttctaacaaatagggaacatgttcaaaaatttaccttttactgcatcctgaagaaaatctgtagtaccaaaagccagtattctatagaccagattatttgataaagatgcaatatagtgtgaaatccacaactataaactagattataggagaaaacaaaaccttattgtcaactcagtaggtacataaaacactctataaatttcgaaaaataaacattaagccacctgacaaactggaaatagatccttcacctgataaaggttatctagcaaaatcctatagccaacattatacttgaacttgaaatactagatgtccctttcaagtcaggaagaagactgataagaaaacctctcaccactatttttattgggcattataattgccgtcctaactaattataaggcaaagaaaaatgtaaggtcaaaaatatattgttagttttcacagatggtatgttttctacacagataatgtaagagagcatgtagacagactaacatagagttcaaccagtcttctgggtatgggatcaatatgtaaaaatccatagtcctcctctataatagcaagaaacaagaagaaaatgttataaaaacattttctgacaacagatatggcatccataatcatgcactgctgtctctcatcttacttctgactttctttcaggttttaagttgtttctgcaagatttgttacctccttcttccctgccacaatatgcttgagctatgaggttttctcttattttttccagaccctctaaatagcagttaaccaatttaaagcaaaaaatacaaattaaggtgaacaaggtagttgagaagaacttagagaatatccctcagtcatagttcctctttcaagtatttagtggctttgatttggctactgctatggaaattgaatatcaaagtgaaaatgctgatttttctggtaccggcttaagcaaaattcaacttattcctatctacctaagtaaaggatcccccactagggattgtgtgcccccctcttagtgtattcaagcaagaagtccatctagttactttccctttaaaaaccagtcccattgaggaaattgaaaaaggtaaaaataaatggaaagatacctagtgttcatggactagaagaattaatattaaaaggtccatgctacctaagatgatttacagattcattgcaatccctgtcagagtaccagtggcattcttcactgaagtagaaataacaatcctaaaatttgtgcggaatcatagaagaccccagatagccaaagaaattttgagcaaaaagaaggaagctggaggtatcacactaccttacttcaaaatatactataaagttacagtaatcaaaatagcattgtcctgacacacagactagtgggacagaatagagagcctagaaataaatccatgcatttacaaccaattcatttttgataaaggagccaagaacacacaatgaggaagggacagtctttaataaatgttgttgggaaaactgggtatccacatgcaaaaaaatgaaacaagatctgtagcttacacctatacaaaaacaactcaaaatggattaaagatttaaatgtaatactccaaaccacgaaactactagaggaaaacatgggggaaagctccgtgacattggcctgggaaatgatttttttggataagaccaaaaaagaacagacagcaaaagaaaaactagacaaatggaattacataaaactaaaaagcttctgcacagcaaaagaaacaatagggtgaagagacaaactatatatgggggaaatattttcaaactatacatttattaaggtgtaaatgttcaaaatatataaggagctcagagaacgcaatagcaagaagacaagtaacctgattttaaaatgggcaagggacttgaatagtcatttctcaagtgaagacatacaaacggccaacaggtatatgaaaaaaacactcaacatgactaatcaacagggaaatgcaccttaaaaccacaataagataccacttcataccctttactgtggctattatcaaaaaaacaaaagttaataagagttggcaaggatatgggcaaaagggaacccttgtaccctgttggttgtgcatcttagttcattttctgtttctgtggctgaatacctgagactcagtaatttattttaaaaaaaaataagtttatttattgcaattctggaggctggaaagtccaaggtaggtgggctgcatctaatgagagcctcatgctacatcataatattgtggatggcatcacatggtggagtgcatgtgagagtgggcatgtgcaaaagagacaaaacatgaggagtgacctcgctttataacagcattctctctgggtaactaatgtagtgccataagagtcagaactcactcactcatttgagactgcattaatcccctcatgagggtgaatccctcataacccaaatgccttttgaagctcccactaccccttaacacagttacattgggcatcaatcctcaacatgagttttggtaggagcaaaccatattgaaaccatagcagtgggaatgtaaattagtacagccacccaggaatattggtgaagatttagaaaaagatcatggatgattgtagacataaatatttaggtagctgcagagcctgttggagagtcaattgtagaggacagcagttatcttgaacctgcagattaatgtgatacaaagtttgtgaaaggtagttcttatatattaagttctgaattactaaagaatatgaaactatatctaaaatgaggaaaatggtgaagaagctgcattgtctataaagaagagattttaaaaaatgaaaaatttaatggaaaatagggacagaaggactagaaatatagaatagttggaagggaatacaaatgcaaaacaaagtaaattgtgaaaagaagaagcactttatatagaaaaaaaaacagaaaaagtatgtttgcatgtgcatgtgtgtgtctgtctttgtgtgtaaataatatgttctccaaacccagagccttctaatgagaaaaaagttactttgaacaagtatatacgttaaatgaaaattaagcaccaacacatattctaaagaataaaaagaaaaaacttgcatatatgattaccacaatggagaggagtcatatgcaggaaaagtagaagcttttataggaaaaatatcatttctgaaatatatatattgaagaaacaatgtcaaacaaaccaaaaagcagtctgtgaacacattaggaattgccctactttgttaaatggaatgacaaaattgactaatatttggtgagctcagggtgtctgctgctttcaagagcataagatctgtatcgttagctagttatttaatttatagaaatatactagaattagaatttatttgcaagagaaaatgctaaattgaagatggaaaactcccattcactatagcagcaaaacccatattagatctagaaatatacctcacaaaagatatgcaagatatgtaagtacatattatgagattttattgaagaacataaacaataatataaatataaataatagaagaaatatgccattttagtgatttggaaggctcattgtcataaaggaattaattctccacagattaacatatgatccaaggtccccaagcttactagtaatgagggaaatgtacattaaattcaaaataattcacaaccatcaaattagtatatattaaaaagcagaataataccaagtggtgatatcccaaagatgaaaggaattgggacttttgagggactatcaatttatacacctgccttggacagcatgtggcaacacctagcaaagtcaaagatatgcacaccttattataatcccaactcccacttctagatattttccatggagaaatcctggcatgtgtatacaggagacataaacaagaatgttcatttccacagtataaaattaatgtccaacatatgggaatggattaatactatcaatagcagcatgttttaaaatggaaggctatatggcagtttaaagtagctaatcacatccatatacttctacaaaaatgaatctggaaaatagtgttgagtgtgcaaaagaatttagaaaacattatgttccatacatttatgcaaaaggacaggaaaattggtcatgcctagagggtctctcagggcttttgtgtattgggccccacaaaaccgaggaaagttctctgaggagattgttggaaaagttcagtactgtctcctcgtgcctgacaaacctgaagcagtgaagcagagaggtcctcctggccttttttacttagagaatattctctctctctctctctctctcttttttttttaagaacattcttcactttatcattggagaaaagcctggtgttaagaccatctattattgtggcagtgactcaggtatactgtctggtggctctctgccaaagagagttgaggggtcaaatgactaaggtttctagattaaaaggacgagtttacaagctgaaccagaggaacttaaattgtgtttttttttctctctcttttttacgcatcactgaaaactttttgaaagaaaaagttcttagtggttattctaatcacctagcttttggttggtttttgttaaagattagaacgtcacttctcaaaattcagcacaattttcatgctttgggccataataataatgaaagtgatactaaaagacttttttctttctccacccccttttctttcaatctcagaacacaaaagatgaaggcagttttgaagagttaactttttggttgagtaatccccttgaatgcaatgtaactttaaaagagagaaaaagggaaggctagcagagatcaaatcaggacctcatggctacccaggctcctgtcaccatacgtaggtggtaaagttaggtggtagggttcatgggtcctggggtttgatctgaaatctcctctgcatatacgaaagagcatggctgaattatgtattcatttggaactttttctcttcattccaggaacctgcaactattataatacatttgttgatgtgtaactttgtgctaataaacagttctgatgcaattattgatttacagattttttcatcttactttagtatgttcacacattatgttgagaatcagtgtgtacagatactattttaatattatagagttaatggtcaattctaacaactgatatagaaaattggacctggtcctctgtctaaaaaaggacattttactcatttatatgactaaattgtgactgtggaggtttatgagtcagtatttgttaaataaatggattgatggatgggcagaaggaaggaagaattgaaggaagaaaggaagaacagacagaacagacagatggaaaggagaaatctgcttgaaaatagctttcatgaagaagatattcactttataggaacattgtcttttatatttaaaatatctgtcctcttactttggatacccagagtgccagccacaggatgcttgctatttatgatcttgaaaatgtttgaagcccttccagggagtaagggaagaaaatcacatcaaagctacactgcgccttttccttttctggttttgtgttcaaacatagcattcaagacgatgcaggtatttgattgtgcagagttaatattcccccagaaaatcaaaatagctgaattataaatagcctctttagattttttagtatagttctttaggagaatgacattcacacaaaaaagtgcacagatcctaagtgtatatctcatcaaatcttcacgaattggagaaaccatagtaatcagcacccatataaagaaagataacattaacagcaccccagaatttcttctgtccttttcttctaaaccttatttctcaccaaaaggttaagtgctataacttttaatatcattaatttgatttccctattctggatattcatataaatggcatcaaacaatatgcagctcttgtgactttcttctttcagttagcatatcgttttcaaggctcatccatgttgtgacatgtatcggtaatcattcattcttactgccaaataatatttcattgtatggatataccaaaatatttgtacccattcatcagttgatggagatttcagctttttctactttgtggtggttatgaataattgtgctatgaacatttatgtacaagtttctgtgtggacatatgttttcaattattttgggtacacgttttctctgggtatacattccatttcttttgggtatatacctggtagtggaatttctgggtcatatgcaaaactgttttcaaagtgacggcaccattttaaatttgtattagtaatgtataagtgtttcacttgtttcacatccttgccaacactccgtatggtcagtgtctttaattttagccattctggtggaaaagtttgtttttttttttcttcttgacaggtttttatataatgttgtgatactcagaaaataatactgataccaacttctataaattaactaatcttaagtcatttcctatccagggatttaattggagcgacaagtattttcctgtcatttctaaaatatgtggacaaggccttcaagatttagctcagatgccccttcttatagaatctttgcatccaagttctgggagggcattagaggtcatctacccaatcccatcattttatagatgagacagttgaagctcagggaagggaatggacatgaccaggcaacatgggcctagtgggcaagtctcctgactttagtccatggttctttctgtctccccagacagctttgtctactcatctttgcttctccttcgctgctaatttgaagagattgaaattcatctttgacaggaaaaaagttgtaagtttctagggcttaaattgaacatcaaagaagcagctctcctcccattgaaggctcgcatgctccatcactgaaaactactatcatttaagccagagaaagaaaacttaaagtgacttttcagcaaataccatttttaatacacacataatatcttctgttttatactctgatcatgattaagaatttcaaatagctcaggaagaattaaggagatttacacccacattattactcataaccacttagagcaaagaaggaaatcttttaaaaggatgtttattgctttcataccaaatgagaatctgaattaaaatgattcctagcacagtctttcgagttgaaagtacattcagccgttttcaaaatcccttgtaataacaacaatgcttggtaatttcatggagtttgtattttttcaaaggagattagggtaaatgctgtaaacatgaacttcctaatccttattttgtgatgactgccctgggccggtcttgctatccttggtcctcagatggagatgctaacacagagtggctgtccaggtttcaaggtttgatctcttggctcactgtgaatttacttcaagtgggagaaccttagttcttcagtaattatctaaccctcagttcctgagctgtaaaatatgaggattatatacccatttctgaggattaatttgtgtaaaacacgtagtactagtaggtgttccttatatggttggtacttttagattctttgctggagaaggctgttgtctaggaacaaaagtggcaggctttggggattccccagacacttatattcattcattaatatattgagaaagcaaagattggttgcttcctaaccctgtatgagaggacttcaagaagttcatgaaaaatatgtattataaaaaattgcacatgaatttctatttatttttgcaccaaaataaactcatactaacttggtataacatatctgaacaggacctagttttgaggcactaagaaagataagacattagtttgaaaagagcccttatcacagcaacatgaattctgctagaattgaagcaaaaataaacataaaattcatcttgaagattggtggaaaaatagtgaaatcactgatgctttataaaaagcttatggggcaatgccccaaaggaatcagcagtttacaaatggataacttgtttaagaagggataagacgatgttgaagatgaagcctgaagcggcagaccatccatatcaatttgtgaggaaaaaaatcatcttattcatgccttaactgaagaggactgacgattaacagcagaaactatagctaacaccatagacatctcaatttgttcattttacacaattctgagtgaaaaattaaagttgagcaaactctccactccatgggtgccacacccattgcatccagatcagctgcagataagagcagagctttcaatggaaattttaaacaagtagattcaagattctgaagcatttcttcaaagaagcataacaggagataaaacctggcttgaccagtacaatcttgaagacaaagtacaatcaaagcaatgactacaacataatactgaatggggaaaagttgaaagcattccctctgagaactggaacaagacaaggatgcccactctcaccactcctcttctacatagtactggaattcctagccagagcaatcagacaagagaaagaaataaagggcatccaaattagtaaagaggtagtcagactgtcactgctgacaatatgattgtttacctcgaaaaccctaaagactcctccaaaaagctcctagaactaataaaagaattcagcaaactttccggatacaagattaacatacacaaatcagtagctcttctatacaccaacagcgaccaagcggaggatcaaatcaagaactcaaccccttttacaatagctgcaaaatacaatacaatacaatacaatacaatacaatacaacacaacacaacacaacacaacacaacacaacacaacacttaggaatatacctaaccaaggaggttaaagacctccttgaaggaaaactacaaaggaagactacaaaatgctggaaagaaaactacaaggaaaactacaaaatgctgctgaaagaaatcatagacaacacaaacaaatggaaacacatcccattctcataaatgggtagaatcaatattgtttaaatgaccacactgccaaaagcaatctacaaatttaatgcaattcccattaaaataccaccatcattcttcacagaactagaaaataaacaatcctaaaattcatatgggaccaaaaaaagagtacacatagccaaaacaagactaagcaaatagaacaaatctggaggcatcaggttacctgacttcaaactataccagaaggccatagtcaccaaaacagcatggtactggtataaaaataggcatgtagaccagccgggcgcggtggctcacgcctgtaatcccagcactttgggaggctgaggcgggcggatcacgaggtcaggagatcgagaacatcctggctaacatggtgaaaccccgtctgtactaaaaatacaaaaaaattagctgggcatggtggtgggtgcctgtagtcccagctactcgggaggctgaggcaggagaatggcgtgaacccgggaggcggagtttgcagtgagccgagatcgcgccactgcactcaagactgggcgagagcgagactccatctcaaaaaaaaaaaaaaaaaaaaaaaaaggcacgtagaccaatcgaacagaacagagaacccagaaataaacccaaataccttcagccaattgatctttgaaaagcaaacaaaaacataaggtgtggaaaggacacccttttcaacaaatggtgctgggataattggctggccacatgtaggagaatgtaactggattctcatctctcaccttatacaaaaatcaactcaaaatggattaaggacttaaacctaagacctgaaactataaaaattctagaagatagcattggaaaaacccttccagacattggcttaggcaaggatttcatgaccaagaacccaaaagcaaatgcaataaaaacaaagataaatagttgggacttacttaaactaaagagctttttagacatcaaaaggaacagtcaacagagtaaacagacaacccacagagtgagagaaagtcttcacaatctgtacatcggacaaaggactaatatccagaatctacaaggaactcaaaccaatcagtaagaaaataaccacacagtcccatcaaaaagtgggctaaagacatgaatagacagttcttaaaagaagatatacaaatgtccaacaaacatgaaaaaatgctcaacatcactaatgatcagggaaatgcaaatcaaaaccacgatgcaatacctccttactcctgcaagaatggccataaaaaccaaaaaaaaaaaaaacagtagatgctggcatggatgcagcaatcagggaacacttctacactgctagtgggaatgtaaactagtacagccactatggaaaacagtgtggagattccttaaagaactaaaagtagaactaccgtttgacccagcaatcccactgctggatatgtactcagaggaatgatatatgatatatacacacacacatatctatctatgatggaatactactcagccataaaaaggaatgaattaacggcatttgcagtgacctggatgagattggagacttaagtaaagtaactcaggaatgggaagccaaacatcgtgtgttctcactaatatgtgggagctaaactatgaggacacaaaagcataagaaggataaaatggactttggggacttggggggaagggtgggaggggggcaagggataaaagactacaaatagtgtgcagtgtatacagcttgtgtgatgggtgcaagcaaaatctcacaaatcaccactgaagaccttactcatgtaaccaaataccacctgtacccccaataacttatggaaaaattaaaacaaaagataaaaatcatgaaaataaataaaaataaaataaaatatagaaaattggtgtttcaaaaacaaacaaaaagcaatggctactaagaggtggaagcggtcaaagcaaaagtaggccagtcaagacatgctcaaggcattttgcttgttgactttcgaatggagggccaaagaatgataacatctgcttatgacaggagtgttttgagaaagcaaggcgcagctttagcagaaaaatgcctggaaaagcttcaccagagagtccttctccaccacaacaatactcccactcattcatctcatcaaacaagggcaattttgtaagagtttcaatgggaaattgttatgcatctactttaagtccttatttggctgctgctgacttctttttgtttcctcatcttaaaaagatctgtaaagggcactcatttttctccagttaataatgtaaaaaagactgcagtgacatggttaaatttccaggatgctcagttctttagaggtggactaaatggctgggatcatcacttacaaaactgtcttgaccttgatggagcttacattgaggaataaagtttatattttttatttttatcttttacttccattttttccactaactttttgaaatatcttcatattagtgtaatgagtgtgtgtgtgtgtgtgtggtgtgaaaacaaaattttcacattaaagcatgtcacattctatttttattatttttaacttatgatttttataaataaccattattaccagtgctaggttccaggatactaaaacaaggcaaagttggaaagaatgtttccatacaaaaaccaatatataacataaagatatgaacagatgaatgaactataaagcaacttctgctaaactggtaattgttagaactaaagcttcagagacttgtaatttataccaactcctggatatgggatattccattgttggattgatggcctaaaataagagaaacatcatttttttcagaagaagttttagaacatggctgaaatccgtcataatgcttaaccttgaactctcagatatcagtgctaattcatattttgtagggcaaatataggacaagagaaactgcacaggcagactgctagtgggtggaaaaatgccctttgactgggaatcaggagacttggctttttgttctagatcagtcactgctttatagggtgacctgagcaagtcactttaatgttgtggatcttactttcctcatttgaaaactacttgtttagtcaaaactattaattataaactatgttctgtagtaataggcttccacagaggtgccacagagatcactgcaggagggactctgcgaccttaatccccaactatgacccaagtagttcttttgtccactggtctatatataggggctattcttggggtttcatttgaataaaaggttctaaggtctgagtaaaatggggcactcccaggctaaatgatcctgacttaggatacacaacctgatcaaggttcttcaggttttaaggttctgtgatatctggataaccaaagtaggtgtttgtgacattctgtaacttatctgtctgtgatatgttagccagttctagggctggaatgatgatggtaatagacatgcccagtgatgaatgacctaccatgctacctaggacatcttacaccttgattattgaatttaaaagagcttctgaatcatcagagaaagatcaaatttggcttagttgtcattttactattgtatatttctatctgtgtgtggtatatttagtgaggctttaagtatatttggtgggtctccagtaactagaatgtttcattgacctatatatgccattccccagttatgccaggcagttgaaagtttatcgaatcagactgaagaatttgaagttgaggcaatgcttctcacacctatataaaagatgtcatgaggaagaaccagagaggaggagtgtgtatgaagtattggtcaattttttatacacatatagtaaaggctgatttatttgaggcatagtgttatttcaggcaatctgaattaactatgactaaaaatggctgttctgagctattacatttccaagtgactaaaaaacacgtgcatgaaagcaaaatctagattttgtcagaatacacccaacatctataagaaaataagctggaggcatatagcacattctattttaaaacatagtggcctccctttgagagaaagtggtgctgttagtgtcattttacttgagagagataactttgtggcactagtgatgcttttatgtgcatttatccatttttatcagcctctttattccctattcattcattcatttttgctttttactctatctctgtaggccttaatgcttttgatatttggctgtatttatgtgttcatgcaatccaaagcagacagagcacctcctgattcaaagcaaggctctgcgtttggcactgttggggatatagagatgattagccactcttcttagtatgttattgcattttagaagataatgtcttgaagatagattattgtcttggatgaagcccctgattaagactggagaaagaaagttgattaccatatccaagatggaggctaagggggaagacttgaaggacatggatcctatacctctttttttattgcacctcatctcattgtatcacattgatctgttgacatatgtctcttccctattagagtgccttgagagcaggcttttgactcaatttgaatggctagaacctagcacacttcctacagagttggttatgcacctactcagtgaatgacagacatgagtctgagctataacttgggagggactgttctagaaaagtaaaatgtggtgaatatatgttactatgtagtgttttaaactgtcattgacatctaggaagaagatgttaattgacttggctttggactgtggcaggaaaacatttagatctcgctcaaatgttcatgacagtcttatttaaaaggtagcctacattgttctccttactgcttattacaaaaatgcacatatcccagaaatcaaaaggaatgctatgggattccgaaacttattgccatctgggccatgtgtggctgaactatgaaaagtcattcagtcagcaagatagaaataacatctgcataggcagacaacttagcagactcagaccagctttcctctgaagcccagctgccattgtgactcatggcaagttcccagcttgaaaaagcaaagaactgaaaagcagaggtacctaacccagagtggagaccataaagggcagggaagcacacaagtcagtcttctgacattcctgaacaaatagatttcctttaactcatttatctccatggagtcaggttgactgttgggcagagaagttggagagttggaggggaagagtgacagaaacattttaattacaaagttaggttcgttatagaaatgcaagcctgtctcaacagttggtaatcagtatgatagatctctcagtatgagagatttgaagtaaataggccatatcatcagtagaaacagaaaaaaagctaattctacccaactgtatgtttgtacccattaaccattccctgtctacctccccctgccactacccttctcagcccctggtaaccattattctactctctatctccacgatttcaatttttttagcttccacatatgagtgagaatatgtgatatttggctctctgcacctggataattaaaaattttaaaaattaagaaaataatgccaactcttaaacacgtcgaagtgcatttaccataaaccaatagtaaacatcataataaatagagaaatataaatggcattttcattaaaatcagaaacaagacagggatttccccattgttactactattcaacactgttttagaagtactcgttagtgttgtgtgccatggaaaagaaattagttttataaataggaaaatgacaaaattattattatttgcatacagtaccactatatatctataaaatccaagagattcaactataaaatcatttgaatgaataagaatttaactgggtggcttggtgcaaaatatatattattaaacaattgcttttaattatactgacactaaccagttagaaacaggacaaaatcccattcacaaacaaggtagtaatttaaaaaattacccaggaatagaattaattaggacaatacaattatgacaatacaatctatgtgagattaatcacaacattgtattcaatagaaaaaaaaaaaaaaacaagagctgtagaaggtgagagacataccatgccccctgcatggcaagaattatgttatcttaagcacttaataatattttttaaaacttaagatcatgattctaaagtttctatggaagaacacaggtgctgcaattgttaagggaatcttaggaaaaaagaaaagtgaaggaaaagtgccccgttaggtatgaaatttaatgtaaatgagagtaatattggtccaaatgtggacaagcaaatcagtggaacagaatggagaatacagatccaggtatttgtgggaatctgctgcatgataaaagtattattgaaatcagtagcaaaactgtgactttttcaatatatggtgttagaagaaaataaaaatagaactgcttcttcacaacatgtacaaaggtaaattctagatatattaaaagtaatgtaaaaaagaactactgaagtattagaaaacggtataaaaatatgtatatgtctgtggggtgatgttccttaaacaagacatagatccatgttctttaaagaaaaaaaatctctacagatttaattatataaaattaatctattggaagaaaatatttgcatacatctgatagaagaaagtcttgatgttactaatataaaaatactcctacaaattcataagagaaaagaactacctaatagataaatgaacaaaggatttggataggcaatttaaaggagaaattacaaatttgttgaaacattcatttggaatattattaggttggtgcaaaaataatcgtgcttttgccatttgacagagggagtaaattaacatatatgataaacccactgtatgctaggtactatgaaaagtggaatatatcttctcatttaagcctcaaaactcattttacaggcagttaatgctaatttagccattttacacataaggaaattgaggcttaatgagtttgactaactcttccaaagtcatgcagtccaaaagtggcaaagctagcatattttctggagatgtattgtacagcatggtgactatagttaacattaatgtgctaagagagtatacgagttagtgggtgcagcgcaccagcatggcacatgtatacatatgtaactaacctgcacaatgtgcacatgtaccctaaaacttaaagtataataaaaaaaagaaaaaaaaaaccaaaaaataaatgttctcattctccaaaataataaggatgtgaggtgatatggatatggatgtgttaattagattgatttactcattccacaatgtatacatatatcaaaacatcatgcactatccacagcctgggaaaatgtgctagttggtggcatagttagatgaatttttaggtcattaagaaaatataccccaacattgttgacttagagctgataatgcattcctagttcaaagaggacttcaagtagccagggaattcagtctattgattctggcttgactgctaacacacagggaaatcctcagcaaggctctcagatcccatgaggtagatacataagaggcttgaatgattgaaccaggagaatgctgaatgagggctctgtgtctacattgttccagggttttgaggacagaccagttattttcttaattcttgtattatcaaagcagatactcagcctggcttagtagaccctggagggtgcactgtagtagagggggccatgcaggctcttctctgtctttaaccctttattgttcaacctataaatatcgaatttgaggaacccacaggagccacgctagtcaggtttttcaattttgatgatggagagggtgtatgccaataaatattattccattcattcctttccaagttaaaagttcattgggaaataaaattcaagaggtggagaaatggagacagaatgccagaattattactaataaatccagcagaagaatttggttttagatctatagtgaaaagggttttctgacatttgtactctgtcacatcccccaactctctcaagtccagacatcaggacagcaaacccaagggaaaggttgagcccataggagccactacatttacccagggtgctgcctcttactgattcaaggcagatagtgacagaaaagtgtgaatcctcagtgcctttgaccttttttattgcaaggtgatatagtttggatacttgaccctgtccccaaaatctcatgttgaattataatccccaatgatggaggtggggcgtcgtggaaggtgtttggattatgggggcggatccctcgtggctcagttctgactttgttatagtgagttctcacaagatctagtcatctaaaagtgtgtggcacctccgaccccactctcttgcttgctcctgctcttgccgcatgacgtgtctgttctctctttgctttctgctgtgattgtaagcttcctgaggcccccgtagaagccaagtagatgccagaaccatgcttcctgtaaagcctgcagaaccatgagccaattaagcctgttttctttgtaaattaaccattctcaggtatttctttatagcaaagcaagaatggcctaacacagaaaattggtaccacgagtggggtattgctataaagatgactgagaatgtggaagcaactttggaactgggtaacgagcataggttggaagagtttagagggctcagaagaagacaggtagatgagagaaagtttggaacttcctcgagactggttaaatggttgtgaccaaatgcagatagtgatatggacaataaagtccaggctgctgaggtctcagatggaaatgaggaacttattgggaactggagcaaatgtcacgtgtgttatgcattaacaaagagcttggctgcattctgttcatgccttagggaatctgtggaagtttgaactaaagagtaatgatttagtgcatctggtgaaagaaatttctaagcagcaaagcattcaagagctaccctggcttcttctaatagcctatgctcagatgcaggagcaaaggaatgacttaagttagaacgtatgtttaaaagggaagcagagtgtaaaagtttggaaaccttgcagcctggccctgtggcagagaaagaaaaagctctttagggagaggtattctagcaggccacttgctagaggtatttgcataactaaaagtgaaccaagtgataatatccaaggcaatggggaaaaggcctcaaaggcacttcagagactttcccagcagcctgtcccatcacaggcccagaggcctgggagaatggaatggattcatgggccaggcccagggcttcactgctctgcacaccctcaggacactgcaccccatatcctggtcactccagttccagctgtggctcaaaggggcccaggtacagtttgaggtaccactttggagaatgcaaaccataagccaaggtggttttcatgtggtgttaagcctgtaggtgtgcagaatgcaagagtgaagaatgcttggcagcctccacttagatttcagaggatgtatgaaaaaagcctgggtatccagggagaagcctgctgcaggggcagagcccccacagagaacatctactaggacagtgcacagggaaaatgtggagtcgaaggccccacacagagtccccactggggtgctgcctagtggagctgtgggatgggggccaccgtcctccagacccgagaatgtcaaatccatcagtagcttgcaccctacacctaaagagtagctatgtcggctgtatcctgcaaagccacagagttggagctgctcagggccattggaggcgactcctcacaccagcatgccctagatgagggacgtggagtcaaagagattattttggagctttaagacttaatgacttccttgctggattttgaacttgcataggacacatagcccccttttttttaatgctggaatgagttaagattttgagggactgttcggaaggcatgattgtattttgcaatgtgagaaagacatgaggtttgggaggggccagtggtggaatgatatagtttagataattgtttccacccaaatcttacgttgaattgtaagccctaatgctggagacgggacctggtgggtgtatagatcatgggggcagatgtctcatggactggtgctgtcattgtgatagaattcccttgagatcttgtcatttaaaagtgtgtggcacctcacacctcattctctctcttccttgctcctgcttttgccatgtgatgtgcctgcttccactttggcttctaccatgattgtaagcttcctgagtcttccctagaaactgagaagatgccagcaccatgcttccagtgaaacctgtagaactgtgagccagttaaacctgttttctttgtaaattacccagtcttaggtatttatttatagcaatgcaaaaatggcctaacaaacagtaaaatatacacaacataaaatttaccttttaactattttgaagtatacaattaagtggcattttgtgtattcacaatattgtataaccacaacatctatctagttttaagcatgtttattaccccaaaagaaaacccagtacccacaaaacaattacctccccctgcaactttccttcccctaagatcctggtaagctctaatctattttatctctgtggagaatttgcctattatggaaatttcatatgaatagcatcatgtaatacgttgccttgtgtgtctggctttcaccatttagcaaaatgtttccaagagttcaaccgtgatgtagcatgtgacagaactttcttaatttttaggactgcatagtattccatagtatgcatataccacattttgtttattcatttatctgttgatggacatttaggccgtttccactttttggctattgtgactagtgctgctatgaacttttgttttctagtatttgcttggatacctactctcaattattttgggtagatacctagcagtggaatctctgggtcatatggtaattctatgtttaacttgttgagaaagcaccagactgttttccacacttgtggctttaaaatattgataagcagccaggtgcggtggctcacacctgtaatcccagcactttgggaagccgaggcgggcggattacctgaggttagaagctcgagaccagcctggccaacatgctgaatctccgtctctacaaaaaaatacaaaaattagatgggtgtggtggcagtcgcctgtaatcccagctactcaggagactgaggcaggagaatcacttgaacttgggaggcgggggttgcagtgagccgagattgtaccactgcactccagcctgcatgacagagtgagactccatccccaccccaaaaaatattgattagctttccctaattgaaaagtgtagcccagtggatgtgccccactaattagataacttcctcctccttggggtggggtaagtcacacgtgggtataaagccaggatgttactacacctgaagttccttcacatgtgcacatagggcagggaaaaagagcatgccatcttcaacagatgacatacagctgggagcaataactgacatctagctattaaacacaaacttcttgaagacctataatgtaccaaaaattgtggcaaacattgtggatccagaaacaaggaaaattttcggtcctccataagctcagattctaaaagctgagcactaatttttaatgaaatcgtaatgcactaatcagaatccacgatacatttaaaaatccaattatctgaaatacaaatttaacattatacggggatgtcgctcaatgataagtgacctcactctcacattacgtcagttcataaaatatgtagaggaccatgtccaaaaaattacacataattcagctaagatgagcactgcacaaaattgaataaattacagtggttcatctgtctttaaaataatatttaaattaagaaaccaaactaatcactagctgaacttgattattaaaatcaaattttttttacataaatgcatgttaatagctagacaacatacactgcaataattgcattatatttgtcagtttcgatttacaactgaatttaccatcatcatgtaaaacatgaatctgtccctaaactgagtgcaggcattaccaatgagctgattatatctccacctactccatttaaccatcgtcaggcactacctgaaatattatataccaacacagcactccattcttgggatgattcctggtccaaatgattcatttctcatggatctgcctccacatacccaaaacccatgttccgtatcattggatatcacattagtgtgggccacagagaacacccatctcttgctaagaacaacagcactattctatagacagcatagctctggcttttgaaatggaaagaaacacatgtaaccatgccgtctttattgctctgtgtaacttttatttaagctcttaggtaatttagacatacccattcttctagttaatggctaacagcccagtattgtcaaataccatgatgaaatattctgacaggtctgcagttttacacatgtgattgaatgttcagactactttctctccatgacaggctaccaaataccatacataatttgagtatttttgacagaagaatgcacatcattttctttctagggaataacatgcttttgaggtttattacccgaatttgaacacattcttatagtggattttccatattgttcttccaccaacaatcattaagggttgtgatgttgtgttcaaatgccatcttatacattaaattaaattcaagttggtgtggttaatgttattggaaaatacctattaggcttgcttgaaaaatgttaggaactgtgattgcatttagaacacagaatcagacttatggaagcaactgagttctattaaagtacctgagtttatgtagaagagcaaagctaaaatgtgactaagtgcaatgcttaaaacacactaataccagttaaatggataagtacctgtagtaattaataaaaaaggaaattcatctagaatataattttaggtgtcaataggaggagtccatcctgcagaagagattcagatagaaattctacttctaacctagataaccatgtattagtatcagtgcttttgtatgcacgttataatctcagctaatcctctcaagagtgctatctcattcatttaaatgggttataatagaaaatggatctgctcattctattctacataataggaaattaaaaaaacaacatcctttgttgtttaagcatacatattatattgctctactgaaggttgtctaagcttctattttcttagacaatctttttttttcttcaatttctattttaagttcaggggtacatgtgtagaatgtgcaggtttattacatagatcaatgtgtgccatggtggtttactgtacagatcatcccatcacccagatagtaagcccagcatccattaggtattcttcctgatgctccccacccccacccccacctccgacaggccccagtatgtgttgttcccccgatgtgtccatgtgttcttatcattcaactcccacttacaagtgagaatatgtgatgtttggttttctgttcctgcattggttttctgaggataatggcttgcaacttcatccatatccctgcaaaggacatgatctcgttccttcttacagcttcatagtattccatggtgtatatgtaccacattttctttatccagtctatcattgatgggcatttaggttgattccatgtttttggtattgtgaatggtgcttcaatgaacatacatacgtgtgcatgcatctttataataggataatttatatttctccaggtgtatacctagtaataggattactgtgtcaaatggtatttctgcatctaggtctttgaggaattgccacactgtcttccacaatggttgaactgatttacactcccaccaacagtgtaaaagtgttcctttttctccacaatctcgccagcatctgttgttttttgactttttaataatagtcttaggcaaatcttgatcttctcctacccctcccaggattttggtttttaagtgtcttttgatgttgaagattgaatctatgttctatttctagctgctgtgcatctctgttttcctccatctttaacctcctctccccttacacaggtgatccttcaatgaaacacaattccttattttgtgagtctctcaattcacttttatgactggatattgtttccaaattccttggcaggtttagttactacagtgattagatgaggccatgatgtggccaggcattggaatcagaccagagggcaagttattcaacttctctgtgcttcactttcctcagctgtgaaaacagactaatgatagtacttacctgataggactattgtgaggattaaatgggataaaacacttaaacactttatatagtccctggtaagtgctcaactaatgtaacaaaagacgttggtgaacattagggttcctcatccataagttctctcaggccatactattaaacaaaccactcagaaagtatctcactgatttattttaatttgtttgaaaatggaagtatacaaccttttcaaaacgttttcccatctctagtcttctgacacgtctcatatttttcaccttcccttgcattataaagggtcattcagaaatctgatctgcaggtgttctctttgcctgggatgccatctaaatgtatcaggagacttagttcattcataatatattgatagaatgcctgctatgtgacagttgccgttctagggatatagggtgaaaaaaacaatatccatgacttcatgaagcttcaatcccggtaattagaaatctcttaaatagccaggggttcgtttccaatctctttgcctagctttgtcttccttattccaccccactccattattctgttacaaactaccttagttgtaccttttccaatctttggatcattacctataatgaagaatacataagcaaaacagtagttgaaaatacctgttttccttctcctctggttatagcatgctgttgttcccaagaacaagcctacgaatttctcttttatttttttctggaaaatataaaacacatcctttttaggaaagcctcaccttattctaggctttaatatttctgacactgtgtcaagggcttcagaaaatcttgatgcaaaggaaagggctttgccttcaggctcaactgaacttaaatctaaacttaattgcttcttagcaatgtgtgtgacccctggcaaatcatttacctttctgaggcttagtttcctcatttttaggtaaggataatgaatgccactttgtggggctgtcatgaacattaaaatgaaagaatgtctataaagcactttgtacaagcctagcacaaattaagtgctcaataaacattaactatttttagcaagagccacccagtaaagaaggcttggtttcaaatctctgttccaagcttactagctgattaaccttcagcaagttgctcatcttcactgaatatgggcttccctttctgtaaaatgaaatttaatatctacttatctgaataattgttctaatgattaagtgagaaaaatgtaatgacattgtacagaatatattccttctacttttatgtcttttgctcactaccaaatttttcaaggccttgtatccagccctgggagaataatatagacatgatctcttgcccttttggagaaagacaaattatgtattatatgattagaaatgatgtgaaaattttatgagggaaataagcagtgctgttctagagaataatggttgtttaatttaaatcagaagagaggacttcgttaagagatgacatccaaacagatccaaatgataagaatctagcaattggaagaacatttcagccagagggaacagcatatagaaagatcctgaagtggaaagagcttggcctgttcaatgagctaaaagaagcctgatgtcccgatttttttgagagaatatacctatcctttatttagaaaagtaaggcagagttgttgacattatcaaataaactagaggagtcaagggagtgagggcaggtaggaaggttttaaaaggtggtcatggtaaactttccaaaataatatcaatattttatcagttgggggtcccgacaggaaacaggtggtacatgcaaagtgggtagctagaggataatgtaataaagggatatatacaacgctgtggtcggggtttaaggttaatagttaaagaaagccaacaaaggagaaggaagcatcccaggacaagcaacagcaggggtggattatcaccctgtgtgttgatgaaactaggagtgggggtggttacagagcttggagagggcagcagctgcatggagaaggcctggtaaggtttttggtagaggaacataactgctatcaatctgtagtccagaaccaagggatctggtggtagggacacataccctgcccttctttcactctcttgccagtacctcctattgggcatactcaagtggaagccagagggaaaagggagttggtttgatgtagcctgtagagatcagtcttctggggcacacagaatgtggagaggggtggagtatagatccagagagacaaattcaaactatccatcacaacatctaatatataattgtgctaggctgaataatgccttccccgaagatgtccatagcctaatccctggaacaggtgaatatattaccttaaatggtaaaatggactttgcaaatgtgattaaggattttgagatggggagattattctggaatatttgggcaggccctatgtaattgtaagggttttataaaagggaggcagacaagagaatgagatgtgcccatggatgcagagggcagagtgctgtagagctatgagccaaggaatgcaaacaacctcttcaagctggaaaaggtgagaaaatagattctcccctagagcttccaggagaaacacagactgctaacgccttgattgtagcccagagacctgttttggaattctgacctccagaactgcaagaataaatttgtgttgttttcagatactaaatttatggtaatcttttttttttttacagcaccaataggaaactaataaaatagctttctaattctatactgttttttactactgtcaagcatgctcatgaacattacctctttcaatattcacagcaattctgtgaggaaggaattattttctttagtatatggagagagaaagtgagggtcagagatttgaaaagtcttgcctatagttatcacatgatgcagctagagatgaaactcagcttttttgactccaaatgcagtgtccttttccctcaatacactaaatttttttctgcagagaagcagcagaagaaagcgaggcttcagggagatgtgggacaaataggtggttcagtgtattgtggtagaagagttgtctccattggagctaacagattctattgcttgatctgacctaccttcagattcagagtatcaatgctcactgaaacccgtgtgatatggtttggctgtgtccccactcagatctcatcttgaattataactcccacaattcccacgtgctgtgggagggacccagtgggaggtacttgaataatgggggtgggttttcctcatgatagctaataagtctcatgagatctgatggttttaaaaagagttcccctgcacaagttctctctctttgtctgctgccatccatgtaagatgtgtcttgctcctccttgccttctgctatgattgtgccacctccccagccatgtggaactgtaagtccattaaacttctttcttttgtaaattgcccagtctcgggtatgtctttatcagcagtgtgaaaatggactaatacactatgcttgatgcaaggcagtggttttcaaacccatgtttggagcaagccccagaaacctagggcttttgaggaaaaggatgtggggtgatggggttctttcaaccagagaagctctatgctcatctattttttaactaattgactttgatgtaggccacatttcaatttacaaaaacaattctggggctaaaaagaagtttgaacataatggtggacattctgcagactttcactgtagatgataagaagaagtagaaacgtagaaactccagggtgattttcagtaaactccatagaaaggaggatgaggtagagcagaattcttggagacccccaagcacaagctggctgtgagaagcagcagaatatcatatatatgacagcatctgggctcttgtttgatttttaaagtagattataacatttggaactccatatcctatgaggcttaaacacatttgtgatggcgggatgtttctgttgcattggcaaaggtcaaaatcaatagaattcgcaaatgttcccctatgtcataggtcaggtgcactattattccatagatcactagtgactttctctgtgatctttaagcatttgtttgacataaaaatgacttttaaggtttacttactggtcccttggcaaactaagaacacttcctatctctaatgctttaaataaatcatctgaaattattgcacattgagctgttactttgactggctgctgagaaatgtgcttgtgttttaaaggacttctcttttggaggtgggtgagtgggtgaagaacctctttttttgtctgctcctctagaaatggtctttctgaatgaaatgagcacatcagagagctatgtccctgaaatgctcctcaaccctcctaagcccaccttctctgaattgtacttcagtattaggtgctggacctccaatagagaacactccaaaaattcttcatcacagacttgtcgttgtctttatggtaggggtggtattgggagcattgtccagaatgtcccaaatacactttagaagaacccgtgaaaggaaagaagttctctcagacctcattgccaggaaaagctgtgtttctcttcagcaactagtgtgtttttacgcttatgagtatttggaattttgttattcagtcagtggccagacccactgaataacaaaaccatagctgcatattagatatgcatgaatgcatggccccactctcaggaacttaatttttcaaatggtgaggctaattttgcaaaaatgctcctcctgattctaatatgtagctaacgttgaagatcactattataacaaaatagtccctgtgatttagtcactggaaaactcaaaatcaagcctggggcatttttgaacagttatacagtaccggatgtgcctttctgagtgtggttctgatctgggcttgatcatagtgacatgttctgatttactcttcctcctaatttctttacctattttttaaatcaatttttcattatatatttattagatctgcttcaaatgattttgaagtgaggcaatagatagattggtagatggagagatgatagaaagatagatcattgccaagcgatgtttatactgcgtctagttactgctagggcatttttctaacgattagatacagcaaattgaatgatatgggccaatcctgctgcagaaattatagaaaacattgtcttttgtgttgttattatgaaaacattcccacagttctttcatgttttaataaaaaatgaagaattattaccaatagctttggaaagtaaagaaaaaggaaatttaaaaagtaattcctaactccaattccccaacatcacaaaacctttgattttttcagagcattcatctatccttagaagacttctatttaagaaaataaataggagtagaaaaatcaacaagtgaagtatttaagaaaaataagcccagtcttcaagatgcttggaatccgcatttgctacttgcaagtcacataagaagaacaagccacttattttagtgacttcctgctgggctccagacaccatagcctatgagatctctaaaactgggcccctatttactttttcaactttcgagccattcaccacttcccctcccctccattcccacatacaactctagtcaggataaacatattttagtttctagaacatggtctttcttctgggtcttcatacatgttgttacctctggatcacattatctccccacttcccccattcacccagctaactcactccccttcattctttctatgttttgccttagatgccatttcctactggagcttctttgagttttcagacttgcttccctgctgtaggtacttttcctattaagccacttgttccaatgaatggtgattacttagtgaacatccgtctcttctgttagactataggctgtggacgctggttttgtcactgtatttccagcacctagcacagtgcctgggacagagtaagtactcaaagcatatattttgctgttgttattataaggtttatgtttttcatgtttgaaaggcacttgtaatatgtcaataattctgatagaagtcatttttagagaaggacgccataatcattcagtgagagaacacagaatgctcagacagtatgtggaccctgtagctggacattacttttccctgctgatggttttctcttcagatattatgttagagattataataagacatgtagcaatggagagaaatcagctcatcccaaactgattttcacttttagttaacacttgctctatgcaagaaaaggtcatattagttggtagcttgaatgcttccaagaccattgcctatttcaatgcttcaaagcttcagaagctctgccctgtgctgcagtcatttggtgtagaagtggaaggtgcctgaaataagacagttaggggttagaagcacagaggcgggtgttataaaatgtcacgtatgtttacatggcttttttctcagtacaattttgattattgccttgtaagcaagaccctgtagtatattgaaaatagctctgaatttgtagtaaaaactttttcatctttctacttcctaacagtgttactttggacaggccaatacatcactctgagctttgatttccttatctctaaaatgggggcagtgacataagcttcatactaacctggtgaaaattctcttgtacctaagtcagtgatcgataaaggtctattaaatccaaatgtcaaggaaagacttacctcattggatggaataagtgtgaactttctggctttcctcttttgcaaagtttgtgaatgcatttaatcatttttattagtagtagtattacttatttacccctctgcaaatcagttatgaaaagaaaaatgtcaaatgtaacttacctttccaaagaaaattgatttgttaaagcaatagttgccagaaactccaattttgctctgatttgatatgatccagtacaagctaggagtttcctcacagagctgaggggaaaaggaagagccaaaaaatctctccaaattagcccatgaatgtgagctgtagttttttttttttttttttttttttttttggataatcagatattctgactttggtcttctaattattttaccaggccaggaaaggagagctgacaaataagcctgattcttccttggcaccaaaaaattcaaagaagaaccgaaagtccattgaagttcttgtttcctttgaaatgcttgtgatctgcctcctgagactgcaaggttattaacttgcatcaggaaggtggtagagaactgaataaagaaatatccatccatctcagttgtcgtggttcttctgtcattcagaccccagcagagcaggaagcagtgagctggaaagtgcatacattggtttttccttgcttctactgaaggatcaaaactccttaggccactcagtgacttggttgatgccttccttcttcctacctttgcctttcaatatctaagcaaagttgccctttgtttatgtctctggggttttttctctttccttctcagaatgtcttttcctcatttactcttattcccaaacaactctttgtgtaatctagctgggaacacattgtatgactacttaggtataatacagaggcatagtgctagaagtatagagataaatgggttctcagtgaccatcctaacagttatacttggtggttttcaaactgtgcttcaaaagaaccctataggtatattctgaaggaatcccaaaggttttataaaaaggaagttggtggaagatgcgtggtttggtgtccaaggaaagctaaacagaaagggctatgggcaagccatcatcacttccaccaaagaagttccgctttaatctgtatcttatatttggcattagcaaatgtttagataaagagttctgtggccaaaacaattagtggggaaagcatctgcttagccctgttacttatctgtagaggggtaaggacctaagtaatgttaataatgttaacatttagtgttaatattattttgtatctgctgtggttgcatagatgcatcttctgtttgctcaactggaacgtgaacccatgaagatcacggcctaggtttgctgtctttatgaatagacacctggtctgttcttattgggcataactctgtcttatggattggctgctgttaaagtttttggagctgtctttttttaataatctaaccagagttgtagaaccactgttataaaatacatctgtagacagcacaatttacatattatttcaaggagttctggtgtcactgaagtcaaactatgcactttgagcataagaaacctggcaggagaggcttcttgatttaccatacaaacttctggagcatgtttgtttggttttttttttttttgaccccgatctttagaactgcccaatattggaattggaatgggctacttcatgacagactcaatgcttgattcctttgcatcaacccagaacatattttagattctattgtttccaatttctacatatgtttccttgggcaaatcacttaatttatcagagtctcagttttcttatctgtaaaatgggagtaatgatattgcctactttataatgacctcataaagttgttgggaggagttaattaggtgggcacagagtaggtggtaaaaatgtcagttccctaaaattccttataatttattacagaaaatacaatctgccttgtgtggaaaattgaattagatgctcttgggtcccttataatgctgagattctctgttggttcatcctttctgctttgttttgtcaaataatccagaagctgttgcctttttgctttggatttaccttcaaatgggttttaggtatagaatcttgggaaattattattatttttttgcctcaaaatccagcttaaaaatgttttacaaatatcttcagctgctttgaagggattttacatctttattgtaaagtggctctgagtttccctgaggaagatgagatttttgactaaattgctgacatgttgcactttgtagccaaattgtctagggagatacacatttatagtagatagtgtacgcttagagtttgtgatgtactttggcttcaggcttttaaataagtccgccaaggcctgttccaaaaaccagatctttaaaacgtataccttttaacatgcctctggtggactatgcttccctggattcaagcccttccttttaacctgggctagcatttgactaattgaatgtggcagaagtgacaatgcacaactttgtaggctaaatcataagaagacttgcaacttcagtctgtgttttttggaatgtttattctgggagaagctgggaaccaggtaagaagtctgactgtgtactccaccatgttggagaaacttaaataggaagaggccacatggagggagagagatgtctgaccagcccttagctgctctagtcgtcccagctgaggtgccagaaacttgagtaaaatagccattttagacatgcagccctggtggctgcaattgcagaagagatctatctaagaacctcttagtttggcccagttaacccacagaactgtgaggtaatatagtaaaatgttgttttgaattactagttctgggtggtttttacacagcagtagataactgaaacagatgcctaaattacacatcgtttgcaggcacacataaatacaaatactggtgaattatttgaagctaccaccacagtgtctggtaggattgttagaggtcctggagcttcctagtaattaggccagctttcgttgccatttactcaagtcgttaaggcttagctgctcagatcaagaaaatcatttgttattaggttcaaggccactgagacaaaaatccagcttttatctttcccattggactctttggcatcaaaattttcactttatttcttattcttaagttatatggaggatttttgccatggttctcccaaattacttgccaggctaactctgtctaactttgaaaactaggggttggcaaagtagggcctgcagacagtccacatgtttttgtaagtaaagttttattggcgcatgcttatttgtttacataggtctatttctggatttgcactataattgcagagttgaatagttgtgagaaagatggtatggtgtacaaaactaaaattatttactatctaacctttacagaaaatttgccaaaccctggtcttgactattgaactaactggttaatgatatttgagattctgtgcagtatcatagagtcagtctgagatcttgacttcatgataatgttcttctaatttcatctttgctggggatcaccaagcaggtaaattgagcctcatataacgtatgttaagtacctactatgcaatagttactgtaggagagccagagatcacatcacctccagccctacttttagctcttagtgggctcttcagctggatctagaaactaaattgacaccaggcagattaacaagataaaaacagacacattttattagttttacatgtacaggggatcttcataagagagtgaagtctaaacaagtggccaaagcaagatgcttatacattttctgacaaagagcaataaatctgaaaagaaatggtaggactaagaagatctggatagggcagtaaaatttcctagaggagtcactagaagatatattacgggtgtaaaacaggtggaagatatgagttacttcattaggtatgtttattcatgtccatggcagccatcaattccaagtgtctggtaataaggacggttttctcaccctggtttagagagggtacaccttccagaggaatcttcttggctttcacggcttgctgaatgcaggaagagccaggtttctgaaactacaatttctccagtgttttcaattcgaaataatcactttacttatctggcatattttggagtggcactccttcagtaccatgatatatgctttcttttatgccattcattgctacatataataatcctgtgagattgatatttctgtctccatttaacagtaaggaaatttgagactttgagagaaaaaaatgatttccttaaggtcatacagctactgacatggctaggctaggacatgaacccagtccatgggcccagtattgggttctttattctatactagtgctttaaaaaattttatctcattattttattgtatgtatgtatttatgtaagaatttatgtatttggcagtgggcatcttattttacttaaaaaaagctaccaacgattctatccaatgtgtataaaacagattaaagcagaacttatttgattaaagtgctcctgtgatcatacacctcttctttgcaacacacacacacacgctctctctctctctcacacacacacacacacacactgtctttcacacacactctctctttctctctctctctcacacacacacacacactctctctctctctctctcacacacacacacacacacacacacacacacacacgctctctctccctctctcttctgccttaactgaaacatatggtggaccttttcaggacctataacaaaagatagaatgacatgaggtttggaccatcatcattcagtctttattttcctcatagcacaaacacctgattgctctattgcctcaattccaggaatttccaaggcattccatacaattgaaataagaaatcaaggattactctatttgtttgtgtgaggtgtggctgctttaatcacttccaagctccagattttcccatcaaatccaaggtagtctcaataccattgttttcacaaacttatttttagcttggcacttccatgtggatggagttttatatacaaatactaaaaaatatgtttataaagatatttagtgaaatcagaaatctttttagtgcaatgctgataaaagagctctgtatatactgcagtctcagctttccctgcatgatgtatttaagtggagaagtatgtgttagcttacttactcctagacaagtacaattggaggaacctgtgcttaaataccgttagtgatctctgggtggaggggttctgtgtgactgacactgtctgccttagaactttttgtattgtccattcttttgaaagcatgtagaaatgatttgccaaaaataagtatctgtgtatacttgtgacactttgtgatattgtttcaaaaatttgagacgaaatggctggcttgagagaacaggcatatcttcgtcccagaattccttctctctgagtctagaaatttcctttcatttttttttggtctgcctgaatttttctgtttctttatttgcagtgacattaaagagagagcacaaaaggcctttgaccttttatttagcgtgtttacagatgtatctctacttacagcttatcagtattgaatgaaaacttgactggaaacacacctctctgtgttttgaacaaaagaagaacagatgttaatccatgttacatgttttaaatgtcactgtcagtgtatacatttggatgtaaataaactgaatccatgtggtaacttcaaagtatgaatgagattatatttagggagacaaatggcttgagaattttaaaacttacaaatgagtccttatactcaggaaagaaaataggtgacatgctgtattacttttcactgaaagtttcctatatgataaagtttattaactgcacagataagtttttgaacatttatgttttggggaaaatgtagaatgaaaacttgcatgccattctggaaaaaaggttatgcattaatgccacttccaaattcaaaaagatcagtgtcacattatgtaaacatctttgtatcagttatattgcaagtgacagtacattttataaggtctaaggaagcttacataagaacaaatattttctcaatacaatcaaatgccactttgaataaggggcacagtagaggagatgcaatggatatgtgtaatgtgtgctaaatttgtgattgccttgggcactactaaagccacactgagtaatttcatttgacagccaaaaaagaggagttaaaggaatgtggcagtttcacctcctatgtctattcacaaactcccatggtgacctcattaatcttggggaggagaattactcaaagactggatgcataatgccaaaatgactgcttgtaaaagttagtatccagtccatctgccactggttttctttatgctggcgtttggcagttttataaaggagtgtgccaaggtgtgctgggtcacagtttggggaagagaatgctgaatgaacactggttggagcagcaacaaaggtttcccttgcatactgtgcctgccagccatgggagctcaggctcaagtcctcccacctctttattgctactggtttgtcaccattctgctggcgagaatggtagtgagcagcagggaggaagccacagggtttcccaccagagaaactggactgtcccggcatgatttgcatactttggcacaaacaccagaggatactgaccttgggccttgatgtcactacaccagacaattggttgaactgatatgctttacttgccttgactaacattgtgttttgccaattggccaattgtttagtggccaaggagactcactgactttagatttgaattcagtaaacattttttatgtgatttactttgtgccagacagtattctggtcactctggcactttttatctcatttaataatcataatattttagaaataagttgatatttttattttaaaattattaaaccaaggccctctatttcatgctgtggctctcctgaattcaaggagaaatatgttaacgttaaaaaaaataaaattgtatcacataatgtgacataaagatgagggcatcatcttttaatagatatatattattgttaaaaatgttaattaggtattgaaaattataacaaggacatttcaccagtgaagtggtgtaagggcagggaagttggggcaatgggaattggaatataatgagccacattaagcatacacatgtcaagtctagttctgaatcctgtggcaggccttacaagagagtccatgagtcagagaggtgcaaatagaaccaggaatttgcattgttgtggatgcaaaggaggaggaagtgttcaacattgtcagatgtagaagagaggtctagaatgataaagactgaaaatagccataggactttgcagatgggaggtcaatgctgaccttaccaagagccccttccatgaaattgaaagggcaacaaacagaaatgcagaatgagggatgagtaggaagggaaggaagagagaagattgttagtgaatagtccagtccttccaaaggttgtgctgggaagaagagtggtttctagagggaacacatctgtaaggaagaggtatttcttcaagtttaaggaaatggagcatctctagcataactactggagtctgaaagaaaagggagagaatggtttgagatataggaagggacttgaagaccaatgccacagaaggaacagaaagatgtggggcagggcacagagggaactgattgaccttcaactggatgagagaccccactgtcctcactcttgaatgcttatattgtgaggtggaaagttaaagaaaatcatagctgatggcttcaattgtcttgatgaagcagagaggccagcaaaatattgaaattggaaggaatggggattgatctaaggacttttgagcaagggagtaaagactgaacagggtcattgagcagaatagaaaatggactgaagaaaagtataaaagagtgtagctgaaaatccagcaaaggttggaatttgtaatgatgccaaacttccagatttgcatgtctttctcttgctgtgtaaatcagaaagggtggattgtaaaattagaccagggtttgggatttagggttttggcagaaggacagtggtgaaaagacactgaggggactggaggacaagtggtttttaatcatagccatcatatccaggcagggcaggaaagaaagtgaagataggaggcatttattaggctgggaggagatgcagagacctatggatggcaggactctttgagagtgatgacaggatggggtagaagaagcagtaaactatgccccaggatcatcctgaatgtggaagaattattaggaggcctagagaggtatatagttgagaaacaaacatttcaagagaccagaggtctttagattaatgatccgggaataatgatcataatgttgggtaggaaacaacagggccagatcaccaatactctgatcctgcaatggcaggagtagatgaaagactaagcagtcttcacttgaaatcccttcagggaaagcagtgtcatcagagaagagccaggttccattaaaggtttgagttggagaagcattctgtcaagtttaggaagtatatgaattaatctactatgatcttaaggatccagaacacacaacgagaatgtttatggacaagggcagcaatacaatcttgaggcagagagaagcagcacaatggggtgagaatgagactgtagatgacaaagggacttatattcagggcaaggaccaaggatgacaagtatgggatagaggaatattgagatttgctggcctcatgttggtgcataaggccaatgggaagccctatggagcttccttgcaattctatgagttgtataaaagcgagtcatgggtgagagctcttggagtccagagctcgagtttgtataaggatcctaaatttacatagtactttatgtcagtttttcttaccaagctgggagcttgcttagatacagctttcaagttatttacattgcaacagactttttaaaaaaatggcttacaggggagacttttggtcaaaaatatgtttggggcactatgtgtggatttcattgattcctgctttccatgcacctgctagttgtctgtaggttcactgcccctgtgaacagaagacccagcccttctggaaaaaaaaattgttttaatggacctaagccaaaaatgctttaagcccggagaaacatttagtaattcttcagaaattttatagcactactgactggtgtggagcaggtagaagttgaaattttttcctgattatgaaagtaagatatatgcattgtaaaatatattaaaaatatagaaaaagataaaagaaaaaatcacattaaatctcaccagctgcagatatccactgttaacatttggatgcatattgttcaatattttgtgtctttgaatatgctttttagctaaaatgagatcatagcaacatattttatattttcttgattgtcttatgaacatgatgacgtcatcaataatcttctaccgcatgatattcagtatagtatttcatcgacttactgtatatacttaaccaatcttctcatgctgttcatctgggttattttcacctttgtagaattatgaatcaccctggtatgaactttcttaaagagaaattaatcttgcatacatttatgattacttaagatgcattcttagaaatgtaatgactggatcacagtgttttcttctctctctctctctcttcccttctctctctttgcttctttttctcttcctgctttcttgtctgcttttctttttttgctacaatttacacttgaaaccaattttatcctacaagctaagaatacattttagatttttaaatggctgaaaaattctaaagaagaatgatattctgtgatatgtgaaaattatataaaattatatgaaatttttatttcaggatccattaatacagtttgttgtacagccatgcccatttggttatatactatctatagctgctttcacactactatggaagagttgagtagttgcaacagagactatatgacccacaatgcctaaaatatctagtatttggttctttacaggaaatgattgatgagtcctgatttaaacctgaggagtttacaaagttattatagataatgtaaatcctttaacttgattccagaacaattttcttgtatgccatatactaatattgtgaatcagaaccccagtttccttgtctgtagtatgggtctaataatagtgataatttcaaatggtttttgtgaagggtgaatgaaatacatttcaagcatttgaatagtgcttggctcagaactgaaaagtaacatcactagaggacatgcagctgcttgcaaagtgtcccattggaagagtgtgctattcatttcaaaggaaggaagacagagcttgcttcttttggagaacctcatactgtatatgtttgacccacatctgccttttaaaatgattgcagaggctctttcatgtggctggggtgggaattggtctccctgataaagtagcaactttgggttgctatccttggtgggtacatcttagatgcttctggtggtcgaatgtggttgaatatatttcacttgctctacaaagtcactgtcagcagcacatggattgcaaatacacgtggaacaaacaatttcaccaaaggaaagataaaaactgggttggataaagaagatataaagaaagaaaaaagggacttgacggagtagagggaagccaacggaagaaaaaatattggatgtgattactgctttttaactttaaataaatgtaggaaaattatttttacaatgccctgtgtattgtgtgcctaaaaataatacagaaaacataggattttaagtgcattaatataaatgacttgagtaccccaatgctgctatgtaaccgaaggttggagttattgccccttttatgtaacttaagtcttttctgtgcttctttccatatacatcccttttttcttcctctctcatcttagaagaaaataatccctcttttcctacaaagactagtccattagtcctacttccccttcctcctcttgctcctgtcccatccttacctggcaaatctcccaccttgcttcatcaattatcctttccatctcacttactcctcaaccattccaagtgatactttctctagaaattttatcaaagaattctctctggtatttggagtaacacaaagaaagaatctaatatggataaaagagtctggtcactgacgtctcttaacataatcaattctcaatcatctagtccgatcgaatgtgaagtcgatgtggtggctatttatttaagtattcacttttaaagtatttaccatgcatactttgttcaaaatatttgaaaatccatcttcagcctataaattatttagattatattttcagtttctgaacacacaggctggtaggtctctttctctttcccttccttcctgtctttcataataatttattattggatcttgggattttggaaagagcttgtgttctttattaaagcaattctttggaattttggggagttcctttacaaccagtgtgtggtcagattttctaatgttctgcatgtgcttgaaagaaatgtgtattctctaattactgggtgcagggttctatatggtttaattagattaagcttgttaattatgtagttcaaatctatgattgtattaaattttgcatggttggtctggcagtttttgacaggtgtgtgttaaaactgctgctgcaattgtggatttattatttttccttataagtatgccattttgtgtcacttatttttagactgtagtgctactttattaatatttttacatttaatctttatataataaacctgtttattactggtaaaattgataaaagataaaaccttaaacaagtacttacctcttagaaatgttacaagatttaggggatggcagcccaaaatttacctccaaaagcatatctcttaattttgttaacttgtaaatgtaattaactgttcattgtgggaatttgaattattggcttcttttatttatacatacattttaattatttttggttgctggccttagtggagaacgtcttagatgcttctggcaattgaatgtggttgaatatatttcacttgtactaaaaaggaagtgaaatatattttacaatatatttcatcacccggtcataatcactgccaacatttcatcatacagccttccattcttccttctctacattttttttctggttgaggttattatccaattcaatattttatcttgatttgttttaactttcgttatagcttaaacattttctcatgtcattactaactcttttatacatcctacttctccacccctaacaaccaagagaattacagtgaaccttgggatgcaataaaatacacctaaaatagtgaatagtacagaactaaattgggaagaacagaaactaaagaatgtgacttgaccattaatcacattatttgcaccacagtttagaaacttgaattatcgagtgtctacaatggttgcagttcttggggaaagctttatagcaaaggtggaatttaagctgatcattgatctcttcgtcaatgctaagccaactccatttagcaaaggtactagggcaggtatgaaccaggccccataatacggagtgggtgatggaaagtagattagacagcagtaatgtagtaggaagacccgtcagctttactcttgagaggggcaggtatacaatttaccaagcagcatgggaccaaattctggaggacctagactgtcaaaaaagttgctgctctctgtgcaaaagagatgcttctagctgtgttgctgccacattgataagctggtagtttgagatgaggaaagaggaatttttatgtccccatgggttatgcagtctcaactacaaatttctgtctgtgaagaagggaaggacaaagcagaactgctttaagaaaggaaagcgaaaaacattaggctgattttgctggtgaatttgtaaccctaagttagcatagatcatcattttttgtccttcttataaaagtatgagaaagtataattatcctgatattaaataggaaggaaccagatctcaagggggttgagtaatttcatatgaccaacaccacaagctagatcttagggcagctagtttgacaggttttctattactttgtactgcttcttcagggctcaatgtgatactatttaatgatgataacagtggttgctagccttttttttttcacacctttgaggtctgtaaggtcttaatttttcctagcaaaattctgcaatactaaatatcagaaggaaaaaatttccagagaagtccagcattatagttactgtttattaagccctttttttttctagactggttcattgtgggattttatgcacacacacatagacatgaacactcacacacatatacacatcatatttatctaggtgtggatctcttcattgtttttgcctggaatttgagggactcattttatcaatatcctcagctttctcctcagctcagaaaagttatcctcagttatacttttaataattgtttttctgtcaccttcatcgaaatgcctgtgatggctaagtcagttcagcccttcatatctatagtcttttctctcttcttttccatgttttagtttttgacttttgtactctggagaccttcagaatgtgaggattttgttttattttctgtagtgttagtttggcttttacttaatgtgcctctcttgacctacctttccctccttttttcccatatttcaataaatggaaccttcatccacccaattgctcaagccaggagctctctgtgtctgaattcttacagacaaaaccatgccgtatcttttctaacatacatccaaagtatacgttgaatcatttcatttcacaaagcaaaatagtggctaaggtagggctggaacccaggttttctagaacaccctggtttatatcctggctccaccactttctacctgtgtatccatggggaaattacttgacttctctgagtgctcatttttaaaataagacatgaagatagctacatttcagagatacatttacaacattctatgacttcatttctatgaaatgtacagcttaggcaaatctatagagacagaaaatagatcagtggttgcctagtgataagagggtctaggagggaaatgtggggagcattgactgctaaagggtatggggtttctttttggggtagtgaaaatgttctaaaattgattgtggtgatagtttgacaattctgtgaagatactaaaaaccatttaattgttagctttaaagggtgagttatatggcatatgaactatatttcaattaagctgtttacaaagaaaaaaaaaaagagtaaaggagggaaatttcctgagatggccaacgatggagtcccttctgcctcaaaggcccagatgaaccttttcccatgttctagtttggccatccaggtttgtagcccaatgaaactctcataagtatgtggtcttggacctggacagagtctcctcagctgcatcacagtgaccattttaacaggcttgcctccctttagaaacacagcttggaaacctctatccctttgtggattttggaagctacatttggcagcttcctaaggtaagcacagagcaaaaataatttgccacctggggctttatggcagatggaacttagtcgcctcttaatatcctcagctgaagagttgagacatacctcgggcctcaattttttcaaaggtctgatccatttgtctttaatgcaagctgcactggcctgatagtcctggtaattccaatgctgaattacttgagacattttatagagttaagggcatatgttttaaggaatctgctttaatcgtcctcactgagaaatatcctccaatgtggattactcagtgcaggtttactggagacatttgatacaatctggaagatttaagagttgaagacatgccctgggtctccattttataagaggttccatgcatcagtcttcacaacaaaccattcttgcctttcaccttccactgagccaatccacattaaaaggaagctgaaagaaatgacacaacttgcactttgattttataagaagttggatctatttatccccattggaaccattctagaattactcccaacaacatagatttattctgaactttcaatgcaatctatataacagagttggggacataacttggacctaaattttgtaagaagttggatcttcccatctccacaaaaacaaccctggcctgtctctctcccatgctgaattactccagtttttcaataacttctggaatatataagagttgatgatacacctcaggctgcaattttgtaagaagttgctcctacttatctctattacaaagaatcctgaattaacaccgcccagagtgaaatcacttcatgcagatttactgcaggcattctctgtggtcaggcattttactggagacattctgtatgataagggaacctgaagagtgaatacgtccagttggtctgacagactaacctggtgccatcttttcccacttcaagaattcctttgaaggttcaactagataatatagttatagtacttggcacacagcagtctcttaaccaatgtttgttctcactgcctctgaacccatttctattgtctccattcatacaaccacatgggtatatttatcatgtgtatttacacacactcgtgtatgtattcatatctattacatatataggagtgtacatatacatttgtgtgtgtgtgtgtgtatatatatatatacatacatgtatatgtaatacatatatacacatctattcatcgccattggaaccatcctagaattactcccaacaacatagatttattctggactttcaatgcaatctatataacagagttggggacataacttgggcctaaattttgtaagaagtttgatccccccatctccacacaaaccatcctggcctggatgttttgatatatatgtatgcgtatatgcattacatatatgtgtgtgtgtatatatatatatacacacatgtatatgtgtatgtttgtatatacatatattctggagtaaaatgggtagttatttaagtcatttgaaggaatgctgaagctatttaccacagagatctgttttgagtattcggtgtgaaggaaggatatgaatattttagaaagacaaaaataaaatattactttgactgaaagagatcagtgcatttccatctttctttaaaaacacagaaaataaattaggaaatgagtctatttgtgtggtatgggggaaagcaactgtccctcaagtggcccatttgttcttggatctccatgcaaaaggcaaactggagaccagggaggctggagcaacctagataggacatcagtagggaggccatgtgattggccctgaggcacctcacagactgtcatctcaagtactgttgtggagccaaatgctgaagtgaataaaatatgttctagttatgcttgggagacctcccgagtccagctgccttactttcctcctccctttgctttattttgccaagattatgctagaaggaaaaggcgagaggagaggagagtgctgggacaactccatcactaaattatatatgttacacttttacttgcacttagaaaatcttggattgcctatcagccctgtgtttacttcagattgggagagaactaggaagagcgctagaagatttgatctttcactgactttgggaaaatttctttgatatcctgagcatcaacttcactatttgcaaaaatagcaatagagataatagtactttcccccctcttttcacatattgcttgttatcaacatataaagcgcaaacagatattattttgaactccttcctagtttcacataattcacatttaaatgagactaaaatgtttagctaaactcaaagaagaaaaaaattggcagaagtgaaatattttctacatattaaaatagcagagattaaaaaataatgacatgtattggtaagagtacaaggagatgggcagtttcatattcttctagtgaaggttgaaattttggtatatggtgagagataggcatctagtttcattcttttgcatatggatatccagttttccagcaccattgattgaagagactgtcctttccccaatgtatgtgtctgatactttggtcaaaaatgagttcgctgtagatgtgtggatttgtctttgggttctccattctgttctgctgatttatgtttctgtttttatgccagtaccatgctgttttgattactatagctctgtagtataatttaatgtaaggaaatgtgattcttctagttttgttatttttgcccaggatttatttggatattctgagtctgtagtggttccatatagattttaggattttttttctatttctgtgaataatatcatttgtattttgatagagattgcattgagtctgtagattgctttgggtaggatggacattttaacaatattgattcttctaatccatgtacatggaatatctttacattttttggtgtccacttcaatttcttgcattaatgttttatagttttcattatagagatcttttacttctttggttattcttagggttttttttgtagctattgtaaatgggattactttcttgaaattttttttctgattgtttgctgttggcatatagaaatgctactgatttttgtatgttgactttgtatcctgcaactttactgaatttatgtatcatttctaacaatttttttcatgaagtctttagtaggtttttccaaatgtaagattataccatctgaaaacaaggataatttgactccttccttttcaacttggatgccctttatttctttctctcgtctgattgctctagctaggacttccactactatgttgaataactggtgaaagtggacacccttatcatgtacctgatcgtgaaagaaaagctatcagttttttccccattcattacaatattagctatgtgttggtcatatatggtttttattatgttgagatatgttccttctatgtccagttttttgagggtttttgtcatgaagagatgatgaattttatcaaatcctttttctgcatcaattgaaatgatcatatgatttttgtctttcattctgttgatatgatgtatcacaataattgattttgtatgttcaaccatccttgcatgcctgagataaatcccagttggtcatgatgaatgatctttttaatatattgttgaatttggtttgctaatattttgttgaggatttttgcatcaatattcatcagcaatagtggcctatagttttcattttttgatgtatctttgtctggctttggtatcaggataataccagccttgtaaaatgagtttggaattattctgttattctctattttttagaatagtttgggtaggataggtgttagtttttgaaatctttggtagaattcaacagtgaattctaccaaattcacttttcaatatggcttaaatctctttacctgttatttgtctgtacaagttttggatctcttcatggtttaatcttaataggttgtatgtttctaggaattgattcatttattctagattttccaatttattggaatatagttgctcatagtagtaattaatgtggtaccatttgtaacatctcttttttcatctctgattttcattcagctattttcgcttttttccttggttaatctggctaaaggtttgtcagttttgtctgtcttttcaaaacaccaacttttagttttgtttatcttttgtattgtttccttcatttcagattcatttatttctgctcttgctgtttattatttcgtttattccactagttttgtgtttggtttgtgcttgcttttcaagttctttaagatgcatcattaggttattttaagttttttatttcttttttgatgtaggcacttatagctataaacttccctcttagtactgcttttgctgtatcccataagatttagcatattgtatttcaatttccatttgtttcaatacattttctaaattttttcttaattttttcattaacctactggtcattcaggagcatattgtttaatttctgtgtatttgcacagtttccacagttccttgtgctattgatttctagttgtattctgttgtgttcagagaagatgcttgatttaaaaaatattttttttatttcagtaggtctttggggaacaggtggtgtttggttacacgaataagttctttagttgtgatttctgagattttggtgcacccatcacccgagcagtgtacactgtacccaatgaatagtcttttatcccttgctacccccaccctttcccaagtccccaaagtccaatatgtcatttgtatacctttgcgtcctcatagcttagctcccacatatgagtgagaatacacagtgtttggttttccatttctgagttacttcacttagaataatagtctccaattccatcaaggttgctgtgaatgccaatatttcattcctttttatggctgaatagtatttcattttatatatatatatatatatatatatatatatatatatatatatatatatataaaattttctttatccattcattgattgatgagcatttgggctggtttcatatttttgcaattgcaaatcatgctgctgcaaacatgtgtgtgcaagtatctttttcatataatgacttcctttcctctgggtagatacctagtagtgggattgctggatcaaatggtagatctacttttagttctttaaggaattttcacactgttttccatagtggttgtactagtttacattccctccaacggtgtaattgtgttccctatttgccacattccagccaacatctattactttttgattttttgattatggccattcttgcaggagtgaggtgttattgcattttgattttgatttgcatttctttgatcatcagtgatgttcagcattttccatatgcttgttgaccatttgtatatcttcttttgagaactgtcttttcatgttcttagcccactttttgatgggattgtttgttttttccttgctgatttgagtttttgtacattctgaatagtagttgtttgttggatgtgtaaattgtgaagattttctcccactctgtgggttgtctgttaactctgctgattatttcttttgctgtgcagaagctttttagtttaattaagttccatctgtttatctttgtttttgttgcatttgcttttgcattcttggtcatgaaatctttgcctaagccaatgtctagaagagttttttcaatgttatattctaaaatctttatggcttcagtcttaaatttaagtttttgatccatcttgagttgatttttgtatagggtaggagatgaggatccagtttcatttgtctatatgtggcttgacaataatcccagcatcatttgttgaacagggtgtcctttccccactttatgtttttctttgctttgttgaaaatcagttggctgtaagtatttgggtttatttctgggttctcttttctgttcaattggtctagatgcctatttttataccagtgccatgctgttttggtgacgatggccttatagtatagtttgaagtcaggtaatctgatacctccagatttgttctatttgcttagtcttgctttggctatgtgggctctttttttggtcccatctgaattttaggattgtttattttctagttctgtgaagaatgacggtgatattttaatgggaattgcattaaatttgtagattgcttttggtggtatggtcatttaaacaatattgattctacccatttatgagaatgggatgtgtttctatttgtttgtgtcatctataatttatttcagcagtattttgtagtttttcttgtagaggtctttcacctccttggttaggtatattcctaagtattttattttatttttttcagctattgtgaaaggagttgagttcttgagttgattctcagcttggccactgttgctgtatagcagagctactgatttgtgtacattaattttgtatcctgaaactttgttgaatccatttaccagttctaggagctttttggatgagtctttaggattttctaggtatacgatcatatcatcagcaaacagcaatagtttgccttcctctttttacctctttggatgccctttatttctttctcttgtctgactgctctggcttggtcttccaatactatgttgaatagaagtggtgagaatgagcatctttttattgttccaattctcaggggaaaatgctttcaacttttgcccgttcggtataatgttggctgtgagtttgttttagatggcttttatttgttaaggtatgttgcttctatgccgattttgctgagggttttaatcataaacggatgctgggttttgtcaaatgctttttctgcatctattgaaataatcatgtgatttttgttttaaattctgtttatgtggtgtgtaacatctgttgacttacgtatgttaaactatccctgcatcccaagtatgaaacctacttgatcatggtggattgtctttttgatatgctgttgtattaggtttgctagtattttgttgaggatttttgcatctattttcatcagggatattggtctgtagttttcttcttcttctttttttttttttttttttgtttgtttgtttgttaggtccttccctggtttttggtattagggtgatactggcatcatagaatgatttagggaggatttcctctttctctgtcttgtgtaatagtgtcaataggattggtaccaattcttctttgaatgtctgatagaattcagctgtgagtccatctaatcctggacattattttgctgacaatttttaaattaccatttcaacctcactgcttgctattggtctgttcagagattctgtatcttcctggtttaatctaggagagttgtatatttccaggaatgtatccatctcctctaagttttatagtttatgtgcataaaggggttcacagtagtgttgaataatcttttgtatttccttggtatcagtggtaatatctcccgtttcttttgtaattgagtttatttggatcttctctcttctttacttggttaatctcactaattgtctatcaattttacttatattttccaagaaccagctttttgtttcattatcttttgtattttttttttgtttcaatttcatttagttctgctctgatcttcattatttcttttcttctgcggggtttgggtttggattgttcttgttgctccacttctgtgcggtgtgaccttagattgtctgtttgtgccctttcagactttttggtgaaggcatttaatgctatgaactttcctcttagcaccgcatttgctgtttcccagaggttttgagaggttgtgtcactattatatttcaattcaaagaattttttaatagccatcttgatttcattgttgacccaaccatcattcaggagcagattatttaatttccatgttatttgcatggttttgagggttccttttagatatgatttccaattttattccactgaggtctgagagaatacttgatataaatttggttttcttaaatttactgagatttgttttgtggcctatcatatggtccattttggagaacgtttcatgtccttatgaatggaatgtatattctacagttgttgggtagaatgtcctgcaagtatctgttgagtccatttgttataggctatagtttaagtccatcattcctttgttgactttttgtattgatgacctatctagtgctctcagtggattactgaagtcacccactattattgtgttgccatctatctcatttttaggtctagtagtaattgttttataaatttggaagctccagtgttaggcacatatatatttaggactgatattttcctcttgcactagtccttttatcattatataatgttcctctttatcttttaagattgctgttgctttaaagtttgtttagtctgatataagaataactactcctgctggttttggtgtgcatttacatggagtatctttttccactcctttaccttaagtttatgtgggtccttacgtgttaggtgagtctcctgaagacagcagaaacttggttggtaaattattatccattctgacattctgtgttttttaagtggagtatttaggcccattacattcaatgttagtattgagatatgaggtggtattctattcaacatgctatttgttgcctaaataccttgttttctttcattgtgttattgttatataggtcctgtgagatttatgctttaatgaggttctattttggggttttttgaggatttgtttcaagatttagacctccttttagcatttcttgtagtgctggcttggtagtggcaaattattttaacatttgtttgtctggaaaagagtgtatctatccttcatttatgaagcttagttttgctggatacaaaatttttggctgataattattttgtttaaggaagctaaaaataaggccccagtccctttgagcttgtagggtttctgctgagaaatctgcgttcatctgataagtttttcttcataggttagctgatgcttttgcctgatagctcttaagattctttcctttgtcttgactttagataacctgatgactgtgtgcctaggtgatgatctttttatgatgaatttcccaggtgttctttgagcttcttgtattttgatttctagatctctagcaaggtcagggaagttttccttgattattccttccaatatgttttccaaactgtgagatttctcttcttcctcaggaacaccaattattgttaggtttaccatagtcccaaacttcttggaggctttgttaattttttaaaattcttttttctttgtctttgatggatttggttctgcttgttcgattctattgctgagattttccagtgaatttgcatttctctaagtgtgtccttgattaccagaagttgtgattctgcttttagttattctatttcactgaagaattttcctttcattttctggatcatgtttttgattcctttaagctggacttcacctttctctggtgcctccttgattagcttaataattgaccttctgaattctttttctggcaattcagagatttttatcttggcttgggttcattgctggttagctggtatgatgttttgggggtgttaaagaaccttgttttgtcatattaccagaattgtttttctggttcattctcatttgtgtagactatgtcaggggaagatctgggattcaaaggctgctgttcacattcttttgtcccatggggtggtcccttgatatggtgttctcccccttcccctaggaatggggcttcctgagagctgaactgtagtgattgtttttgcctttctgggtctagccacccagtggagctaccaggctccgggttggtactggggagtgtctgcaaagagtcccgtgatgtgatctgtcttcaggtcttgcagctgtagataacagcacctgctccggtgaaggtagaggtagcagggaagtgaagtggactctgtgatggtccttggttgtttttgtttagtgtgctggttttgtgtttgttggcctccagccaggaggtgacgctttcaagagtgcatcagctgcagtcctataggaaggatgcaaacttgccctagggtcacctggttaaatattcaggtttctcaggtggtgggcagggccatagagctccagagagattatgatctttgtctttggtaccagggtgggtggagaaaaaccaccaggtgggggcagggataggcatatctgagctcagattctctttgggcagggcttcctgtggctgcctttgggaagggggtgtggttcccagtccattggagttatattccctgggtgattatagctgcatctgctcggtcatacagttcaccagagaagtgggggaaagacaggagtcacaggcctcatcccgctgccttgcagcctgcagtcctaaaggccagtctcactcccactatgcccccacaacagcactgagtctatttccagatagccagtgaccagcactgagaacttaccccagatcacaaacctccccattgagaaagcaagcagacacagtttttcggtgtttcacggagcctgcagtggtgatccagttccttcaaagggtctgtggattcctttggctttcctagtattttcctgcagttgttcttggagcaaaagttcacgatgtgagtctctacacactgctttgtcagtccaaggaggagctgcaagcttgtcctgtttcctatctgccaccttaatctctatagaccaccacaatgcttgatattatttcaattttttgaatgttttataactgttttgtgacctaacatatggtttatccttgagaaagatctaagtgatgaggaaaagaatgtgtgttctgtagctgttggatgaaatgttctgtaaatatctattaggcccatttggtctatagttcagattaagtccaatgtttgtttgttgattttctgtctggaatatttgtccagtgctgaatgtagggcattgaagcctcccagctattattgtattggggtctgtctccctttagctctgataatatttgctttatatatctgggtggtccagtgttctatatgtatatatttataattattgtatcctcttgccaaattgacctctttatcattatacagtgactttctttttgtctttttctagtttttgtcttgaaatccattttgtctcatataagcatagctactactgctctttttttggtttccattggcgtggaatatctttttctgtcctttcattttcagtctatgtgtatttctataggttaaatatgtttcttgtaagcaaaagatctttttttctgttttttaaaatccattcagccagtctatgtcttttaattggagagtttagttcatttacattcaatgttattattgataactaaggacttactcctggcatttggttatttgttttctggttgttttgtagtgtttgcttctttctttcctttttgtcttccttttagggaagatgattttctctagtaatatgacttaatttcttgctttttaattttcatggatttgtttcatgttttttgatttggggttaccatgcggcttgtcaatactgtctttaacccattatttttacttgataataaattaacactgtttgcataaacaaagaaacaagcaaaaagaaaagtaacaacaattctacacgtcaatttcatccccccactttttaactttttgatgttttgatttatattttattgtaatgtctatgtcttggaaagttgttatagttattatctttgattgattcatcatttaatttttctatttagtataaaattagtttacacaccacacttacagtgttatgatattttgtgtctctctgtatacttactattagtagtgagttttgtaccttcagttgatttcttattgctcattaacattcttttcttttttactgaagttctctctttagcatttcttgtgggacaggtctaatgttgatgaaaacccacagcttttgtttgtctgggaaagtttttatttctccttcatgtttgaaggatattttcaccagatatactactctggggtaaaggtttgttttcttcagcacttcaaatatgctatgcctctctctcctggcctgtatgtttttcactgaaaagtctgctgccagacgtattggagctccattttatgttgtttcttttctcatgctgcttttagggttctttctttatccttcacctttgggagtctgattattaaatgccttgagatagtcttctttgggttaaatctgctttgtgttctataacttttttgtagttggatattgacatctatctctaaatttgggaagttctctgtttttatccctttgaataaactttctactcctatttctttctctacttcctctttaaggccagtaactcttagctttgccctttagagactattttctacatcttataggtatgcttcattgtcttttattcttttatcttttgtctcctctgaccatgtattttcaaatagctgtcttcaagttcactaattttgtcttctgcttgatccattctgctattagactctgcatttttcactatgtcaactccatttttaaactttagaatttctggtttttttttgtttatttcaatatttttaatttatctgatagcattctgaattccttctctgtgttttcttgaatttctttgagttttctcaaagcagctattttgaattctctttctgaaagaaggtcacatatctctttcttcaggcttggcctctggtgccttattgagttcatttagtgaggtcatgtttttcaggatggtgttgatgcttgtggaaatccacctgtatctgatctgggtgttggaaagttagatatttactagtctttatagtctgggcttgtttgtatgcatcctccttgagaagcctttcctggtattcaaaaggacttaagtattaggatctaagccttgtctgcattaggaggcaccccaagccaagtaacactgtagttcttgccaacttctagaagtacaactgtgatgatcttggattatatccagaataattccttggattattaaacaaaaacttttgttctcttcccttatttcttccaaagaaatggagtctgtctgtctgttctgtaccacctggagctggggggggggggggggcagtgacacaagcaaccctgtggtcaacgccagtgggcttctcctgagttagacctaaagccagcacagccctggatcttgctgaaggcccactgtaaccactacctgtcttccatctatgtttgttcagggccctggggctctacaatcagcaggtgcttaagcctgccaggcttgcgtccttcccttcagggcagtgacctcccctaggccctggtcaggtccagaggtgctgtctgggatctagagcctggagtcaaaacactctagaagtctacctggtgttctgttgtactgcagctgagctggcactcaaactgtgagatgtggtccttcccacgctttcctccccattccacaggcagagaagcctcaccctgttgccaccactacaggcccacagagggtagccaatgtcccctaaagctcaagagctctttagttggtttgtggtgaattctgcctagtctgggactcacccttcatggtagtgggctcctctctggcccagggcacatccagaaatgtcattgaagagccaaggcctggaattgagtacctcaaaagcgctcttggtgttctgtccctttgtggctgagctggtgagacgtgacagcgtgctggcagtcctcagagccctcgcttgctctcggcacctcctctgcctgggctcccactttggcggcatttgaggagcccttcagcccaccactgcactgtgggagccgctttctgggctggccaaggctggagcccactccctcagcttgcagggaggtgtggagggagaggcgcgagcaggaaccagggctgcgtgcggcgcttgccggccagctggagttccgggtgggcgtgggcttggcgggccccgcactcagaacagccggccggccctgctggctccgggcaatgagggacttatcacccgggccagtggctgcggagggtgtactgggtcccccagcagtgccagcccaccggcgctgcgctcgatttctcaccgagccttagctgccttcctgcggggcagggctcgggacctgcagcccgccatgcctgagtctcccacccactccatgggctcctgtgctgcccaagcctccccgacgagcaccaccccctgctccacagcgcccagtcccatctaccacccaagggccaaggaatgcgagtgcacggcgcagtactggcaggcagctccacctgcagccccggtgcaggatccactcggtgaagccacctgggctcctgagtctggtggggacgtggagagtctttatgtctagctcagggattgtaaacacaccaatcagcaccctgtgtttagctcaaggtttgtgagtgcaccaatcgacattctgtatctagctgctctggtggggccttggagaacgtttatgtctagctcagggattgtaaatacaccaatcggcactctgtatctagctcaaggtttgtaaacacaccaatcagcaccctgtgtctagctcagggtttgtgaatgcaccaatcgacactctgtatctagctgctctggtgaggccttggagaacctgtgtgtggaaactctgtatctaactaatctgatggggacttggagaacctttttatctagctcagggattgtaaacacaccaatcagcgccctgttaaaacaggccactcagctctaccaatcagcaggatgtgggtggggccagataagagaataaaagcaggctgcccgagccagcattggcaacacgttcgggtccccttccacactgtagaggctttgttctttcgctctttgcaataaatcttactactgctcactctttgggtccacgctgcttttatgagctgtaacactcacggcgaagatctgcagcttcactcctgagcccagcgagaccacaagcccaccgggaggaacgaacaactccagacgcgctgccttaagagctgtaacactcaccgcgaaggtctgcagcttcactcctgagccagcgagaccacgaacccaccagaaggaagaaactgcgaacacatatgaacatcagaagggacagactccagacgcgccatcttaagagctgtaacactcaccgcgagggtccgcggcttcattcttgaagtcagtgagaccaagaacccaccaattccggacacactggtacctaaagtgcaagacaaagtcccttttgcttgtccctccacttttcccaaacagaaggagtctcttctcatagccagcacagctgggaatttgctgtatattacctgaagtcaataagtcttagagtctcacgcaaggcctatagtatacttcctgggtatcactactggttattcagggcccaagggctctttagtcagcacatggtaagtcctggcaggactgggtttttcacttcaaggcaatggatttccttctggcccagggtgtgtctagaaatgtcattcaggatctagggcctggaaatgagaactcacaactctgattggtgtcctattttactgtgactgagctggtatccgtgatgcaagacagagatgtctttactctcccctctcctctcttcaagtggaaggaagggatttattttggaactgcaagctgtacagcttggggttgggggacaagtggtacaagcatttccttagcttccccagctggagtctcagtagctcacatatccccctgagtctactggctcttagccaagtttagcactaggacttgccttgaatttgcagtccttgtggcccagactgcttttctatttttttgacggcaatattagatttattaaagttccatatttaaaaacgcaatacatctttaagcttttgtgttcatcttttttttaaaattatactttaagttctgggatatatgtgtacaacgtgcatgtttgtttacataggtatacatgtgacatgtgagtttgctacacccatcaacttgtcatttacattaggtatttctcctaatgctatccctccccaagccccctacccccaacaggccctggcatgtgatgttcccctccctgtgtccatgtgttctcattgctcatctcccacttatgagtgagaacatgtggtgtttggtcttctcttcttgtgttgctttgctgagaatgatggtttccagtttcatccatgtccctgcaaaggacatgaactcatcctttttttatggctgcatagtattccttggtgcatttgtgccacattttctttatccagtctatcattgatgggcatttgggttggttccaagactttgctattgtgaacagtgctgcaataaacatatgtgtgcatgtgtctttacagtagaatgatttataatcctttgggtatatactcagtaatggggttgctgggtcaaatgatatttctagttctagatccttgaggaattgccacactgtcttccacaatggttgaactaatttacactcccaccaacagtgtaaaagcattcctatttctccacatcctctccagcatctgttgtttcctgactttttgatgatcaccattctaactggtgtgagatggtatctcattgtggatttgatttgtattttccaatgaccagtgatgatgagaattttttcctaactttgttggctacataaatgtcttcttttgagaagagtctgttcatatccttcactcatttttttttcaaggggttgtttgtttttttcttgtaaatttgtttaagttctttgtagattctggatattagccctttgtcagatggacagattgcaaaaattttctcctattctgtaggttgccttttcagtccgatgatagtttcttttgctatgcaaaagctctttagtttaattagatcccacttgtcaattttggcttttcttgccattgtttttggtgttttagtcatgaagtctttgcacatccctaagtcctgaatggtattgcctaggttttcttctagggtttttatggtttttaggtcttacagttaagtctttaatccatctggtgttaatttttgtataaggtgtaaggaagggaaacagtttcagctttctgcatatggctagccagttttcccagcaccatttattaaacagggaaccctttccccattgcttgtttttatcagatttgtcaaagatcagatggttgtagatttgtgatgttatttctgagggctctgttctgttccattgatctatatctctgttttggtaccagtaccatgctgttttggttgctgtagccttgtagtatagtttgaagtcaggtagtgtgatgcctccagctttgttcttttggcttaggattgtcttggctatgtgggctctttttggttccatatgaaatttaaagttgtttttttccaattctgtgaagaaagtcattggtagcttgatggtgatggcattgaatctgtaaattaccttgggcagtatggccatttttacaatattgattcttcctatccatgagcatggaatgttgttccatttatttgtgccctcttatttccttgagcagtggtttgtagttctccttgaagaggtccttcacatcccttgtaagttggattcctaggtattttattctctttgtagcaattgtgcattggagttcactggtgattttgctctctgtttgtctgttattggtgtataggaatgcttgtgatttttgcacattgattttgtatcctgagactttgctgaagttgcttatcagattaaggatatttggggctgaaatgatgaggttatctaaatatacaatcataccatctgcaaacagaaacaatttgatttcctcttttcctgtttgaataccctttatctctttctcttgccttattgctctgaccagaacttacaatactatgttgaataggagtggtgacagagggcatccttgtcttgtgctggttttcaaaggaaatgcttccagtttttacccattccatatgatattggctgtgggtttgtcataaataggtcttattattttgagatacattccaaaaataactagtttattgagagtttttagcatgaagggctgttgaattttatagaaggccttttatgcatctattgagataatcatgtggtttttgttgttggttctgtttatgtgatagattatgtttattgatttgtgtatgttgaaccagccttgcatcccaggaatgaagcctacttgatcgtggtggataagctttttgatgtgctgctggattcagtttgccggtattttattgagaattttgcatcgatgttcatcgtggatattggcctacaattttctttttttgttgtgtctctgccaggttttgttatcaggatcatgctggcctcataaaatgagttagggaagattccctctttttctattgattggaatagtttcagaaggaatggtaccagctcctctttctacctctggtggaattcggttgtgaatgtgtctggtcctggactttttttggttggtaggctattaattactgcctcaatttcaaaacctattattggtctattcagagatttgacttcttcctgatttagtcttgggagggtgtatgtgtccaggaatttatccatttcttctagtttttctagtttatttgtgtagaggtgtttatattattatctgatggtagtttgtatttctgtgggattggtgatgatatcccctttatcattttttattgcgtctacttgattcttctctcttttcttctttatttgtatagctagtggtccatttattttgttgatcttttccaaaaaccagctcctggattcattgattttttgaagggtttttcgtgtctctatctccttcagttctgctctgatcttaggtatttattatctgctgctagcttttgaatgtgtttgctcttctttctctagttcttttaattgtgatgtgagagtatcaattttagatctttcctgctttttcttgtggacatttagtgctataaatttccctctacacattgctttaaatgtgtcccagagattctgatacattttgtctttgttctcattggtttcaaagaacatctttacttctgtcttcattttgttatttacccagtagtcattcaggagcaggttgttcagtttccatgtagttgtgcagtttttagtctgtttcttaatcctgagttctaatttgattgcactgtggtctgagaaacagtttgttgtgatgtctcttcttttacatttgctgaggaatgctttacttccaactatgtgatcaattttggaataagtgcaatgtggtgctgagaagaatgtatattctgttgatttggggtggagagttctgtagatttctattagatctgcttggtccagaactgagttcaagtcctggatatccttgttaattttctgtctcgttgatctgtctaatgttgacagtggggtgttaaagtctcccattattattgtgtgggagtctaagtctctttgtaggtctctaaggatttgccttatgaatctgggtgttcctgtattgggtgcatatatatttaggatagttagctcttcttattgcattgattcctttaccattaggtaatgcctttctttgtttcttttgacctttgttggcttaaagtctgttttatcagagaccagaattgcaacccctgcttttttttttttctttccatttgcttggtaaatcatcctccatgcctttattttgagcctatgtgtgtctttgcacgtgagatgagtctactgaatacagcacaccaactgatcttgactctttatccagtttgccttctgtgtcttttaattggggcattttaattgggacatttcaagttaatattgttatgtgtgaatttgatcctgtcattatgatgctaactggttatttttcctgttagttgatgcagtttcttcatagcgtcgatggtcctcacaatttggcatgtttttgcagtggctggtactggtcgttcctttccatatttagtgcttccttcaggagctcttgtaaggcaggcctggtggtgacaaaatctctcagcatttgcttgtctgtaaatgattttatttcttcttcacttatgaagcttagtttggctggatactaaattctgggttgaaaattcttttctttaagaatgttgaatattggccccccctcttctggcttgtagggtttctgcagagaggtctgctgttagtccaatgggcttccctttgtgggtaacccgacctttctctctggctgcccttaacattttttccttcatttcaactttggtgaaaatctgatggttatgtgtctttgggttgctcttctcgaggaatatctttgtggtattctctgtgtttcctgaatttgaatgttggcctgccttgctaggttggggaagttctcttggataatatcctgaagagtgttttccaatttggttccattctccttgtcactttcaggtataccaatcaaacatatatttggtcttttcacatagtcccatatttcctggaggctttgtttatttctttttactcttttttctctagtcttgtcttctcgctttatttcattcatttgatcttcaatcactgataccctttcttccacttgatcgattcgaccattgaaacttgtgtatggttctcgaagttctcgtgctgcgtttttcagcttcatcagttcttttatgttcttctctatactggttattctcattagcattttgtctaaccttttttcaagttcttagcttccttgcgttgggttagaagatgcttatttagctcagaggagtttgatattacccaccttctgaagcgtacttctctcagttcatcaaaatcattctccgtccagttttgttcccttgctggcgaagggttgtgatcctttgtaggagaagaggcggtcttgttttgggaattttcagcctttctgcgctggttcctccccatctttgtggtttcatctacctttggtgtttgatgttggtatcctacaagatggggttttggtgtggatgtcctttttgttgatttgatgctattcctttctgtttgttagttttccttctaacagtcaggctcctcagctgcaggtctattgcagtttgctggaggtccactcccaaccctgtttgcctgggtatcaccagcagaggctgcagaacagcaactattgctgcctgatacttcctctggaagttttgtcccagagaggcacccgccagatgccagccaaagctcttctgtattaggtttctgttggcccctactgggaggtgtatcccagtcaggctacatgtgggtcagggacccacttgaggaggcagtctgtctgttatcagagctcgaacgctgtgctgggagaaccactgctctcttcagagctgtcaggcagggatgtttaagtctgctgaagctgcgcccacagcggccccttcccccaggtgctctgtcccagggagatgggggttttatctataagtccctgactggggctgctgccttttgttcagagatgccctgaacatctagaggtagaatctagagaggcagtcggccttgctgagctgtggtgggctccacccagtttgaacttcccagcagctttgtttacactgtgagcataaaactgcctactcaagcctaagcaatggtggacgcccctccccccaccaagcttgagcaccccaggtcgatttcagactgctgcgctagcagcgaggatttcacaccaatggatcttggcttgctgggctccgtgggagtgggacatgccgagccaggcactggagggaatctcctggtctgctggttgcaaagaccgtgggaaaagcgcagtatctgggcaggagtgtaccgttcctcctggaagtctctcacggcttcccttgggtaggaaagggaaatcccccaactgcttgcacttcccgggtgaggtgatgccgtgccctgcatcggcttgccctctgtgggttgcgcccactgtccaaccagtcccagtgagatgagccaggttcctcaattggaaatgcagaaattacctgccttctgtgggtatctcactgggagcagcagaccagagctcttcctatttggccatcttgccagaccctctccagactgcttttcaagtttatttggggtacctgtacactttagcttaccctggtgaggcttgccagaactgatgttccaactgctgggatgggcgattcccctctaactaggggtggtttaaatactccctccaagtgtaaattagttcatccattgtggaaagcagtatggtgatttctcaaaaagctaaaagcagaactaccattcgacccagcaatcccattactgggtgcatatgcagaggaatataaagcattttaccataaagacacatgcacacagatgttcattgcagcactattcacaataccaaagacatggaattaacctacatgcccatcaatgacagattggataaagaaaatgtggtagatatacaccatggactactatgcagccataaaaaatgcgatcatgtcttttgtgggaacatggatggagctggaggctatcatacttagcaaactaaagcaggaacagaaaaccaaacactgtatgttctcatttgtttgtgggaactaaatggtaagaagatatgaatacaaagaacaaacaacagacactagttgggggagggctgttgggaagagagaaaggagcagaaaatataactattggatactgggtttagtacctgggtgatgaaataatacctacaacaaacccctgtgacacgtgtttacttatgtaacaaaccttcacgtgtactcctaaacgtaaaataaaaattaaaaaataaataaaaatcaaaattaaaaaataaataaaataagtactcaatccacaggtgggcatcagctgaaattatcccagttttactttctgctgagtcagggcagcaccgaggtcaatgcaatgtttcacaattgctgtactcttcctctcccaagtgcacagattctctctccatgccatgtgaccattgctaggggatgggggaggggtaatgctggcaatttaagactgtctttcctgccctcttcattgcctctttcagtgatacaatgttaacacgaggtactgtgagtgtttacctgactgaagatgcttttttttttttttttttggttacatagttgttgaattggtgtccttgagttggggtgggacaagcagtggagccttctgtttggccttgtagctacacccctctctgaatgcagttgttaaaaagaatattatgaaagaatatttattggcatagataaatgctctcaaaagtgtagatgcttgtttacatgcttttcaacacgtaacattgtttataagaataatattgggtgaagcaaaccataaaatatcaaatgatagaggattaattagtactataatacatactctgattaaatataaagcatggttaaaaatcatgaatttggggtgttttctaagcctgtatgaatattgatgcaaatgctaaatgaaaacacacactatatgttcagtataatttataatatctgtaacctatatgtataggaaaatataagggattatatcctgaaataataattagtcaacttttatagtaggggaattatttgtttaaaatgtatttatttttaaatttgaaattaagtctaccaagtaaaatgactatcaacaaaattatggactagatgtttgcccacaaaattcatattgaagccctaacccccaacatgatgatattcggaggtaaggcttttaagagacacttaggtatagatgagttcataaggttggggcacctgtgatgtgattagtgccctcataagaagaggaagagagaccagagcttcctctctctgttgtcagaggatacagcaagtaggtggttatctgcaaccaggaagggagccctcaccagaacctgactatgctggtaccttgagcttggactttcaggctccagactatgagaaataaatgtctctgttaagccactcagaatatggtgttttgttatagcagtctgatcagactaaaacaaaatgacaacagcaaaactggaggctttctatttcaaggatccagtagtctctagtactatacaggaggtaaaatatatatctctaatgaccagaaattgttccagtaattttaaaagcatagatcccaagaggaaaggttggatcaattagcatgataataaaattgatggaaagagtagttactacttggtgtctactaggtttttgacactgtaagaggcacttttacaccttaactcatttaatctttatgacaacacagtgtgtcacttaatttttattatgcttcatgggaaggtggggattatctcaatttcacagatatggaaagtacatctctaagagattaaggcacttaagatcatatagctatcatgtgcagaaagcagcgagaatttcgtttgtctggttcctatgtatctgttattttgatgatcactatgccaactgggtgtaatgagggaagagtttttagaagggatggtattcagctatgatagttaaccaatagctagagtttaggtttgagtactctgttgtcttagagatacgttttcattaagcattgatgatgaaagctgctttagttcttacactgttcactttggatgaaataggttggattgcaaaaagggacatttttaactttttattttgaaataattttagacttactgaaaaatggcaacatcagtacagattttctgcatacttagtttcccctcattttaacttcttctattcccatagtataattattgaaactaggagacactcattgatacaatactattaactgcactacagattttatttagatttcaccagttattccactaatgttcctttcctggtcaaggatctcatccagtatctcatgtttcaattagttgccattctccttagtctcttctagtctgtgacagttctgtcttttcttgtctttcatgaccttgacatttttgaggtatactggtaagatatttttcagtatgtttctcaatgtgagtttttctgaagtttcctcatggttaaattcagattaggaatttttggtggggataacacagaagtgtgtctttcccagtgcatgatatcaagaggtacataatttctctatgtctccttactggtgatgttaaccttgatcacttaggaaatgtggtgtcaccaggtcattccattataaggatgatacagttttccctttgtattaattagtattttattaggaaatactttgagattatgtaaataccatgaatacctgtttattcatcatatgttttgctcactaattttagcactcatcaacatttcttaactacaataatcacttttgtggtgtttgcccaatagcaatgttctatctatatcattcattctacatttattaatttgaattctactgtaaaaagatctgcccttcttctccatttatttatttattcaattatttatttttattagtatatactccaaggtatttattttattatatggattgggctctattattatcatcatttaattatccctatatctcatgctatataaaataatgaactccaaaaggaacagctaaataagtgtaaaaatgaaaccacagaaatgctagaagaaaatatgggtgatttcctcttaaggtttgttgtttaaggctttccaactacaacttttcaatttacatgaaattccatatgcaaaaataactaaatacataaaatattgataaattagactacatgaaactaaaacaattgcactataaaacacgataaacaaaattgaaagacaactgataaacaggaagaaaatgtttgcaccatatcacaaaagactaatatcccccaaatataaagaactcctaaatcgacagctaaatgactaaaaacctgatagaaaagggaaaaaaagacatgaacaggaaattcacccacacacttacacacaaacacacacacacacatgtatatatatgtgtatatgtaaagatgtcccataaatataggaaaaatgcctaagctcacttataattagagaaatgcacattaaaacaatagcaagatgctgttttcttcctatgaaactggtgaaaatttaaaaatatgacaacatattcttttggcaaggctgtggggaattactcctccttattgctgatgggaatgcaaaccagtgcaaaaggggactttttcaactatctagcacagatgttatacagatgaaacagaaatgtatttattttctggtgatatttgggagaaggctgcgttacgatgatgtttctggaggtcactggtaatgtaagttatattacataagattatacaactgacatttatagctacttgaaatactttcccaaactttcccttattgattgtctttaaggaaatatagtcatgttcagggagtgtcaaaatgccagccatctccattgttactgaaactatttctgcttccctcctactctccacctgattcagagatctgacttactttctacaagaaaatagagctatagagtcatataactcagagctgaaaagacctttagagatgatctagcccatgcctgaatgatttagaggagtaaatgaggcccagagaggggcaatgacttgtccagggtcacacactgagccaagactggaagaaaagggtcctgaccagaatgctccatatctcttgcaagatatgtgtaaattaccagacacacagtaggcatgcaatatatgagagcaataacaaccatttatttcaaagggtgcaagggttcccaatttcattccatgagaggaatttgtgttttaagtatcaaattgaggaaagcatacactctatttctgtaatcattaataatatttctcccagggttctcaagtagcaggcatccattagcacttaacagctataacatcatgagaaggcatcaacggagtagtgactactaaatttcagtccagctctattatcttttcctcttgatagtttgacttcgagctttagtaactgtgggcctgcactgggcctggagcctccatttcaaaggaggcttgtggttgcacagtgcacaaggatgcataccgagggaggtaatgggagctagaatccagcgtatgatctgctaactaaacctggagcccttgcttgggactgtcttttcccaaggaagggggactttgttctcccaaaggctgtctacatgtgcctacagagttgtgtctaccttgaggggagagcttattaattcacacagaggtgctgtataaggtaatggaggctgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactgtgagtcctattaaacctctttcttttgtaagttgcccagtctcgggtatgtctttatcaacagcatgaaaatggactaatacaggggctctggttagaattaaaaaccaagtctgtctaaatataaagcctgtgtttctccatctttactcagaaagctatgtttttatttattatttttattttttaataatttaatttttatgggtacataggtgtaagggctgtatttttaaatcttaacccaggaagctagaagattttatagaatatctgctccaaatcttaccctttatagactataattttggccccttatgattaagtgccctgcacataatcccacagtacatataccttgctctgaaggtatcattcagtgtatttctggaaaaaaaggaagtctttaatttttcaaatattaggaagtctctaggccttgagacatactgttcaggcaggattcttttaagatgccaaaaacatactttcagcattcctttgtttttataaagcctttaaaaatatctgcctggaaatttatactaagtcttcacttaattcaaggcagtggatattatagcttatttggggactccaaacttgaattttggggttttaatgtgacacaatagtgtgaacacggtttgggtatggatgaatcttggttatttcctggtgctttttcgaagtagttttataactctgggctggccatttaactccacaaagatgtattacctatttttttttttcagttaatagtaaattatgattgtttttccatgtcattatcgtgttatataattatttttatgtctgcatagtatcattgtgtggctcaactatcaaaagtaatcaatctcctattatggttagatgtctgtgctatttcccataactgtgataatttctcttatagctttatctctgcaaggcctctaattctgagtgttatttttcagatgaaatctgcctactctagatatctatgacaataccaagaaatttatttagctcgggaatttctaaatatggaaaaattagtaacaatagttactgtttattgagtatctaccaggcgctggatcccttctaaatgaatattttgggttaggaaatgtttcaagatgggcctcaccagctgttcacttcaactgtagggaaatccagtaggaagtgtggttgtgatcgccatagcctcctggtattctggccagtacaactcagcagtaacataaaatcccaggataccaaatcagtttcaaaatggagttcttcttctagggagggtagttttcattttgatccagtttgtaaagagtcctttctggtagttaaatgcacatgccgtttctctcttagtttcttcttttcattgttcctggttgcagatattaaaaacatatcattagcataagagaagaaacgtatttcccaactcactgtggcatatattttactcatctataagtggtagccgacagccaaggatacattttaagagtataaaaaccttagccctcatccttctaaaatgaatacttagtcattcttaatttctgttctcagcaatcttcaggatatttgtatatatttcctagtgttgagaaaatgaagtataaaaatttattaagagatgagccacaataaggaagatgccagcaagcatgctcagaatggtgcaatggtgtgcatttgtctcttccactctacttaaacctcaaaactctatgctagtttcagctcctgctttctttgattgtattttaaaatgaggcagctaggtagattgactgtcccattcacctaagtagtaaatgatgtttgtgtgttccagagctagaggaagtttgggctttctgtgtgatgcacatgttgcaatcatatatactaatgcctgcatactccctctgcatactaatggcagagaaaagctattttgaatgagaatatttacattcagaacctggagccttttagaaaaatagtaacaaattttgataaattttcaatctgtgggctttcctacatttttatagaacatgatttagagatcccagctgaggagcctatgataatagctcatcattatatagcatagattgcattcagttattcatttgttcattcaacaaatatttatgaaacacatggtatatgccttttcacctgtaataaaaattagaaatcggattttctgacttaagtgccaaatgcatttgctacagaaaataaggtgattagagagagatgttagcatatggctagttggagccagggagcagatgatattcacagcaggagtgagtatagagaaagaagaggaaggtgttaacaaaggagattttggaagaccaagatttaggcaaggagtgtagatgtaaaagagtccaccaaggaaactgtgaaagataatatagtgagttaggtggaaaatgattctgcttgttgttggaaactagggaacaggtgaaaaccagagagagcataactaagctgtacaaatcaaactattatttttatgtgtaacaataaaacaatgggctgtttttattattgtaatgataaaattcattcctatcctccaaggtattgtaggttacaaaggaagtcatatagattatgtttttgtcccctcatcaacattgagaatgaactcacaaatgaatagcgtgttttatatatgcttagtttatcatcaaaatgtacatgtattttatagccaaaagctgcataatagccgttaagaaaacaaatgttaacttcaccatgatccctaagaaatttccaatatgagttcaataattcactgattttccctgatatatctgactaacattatcatcagctaattttccagtgttaacattttttatacatcatttggatcagaactttatctactatctgagtcattaagaagtcattttggtcagtattaagattattcaacaaaatgaacatcagccaaagctttactttagctgaaaattatccaattttgaattttaaaatttaattaaatgaatttaagccatgaattccctctgtggaactgcacatctggagctacttgcaggatttgcaccttccattttgctgcttatgctggttgcagcagttctggcagagtattcagaataacccagaggcttattagtagagtaggaacagagtctaagagtgaatactataaggaaagggaaaggatggggcagagcaaacagtgacccagggagatcggaatacttaaaataattagatttctagaaaaactgaatgcttactctcacatctgccaacactgctgctacctttatggatgtgacacaacatttgtgctatacttcagagaaatcttagagacattttctgtctcttgccagtatctccagttcttcagtatgtagaggaactgaagtgtggctgggccatttaactccatacatgccttcagaatgattcatacatttacaaagctatgtcagtcttctttcttctgaaggtttttcaggttttgtttattttaaatatttgttgcacaagcaacattataacagtattaaatatttggtatgaagagatggtgaggtaatagatgattattaagaatgttctatttctgttaaatttctgtttccttcctatgactattttgatataatttttataatatcatgtgacaagataatctaataacacatttctatttttaaaatggattcaatgggaaaatcaggttgctttatagaaatttattctagagcaaatttatttagttggtatgtcagcctactctttaaaaaatgtttccagctggatgcagtgctgtgcccctgaactcccagctacctgtgaggctgaggcaaaaggattgcttgagcccaggagttcaaattcagcctaggcaacatagtaagaccccgtctttaaaacaatttttaaaatgttgccattttgtgggaaaatgtaccctccttcctcccatgttggggtaatacatgctgctgctgaagcccagtagagggcaagtgcatagtgtagtggaagaaattcaggctggggaagtgtgaggtaatggcacatagtttcaattcctggctctgctattcactcattgttcgatcttagacctggcttagtcctcagtgttctcatgagcaaaatgaaagaaattgtgatagatgagttcaaagtgctgctttagtcgtaattaccatgatcagacatggagatggagctgaactccattgctcttatagggcaaaaaattaaaaacaaacaatcctaccattggtacatttccaggcacatagacataggagctagtctatttgggtttgagttttatctctatcatttacaaactatgtgaccttagttggctttgttaacttccctatgccccagttcttcatctgtcaaatgagtgtaataataatgccaagttgtctggttgtaaaaataaaatgaagtaatgcatgtaaaaccgtcagattcaacagtcgattataaacagtgtgctgtttgctgtttttttcttcaagtagccaagttatatgatatttatatagaccacatatgccagcagtcttttcacctttcaaggcatcttgtagaaaaaaagtcacgtttaattttattaccagatggcttttatttatcaaaaatgatagtctctcctaataaaattattccaatgctaggcattctgctgagaaaataatatttttatttactatttacttattttctaacaacaatagtttgagtaataacccatttctttaagactaagtgataagacacttaggcaaattaggaaccacattcagtaatcactcatatttgttaggtaaccattgtcttggggtttgagaatagtccagtgtgaccttgtgcaaaacctggaagcactttcaggctcttccagcctgttggactactgatatatctcatcttctcaattgtactcacagaggttggtagggtatttagattaaggatcacttttatttttaatctctgtaataaacaagaatgattgaagaggtgttgtcacaggagactccatcctgtttaacaggaatattaggtaggcaggggcatggtggaaagccatagatagagacagctgacttgaatcctcttcccatctctgccactattcactgtcctctcctctctgtgtgtttctgtaaaactctgtgattctatgaaccttgttaacttagctggttaaaaacaaacagaaaccaaaaccaaaatccaggacatcagttcctttctgtaaatctgcgaaacatttagttgcttgtcacaacatattcagtgtgatctagacacagcctaaacttttccttccacataggcctaatggaggatgttgatgttttgtttccttacttcacagaggtgtcatgaggacaagcatgaaaaaagtagggatgcatcatttgagttcttcaggaggaagctactacctaagtaagagacattagtatgattaagtgtgatgtcattaatattcccccaaactgcctttatcctatttgtactgtaggtaatttttgtgactggggaacatccccagttgtattttcattttaatgagaaatgatgacagtgttgcctcattgctcttaaaaaatacaaaaattaaaacacacacacacacacacacacacacagaactgacataggacctcagtacatttttacctttaccttgctgctgctgcttttctcctccttctcctcctcctccttctcttcttcttgttctcctcctccttctcttcttcttcttctcctccttcttcttctccttcaccttctcctccttctccttcttcttcttctcctcctcctcctcctcctcttcctcatcctcctcctcctcctcctcctcctccttcttcttcttcttcttcttcttcttcttcttcttcttcttcttcttcttcttcttcttcttcttcctcttcttcttcctcttcttctccttctccttctccttcttctccttctccttcttctccttctcctctttctcctccttattcttcttctttcttcttcttcctttgtttgacagagtctcactctgccgcccaggctggaggctggagtgcagtggtgcaatctcggttcactacaacctccgcctcccgggttcaagcgattcttctgcctcaaactcctgagtactttgtactacaggcatgtgccaccatgcccggctaatttttgtatttttagtaaagatgaggttttgccatgttggccagactgatctcaaactcctgggctcaagtgatctgcccgccttggcctgccaaagtcctgtgattacaggtgtgagccactgtgcccaccctaccttgcttcttcttaaaaaacaaagcaaaacaaaaccataaacaaaatgctgaggtttcttctagcactggtctttattgctcactagtcaaagctcctcattttttgcaattttggtaagaatacttaccatgagacctttctttttaaacacattttaagtgcattctactgtattgataactataggcaaaatgtcgtataactataggcaaaatgttaaacagatctctagaacttaatcatctttcataactgaaactttataccagtcgaatgctgaacactatcccattgtacgtctacaccaagttttctgtattcattcatttatcaatgggcattttggttgtttccatatcttggctgttgtgaataatactataatgaacatgtgaatccaaatatcttttcaagatcctgattttaattcttttgtgtaaatactcaaaaatggtattgctagatcatatggtagttctatttttaattttctaaggaacctcaatactgatttccatagcagctgccccattttacgttcctaccaacagtgtatataggttccaatttctcagcattctcactaacacctggtagtttttgttttgttttgatagtagccatcctaacaggtatgggatgatctctcactgtggtcttgatttacatttccccagaaataaactcatatatatatatatatataagatcaacttatctttgataagggtgccaagaatacacaatggggaaagaatagcctcttctatgaatggtgctggaaatactggatagccacatgcaaaagaataaaattagaccccgtctcccaccacttgcaaaaatcaactacaaaaagagtcttaaatgtaaaatatgaaactgtaaaactcccagaagataacatggggaaaatgcctcttgacattgatcttggcaatgatttcttagatattacactaaaagtacaggctacaaaagcagaaataaacaagtgggattgcatcgaagtaaaaagcatctgtacagcaaaggaaataatagagtgaaaaggcaacgtacagaatgagagaaaatatttgcaaactatatatctgatacgaggttaatatccaaaatatgtagagaactcctacaactgaatagcaaaaaacaaatattgccatttaaaaattggtaaattgcttaaatagacatttctccaaagaaaaagacatacgaatggccaacaggcatatgaaaagatgttcaccatcactaatcaacagggaaaggcaaatcaaatcccattttagagatggagaaattgagggtcaaagaagaatgttatttgcccaaagactctaaactatctggtggcagagcctggatgagaaccttggccttctgattccttgggcgtacttttcccactccagtttgtgctgatgactgctctgccactaaatcatgtgtattaaagtttctcttctaccagtctgtgagggcatggattctatcatatttagctgaaatgattatttcttcagcctttcttgtgcaacttcctctatgaatccctgagtctgcatgcagaaatgcgttactgaaatgcagaagccgttttcccccactagtaataatctgttcctcattcaaatacacaccttctgagctggggttttgtcctcttttgttttctttaacatagatgtgtcctgactatgtggagggactggaaaaggaaaataacgtttcacaggagaagggctgagaatattgttaaagcacagacaatggtggagcttgaaatcagagaaaaaaaatacagtataatggctccctgtcccttgtagcattccatctttcagctctcaccatattccaagcacaactacgtcccttaacaaaatcatatccctgaatcctgatgatacccaacaactcagataaatttcccagacctgttcccaacctctctctggtcacacctgcattcctgaccttaacgaccttctcccaaccttgattatatccttcaaccataaaaagccacttgagctgaggccattctaccacattaatcatgtcctccgctgttagttatacttctatcctcatgctcgctaaagtggccacacagcaatagtatttaacacaccctttctgactcttcttccaagccttgtcaaactgcttggctctgatcagatgtccagtgtgatccttgattctgaacaccaactggtgactgattctgggagccagattaaggcaggcggtaagagcaaaggaattggatgaaccaagagatatgtgggagagagagagaaataagatgtgagaaaaagggtaaggggactgagtatgagaagggcttcatggcatggccaccaagtctagaattaaatgtcttttgcttgtgggtgggtattgagaatgagtttaataaggtaggctggttcccaatttttacctctctgtgaactgtggtccaaatgggctgggctgttggactgtatcacctgagcctgatggagcaggctgattgagcattttctggaacgctgtgtgggtgaatgatgatgtacagaatatgtcctatccatcctcatttcttcccattcactcctagcatgttggtatatacctgacatatcatggttgctcaaaataggatcatttcttcagaataattcttgcattccttagtatggcatatagagccctgattctcaactgcctcatttctcatcaggataaccctcctcccttgtgttcgcatgtgtgtgtgtgtgtgtgtgtgtgtgtgtgtgtgtgtgtaagcacacaattttgttccagctgtgtttatccaacggggccaagttctttcacatcctgttgccattgtacctgttgtttctctacctagagtacccttttcctctattttttgctcagtcttccagtcttatcacaagcactactttgtccaaaaagcttttcttattggccctagaatctcctcagatgtcccttttctgtgttctcatagcattccactcttaaggcatcattgccataagaatgaaataaacaaaacttgacagttttgtttctgatttcatcccatattgaaccatgagcttgtagagggcagggactgcatcttatttgtatttttctactcctagtgcttaacccaaggccttgtacatattaggatttcaatgtatgtttcctaatatgtgaatggaaaccttcctcctatttatcttctctgttctatttgacttttttgttcactttcatttttttgtctgtaaactgaatacatacattaagaagtcaccaaaatgaatgggcatctacaagcaaaccctattcattcttatcatccagaaaacaacctgtatttctcctaaacacaaatttcttctatgctttccttgccattaatgcaaaaaaaaaaaaaaaaaaaaaaccacacttctggaagcatccatagtgatgacgatcattactattctctgtattctctgaagattattagaatttatcaagcagctgtttcatgggaagagtgttagcaattgtattgcattttgtagctaattgcaggaacaaagtgtcaactaatgcaaaatttggtttttaaaagaaaacattctctccctaatcaagtcctcatggtaaagacaacatgaaattattattgatcatcactcatgagccaggagagagatgaagtagtatattctttttgatttctacttaagaatttgaaaggtaggatgctacatgtttcaaggagatttgcagaatccagtaatacaaattctgaagactgaaaatcaggtaaggtttggctcggggattaaaaggaatgggtaaaaagtgcttctgaacattagagaagcccagactgatagagatggacagacttttcagaatatctattttggtgatcctcaatttctctttttgcttatatcccctctaaaaggaaaaaaaacattttgaaaaactacataactgttcatacatctttatattgagatatatgtatatacattttaatcatgagtttaaatggttatgaaggaaataactttcagcatattgcatattgattatacattttaagtacatttttatcacagccttggcattactcaattaactcattcagtttatgggaaatgtctgccatgtaacctcaatagtgaaaccagtcctcattgtcaaaccagcctgccaactcagactggctttctgtttgaaagagtctgatttcattatattcccctgtgacaagcatctcgctactgaattctaacataaagataggtagctaaggtacagagccttgccatggtttgtcacttggatgagataaaggcactgcctcatcaatatttcttacccaaacactctgctttgctctccagggactctttttcaggagtctctgtgtccttgaatcccttctttgttgtttggtaccccagaggatcttgccctctggtacaatgctccatactaaaattcaggatgagaagtatgtctgtctctcttttgtcaaatgggaaaaaggtcattgtggaaattgaaatggaaaaaaaaaggaatatacaaatggtaggaagatataccaggctactcactctttggaaagtcagataaccaaatttgcctgcacattgtttacatgtaccctaaaacttaaagtataataataatataaaaaaaaaaagaaaatctctgatcttatctactcctcccttattttgttgttgggccaactgatacctcgaaaaaagaatggactaatcccaggtaccaatgcttgttaaccagtggcaaagccagtactggaatataggtattttcatttcccaactaatgtgcttcctgcctcatggtgtctccttaatctgtcctatattcaaacgattgtaatttctttatccagtcacagtggggtttttctcatagaagaggtctgacctttacatttctttacagggaggtgtgtgtacatagagaatgccaagatggtagttgtttgtttgtatgttctcttacattacttgcagttgaagcaggtaaggtgactacttaacaagtcttcattcaaaaacctgtaatttgagaagcttgctccatattagtggaaaatgcacttttcatcatggggcctaaatctcttgatgcttatcattttttttggaatagtttactatttacttaattttgctatttttgtagatttagttgtaaggtctcaaagtacataactctgttttttactccattatctcaaaatcctgtaaaacattcagtaatttggtcaaactgcctcagttcagatattgatctgccacctgctagcagtatgactttggaggcagtgttaacctcttgttacttcagtttccccctctgtaaaatgagttgtgatgattgaatatattatataaatctaatgctttgaagtacctggtacaaacataataagtcttcagtaaatgttaactattgttatcatcattgttgattgaaaccatcaagtaatctaacattaagaacaccaggggccgggcgcggtggctcgcgcctgtaatcccagcactttgggaggccgcggcgggcggatcacgaggtcaggagatcgagaccatcttggctaacacggtgaaaccccgtctctactaaaaatacaaaaaattagccaggcgtggtggagggcgcctgtgatcccagctactcgggaggctgaggcaggagaatggcgtgaacccgggaggtggagcttgcagtgagccgagatcgcgccactgcactccagcctgggcgacagagcgagactccatctcaaaaaaaaaaaaaaccagggcagctagcccatagagattaaacaggttggaaagtagattaaatttacacagaggcaagttatgaggcagagagaacagacctgcagaaggaagtggcctggcagtgttatggacggtccatcaagtcatgtctgaaataatggtttagaacaatgctgtccactggagctttctacaatgatagaaatgttctacatccacactttctgctatgatagctgctatttgatatgatagccagttgtcacatatggctcttgagcacttgaaatccggctaatctgaataaaaaatggagtttttcatcgtatttgatattaattaatgtacagttaaatttatatgacgacatatagttagtggctaacattttggccagcacagatccaagacttcagctttgcttttgtcaattaccttaaatctttgaatagtaaaccagcttaaataattcatgagaacagtgacggtaagactgtctcttccagctctgtccatctctttgttactccttcatctctttttctctagctctgctcccatttctcacacttcatctgtggtatcctccttcattactccatgtttctttaaagccaggctcctcagccaaatatattttgatacctgtgcatgtataggtatgttcttaccaattaaggtcagatattcatgagcaagtatatgaagacacttatggtgcaaaggccaatttcttaggaatggaatgtgattgtgaggaagttgcaagctgtggcaaaaagaaaccttttcccacattattttcatgtgaggaattactgtccatcaagttagtattgattccactcacctattaagtagtagatcataggcaagatcatttaagattttgtagactgatggcaaaagctcccactatttaccagagctatataaagatgacatttcaatgccttcctcatgttataacacactatattttgaaagcttaaatagtcctttaagggaaagagaaacacttaatatacgtcaagaaaacgaattgcatttaatgtgaagaagtaccggccagaccacatgaagtgagcatcactcatgttgctatccaggcactgctttgggccagtgttcatcatgtgaacaaagtttctggaccttccaaaactacccttctctacattcctaatattcagattcaaagagttcattgttagtattttgattatcttaaatgtgcactgagtcatagttaatatcttaaatgacttgaacatttgctattctaacagaggctagtttatagagcactgtaaaacctctttttatttatggaatgcatccatattaaaattataacttcagcagctttctgtggagaaaatggtgactctgaccttttattccatctgaccactgagaaaaggactataatttcaacaatcaaatctcaaatgtgttattgtgcctattttctttttgtaaaatgtcattccatctatcatgctaacagctcaccttaatccattttcaatgggcttttttgcagaaaatttgcacaaatattttaaaatttctctatttcaatagcttttggggtacaaatggtttttggttacatgggtgaattttatagtggtgaagtctgaaactttagtgcccccatcacctgagtagtgtacattgtacccaatatatcattttttatctcttgtcccccttttaccatcccccttctgagtctttatagctcattatattgctctgtatgcctttgtatgctcataacttagttttaacttataagcaagaacatatggtatttggttttccattcctgagttacttcacttagaataatggcctccagctccatccaagttgctgccaaagacattattctgttccttttttatggctgagtagtattccatggtgtatatatactacattttctttatccactcattggttgatggacacgtaggtttgttgtatgtctttgcaattcacaatttttaaaaaatattctttaaaatagagctgttgaaagctctcacatgtttccagcgtaaacgtatttattaacaatgatttatttgaaaggtcagaggaatgtgagccttgtttccggtggtcacaaggggccaggagcattcccgagtccagcgcataacaaaagtaatgcagtgtcagaagaccagactgaaaacagcagttgtcaatgaatggacactaatgcaattcagatttttaatttgtttttctattaagagaaagtgagaagtgtccaatgaacagtggctcaaaatctaatacgcttggtcttaggcaactccctcaagctccatttcctatataggccaaactgccaccttcccagtatattcacattgctgccagcttaggcttcctaaaacacaacatagtgaccttgaactctgataatctcaaaccttccatattcatcaaagtccttcacaatttgctcttaccctcattctcaacattgcttttattttgttcccctgcagccccagtgaactgctctcagtcctgatgtcattccccacacttttttgccatcttttgctcacaccattcttcctccaaggccctttctttcctctggatctgtgacaaaagaactacccattcttctaattgaagttcaaatcctatctactccaaggaaccttcttagagcccccagtaatactgaaggcctttcttcttcttttttttttttattatactttaagttctagggtacatgtgcacaacgtgcaggtttgttacatatgtatacatgttccaaatgtccatcaatgatagactggattaaggcctttcttctttacagttctctggttctctaacactctggtgtagtagaagagctgggaatcagaaatcctgagtttggattccagttctgccattttctatgtacatgatcttggacaagatagtcaacctcactttctgagcctgtgccatcaactggaaaatggagataataatgcctttcctgcacatgtcacaggcttgctgtgaaactcaaaggagataatgcatgtgaaagctttctatatacagtgaagtgccatgcacatggggagtattattgctttcattattgtttttccattgaaaaatcagccaaggctgcttgaagcaatttgcttgaatggcacagaaggatgaagtttgtcagtcagtccctgagcacaaccatcaaagtgtcccagaaacttcagtatttcagcctccaaactttactctccagactgcctctggcaccacaaaagaaattgaaatcctcagtctcactatgtgttctgatttagggtttaaaaattagggtgcctgtaattacagcacttgattgcactagatatgagtttcatgaaaacaggtaccgcatatgattcatctctgtgtcttctccattgcttagcaccatgctgatgccaatccatagaatatgctaattctcacagtctcctttactgagctgtgatgaatgtaagtatctacggatgtaatatatgtaactgaaatcctagttgttagattacaaaacacgtattgtgcccatttgatatgctgttagactttttctctttcctttcttttcctatggagttgaattctcctaactttctttaaatattcaagaatagaagacttagaaccagaaagaggagataatgattcagtgaaaaggctgttgaaaggtaacaatcaggtcacatagtagctacttggctgaactgtagagatgagtcttctgcagggtggcagtcttgcctgagcccttgtttccagggtcaggggatccttgtaggctgtattataaaatgaataaaatcacaccagccagagagctccactatatttcctgcttatatccttttaatcaactcctcatgtaccaagcacccaatagtgaagagtcacaggtaacccagttctgttaacattatagtttccttagtttcctttattttccccaaatttgctctgttccttattatccaattctgcattcacctgactcctggcctctgaccccttgtcttattttgttttctgctgctataacagaatgctgcagactgggtaatttataaacaatagcaatatatttattagagttttctgtgctgggaagtccaagggcatggttatgtcatttggtaagggcctttttggtgtatcacaacatggcagaggacattacatgttgagaggtcaagagtgcttcaactcagatctctcttcttcttataaagctaccagtcatatcatgggggctccaccctgatgaccttatctaatcctaattgcctcccaactatatactgcctacaagagactcaagttcgcctgtaagaacatgcgtagactgaaagtaaaggaaggagaaaagatattttttgcaaatagaaaacaaaatagaacatgagtagctaaactcatatgatacaagataaactttaagtcaaaaactgtgaaaagagaccaggaaggcaattatataatgataaaggggaatacagaaagaagatacaataattgcaaatatacatgcacccaacatcagagcatcaaactgtatcaagcaaaaattaatagacctaaaagggaagatagactgcaatataatagtaagggacttaaacacctcactttcagcgatggatagatcatctagacagaaaatcaacaaacaaacattagagttaaaccacattccagattaaatggacctaacagacatttacagaacattctatttaacagcaccagaatatacattcttaacagcacagggaacattctccaggataggtcatatattaggctgccaagcaagttttaaaaatattttaaaaaaccaaaatcatattaactatattttctgaccacaatggaatgaaattagaaatcaataacaggagaagctctggaaattgtacaaatacatagaaattaaacaacatattcctgaacaaccaatgagtcaatgaagaaatttaaatatttcttgagacaaatgaaaatggaaacacaacatacaaaagcctatggaatacagcaaaggcagctccaagagagaattttatagcaataaatgcttgcattaaaaagtagaaatatttgaagtaaacagcctaacattacacctcaaggagctagagaaacaaaagcaaactaaacccaaaatgagtagaagaaaagaaatactaaatatcaaagcaaaactaacaaaaaggtcctaaataaattataaagctcaacaaaattaagagctttttgaaaaactaaacaaaactgacaaggcttctacctagaaaaaaaaaataatgaagtaaattattcaggatctataagaaactcaactcaatagcaaaaataaaacttgatttaaaaagtggacaaaagatctaaatagactttctcaaaagaagacatacaagtggctagcaggcatttaaaaaaatgctcgatatcgctaatcatcacgtaaatgcaaatcaaaactacaatgaaatatcatctcacgcccattaaaatggctattatgaaaaagacaaaaaataaaaaatgatggtgagggcccggcacggtggctcacacctgtaatcccagcactttgggaggctgaggcaggtggattgcgaggtcaggagatcgagaccatcctggctaacatggtgaaaccccgtgtgtactaaaaatacgaaaaaattagccgggcatggtggccggcgcctgtagtcccagctactcggaaggctgaggcaggagaatggcgtgaacccgggaggcagagcttgtagtgagccgaggtcgcgccactgcactccagcctgggcgacaaagcaagactctgattcaaaaaaaaaaaaaaaaaattctggtgaagatgtgtagaaagggaaatccttataaactattggtcgtaatgtaaattagtataagtcaacagtatggaaacttctcaaaaaaaaaaaaatagaactaccatatgatccaacaatcccatgactaggtatatatccaaaggaattgaaataagcacgttgaagagatatctgcactcccatgttcattgcagcactattcacaatagacaagatatggaatccacttaaatgtccatcaatggatgaatagagaaaaatgtgatatacacacacacacacacacacacaatagaatactagtgagccataaaaagataaaattctgtcatttatgacatggatgaacctagaggacattatgttaagtgaaataagccaggcgcagaagggcaaatatgatgtgatctcacttacatgtggaatctaaaaaaattgatctcatagaagtagagagtacaacagtggttaccaagacttgggtaaccactactggggagaggttgatcgatgggtatgaagttacagttagaagtaataaaatgtttgtgttctattgcgcagcagagtgctcagtgaacaataatgtattgtatacttcaaaatagcggattttgagttcataccacaaagaaatcacctgtttgaggtgatgaacatactattgaccctgatttgacttttacacaatatatatgtatgtatcaaagcatcacactgtacccaatacacatgtacaattattatatgacaaataaaaagaaaatataccttaaaaataaaacaaaagtaaaaagaaatcccacacaatgaaaaaagtatatttgtttaccatatgtctgacaagggacttatgaaaaactattacaactcaattaaaaaagacaaccaaatttttaaattggagaatctgtagacagttttacataaatatgtgcaattattatttgtccgttaaaaacaaaataaaactgaaaaacaaaaaccctagcaattattagcacttactatgtacatgatactgagttaactgctttacatgtaacattatatttaattctaacagtattcctttgaggtagatactgttcccatttaacagaggaaactgagatctagaaaggatagttaacttgccaaaagccatacagctaataggtagaggagccaggaattcaatctatttttgactccaggcccctggcaataccctgtcctatttctcaccagggaacccttggtgttgtgggccactttggtcagtgctccccagatttgcatatattctttttcataacttagaaacactcaacttctgaagtttaggaaatacagttcatcatgaacccacttaatctttgttaactgcggagaccaggtttttgaattttactcttaactcaagttgccaatgagtttgctgaaagattaaaagactaagtgctaccgttgtgtggttatttgaattaagcatcgaagtgtaacatttatctataaattctcaactctagtgcctaaaatcattttatttcttgtcatattcgaaaataggatttggttgctgaaaaaagtatggagaataagtgggaatttaggagaatctgcaaggcttgttggaaactcaagcagacgaagaccagtttggaagtgatgtattaactcctaaatgcattttttgttagtcactagcaaatatcgtgggtccccctggtgctttgtgagaagataaatttctcctgtaggtgaattaggtataattggaaacaattggactagaagcatcctgacgcgctctgggtcaaaagcttttcagcaaggctgtttttaggagcgtctgaattgatactgtttctgtagcctaccaatctccaaacagagtgacatattgtttttcttctttctccccctcctatgtcattgtggagaacaatatggcagtgcagacatagcatagagtctgagaacaaagtgcatatcagtcccagctatgtcccttagtagctgcgtgactcactgtaaaataggtcttgatgcccgccctcctcttcctccgcttaattatttttaaaaatacttattgagtgccaaccatgtgccagacattgtgttaggcactgtagctgcaatggcgaataaaacagacatcattcatgcactcctgaaactaaaaatttaatagattatatctgccttctgatcagtaagcctaccatgaggaataaataggcgtggtggatgtaaagtgcccaaaacatatttactgtgttcacaaagtgtgaatttcctttccttttcttcattttggcattataacgttagctgtagatggcatgtacatgcagcatagcatccggggtgtgtacatgcacacacacagacacgcacactcaattctctatagcttcacttattttagtctaagattgttgccattttcatgcacagctattatggtaggtgagtcagccaatcaaaaacagatttgattgatttgctttgagctacttgcctgccaacaaacgacaatggctgtatggatatagtcattgagtcaggtggctttatggatttccattggtgttagacttttaaatttagtttcttgctgcctgttatacacgggaggcaatgacaagctctcaactctctaatttgctgtagtggtgtgctaattaaaacacattcctaatacattccgttttggattcagagccagtgttcttataaaactataacactagtaagaaaaatgcaccatactatcttatgagaaatttcataaatgtgacaccccacaaccttattttatttttcagacattatacaagctatattgcaattttatgtcctattcgattcttctccacaaactgctttgccctgtgtattccaaatttttgtaagtgataccaccagataaatccaaaacctagaaaccagcctagatgtttcattctctgtcacccatctctctagatatgtcctatcccaaagttcccttgagtttgctccataaatgtatccccatccccactgccactacctcagttcatgctccagttatctcaaggttacagcaataacttaacagaattccttacctccaatcaatccctctcctccatctttcctactacctatactacagaataagtcttctgacacacagttgactgtgtcacttttctgtttttcgagtttttcagtcactctccattgtctgtgcagaataaagcccaaactcctgtgcgtgacatacaaaggtcagcctaatttgcccctctccctccagtttcaactctcatcaactgtatttattttctagtaatccaaaatatgtatagctccagaataaggcatttactcattcagtggatatttatgtgccaggtacttgtttagatactgggtatattgctgtgagcaatacagacaaaaggccctttcttcatagactttacattctgtgagagaaacaaactaaatggatacattatttctacaacttttttgtctttacatatgccatttcctctgcctgaagtaattttctcactccccatttctctaaaaattgcctagtcctctttcagaaaatcagcttgcaagtatgacatctaagagagatttcagcctgctttcatcttttctctgtatcttttcagagtttcactatagcttctgctttgctgttgtttctcattatttgcatgtcagaaccctccctcgtggcattctctatttaacaggactatatcttttctactctgtcttcacagtacttggcactgttgtagcacttagtcaggaaacagaaaagatgtttgagtccatgaaagcctggaaggcagggaagaagaaaggaggaagacagaaaaaaggaaataaaaaggagagagggatggggagaagaagggagaaagtgagggagggagaaaagtcaatttagtttcatttctccttggtttggaaaaggtataactagttttgtattatgacccagtaggattgcatagtcaagaaagtgccactaaattttgcaacttatatttccttaaaagtatgggagaaatgaatatttccctttgcggtttggtttattaatcattatcctacaagttaatattaaactaacaaattaaatgaaatctccatcacacacaggtgaattaatctttgccttcatatcttcttgctatgtaataattgtcagaacttgcaagaggtatatttttatgttattttaatcatgttcctgaggggcatcaaggtgaaatagaaagagcagagttaggagatatgaagtcgagtttgggttctgcaacctagtagctggccgaattaggggaagcattttcactgtggggagctttagttttgtcgtctggaaaaggaaggaaccagaatgactgctcactgtactgtttccagtttgcctcttctcattttagtttcctgcttgcaggaaactttacaaacatactaattgagtgatgatcagttatagactgccttagtttccatttcatctcctccacaaggtacagccttgtattctcctgtggctataaataaatcccatcatagccttatattctgtttactgtattttgtcttgacctttaccaagggatagattctgaaggcattatgcagttggatcaaatggcttgtattcaaaattgtggcttgagtctctccacccagatgtcatggatgttgatttccctggtgtcttaatccaccctccccgcaggactttccatcttctttaggcctctttccctttatccactgcctttctttgctgtagcctccttgtccagttttactttacttccctaaggtttctgtaacattggaagacctgccacctgtgacttctgtgtcacaaaacattgttttttcttaatggctctcctttttagaagatgagaaatttacgtttaaattgtgtgcattgagcttagtgtgcaatgattttttgtaagccaagaaaatcaggaagaaccgcaaagggtaagggatggagtcttcaacaaatggtattcgttaattttctgcccattaagggacataatctaattaaattcttatcctacaacatagacaaagtgaattcctgctgtattaaagagttaaatataaaagaaaatgaaatagtaaatatcagaataatgtggaatatttaacaattttggggggcagggagcaattttggggggttgtattagtctgttctcaggctgctataaggacatacccaagactggataatttataaagaaaagaggtttaattgactcacagttccacgtgcctggggagacctcaggaaacttaaaatcatggtggaaggcacctcttcacagggcaacaggagagagaatgatgactgctgagcaaagggggaagccccttataaaaatgtcagatctcatgagaacttggctatcacaagagtagtatgggggaaaccaccccccatgattcagttatctccactttgtccctcccttgacagaagaagattattacaattcaaggtgagatttgggtgggagcacagagccaaaccatatcatttcacccctggccactcccagatctcatgtcctcacatttcaaaacacaatcatgcccttccaacagtcccccagagtcgtaatccattctagcattaaccaaaactccaagtccaaagtcttatctgagacaaggcaagtcctttctgcctatgagcctgtaaaatcaaaagcaagttacttacttccagttacaatgggcatacaggcattgggtaaatacaccccttccaaatgggagaaattggccaaaacaaagggcctacaggctccacacaagttcgaaatccagtggggcagtcaaatcttaaagctctgaaatgatctccttagtctctcatctcacatccaggttatgctgatacaagaggtgggctcctacatccttgggcagctctgtccctgtggctttgcagggtacagccccctgccctggctgctttcacagctggcattgagtgtctgtggcttttccacgtgcacagtacaagctgtctgtggatctaccattctggggtctgaaggacagtagccctcttctcacagctcccctaggcaataccccagtgggaactctgtgggggtggggggaggctccgaccccacatttcccttctgcactgccctagaagagattctccatgagtgggtctgcttctcccagtccactcactcaaatgttaatctcctttagcaacaccctcatggacacacccaggaacaatactttgcatcctttaatccaatgaagttgacactcagtattaacgatcacaggggcatttaaagccaaagcagaaatcacaaagaaaatgactgatagatttgatatatcaaaatgtaaaacaaaaataaaaaccaaagctttcattcatcaaaacatcaaaaataaaaacattttctttaccactccctttcatgggctatagatatcaaagggacttctggattttattcagggccagcatcatgggtgtttggcctgtgtagtcgcacaggccaccacacatggaaggatcctgtgattggttcaatgctctgttgtatccatcttgacattcataattttggaacaagggacatttcatttttttattttgtactgggccccacaaattgtgtagccagtcctgagtctcttgaatcattctggaacctccctgctcatagtgaaatttttaatgacaggcccatttgaatgatgcttggtgaaagaatgcaagaaaccacttgctcaataacattggacttaaatgagaatatagacgggcacctggatgttcattaccttgtcagtgtaccagataccctgatatccattcacttattccttcattaatttagcaaacatttttcaagtccatcctttgtgtcaagcactgtgctaagcattggggatacagtggtgcacaagatggattcagtcagtgctctaaaggaggcaaggttgtaggtgaatagatggcaataccacatgatagaaagtgtaggagcccagagcaggggcccctaacacagcctgagagatgagtaagggagttgacatctaaacgaactgaaggggtaaaggaagtggaggtgagaggcatatcctggggaggccatttaggccaaggaaacagcatgtcctccttttgttctttcatcattctttcatcagcagggcaaggatcttaacctgccctgggaattcatcaggttaagggtcaggtgtgtatggaacagctggctggcctcttctcgggaagtttatgcccattccaagctacctattgtacttgtctcctggaataggtggtgatgtagtttggatgtttgttccctccaaatctcatgttgaaatgtgatcctcagtgttggaggcgaggcctggtgggacatgtttgggccatgggagtggatctctcatgaatggctttgtggtaccccccagccccataaattagtgagttctcactctattagctacctgcaagagctggttgttgaaaggagcctggcacccctcccgtctctctggctccctctcttaccatgtgatacaccagcttcccttcaccttccaccatgagtggaaacttcctgcagtccttgccagaatcagatgctggcactacgcttcttgtacagctgcagaactgtgagccaaataaacctattttctttacaaattacccagctttgggtattcctttatagcagcacaagtcgactaagacagctggaattacatactgtttgatgtctgaaatgtcctatggaagaagaaaggataaatatccactgtgccccttatctctaagacacctgatcaccccctctggatattttaaaaatcctagatttcaaatagacttttactctaccaaaatttctgtgatccctggaagacctagccactatttttagcttgcaggacatagaaaaatagtggggggtcagatttgtaccataagccattgtttgctgatttctgatttagaattaagttgcctcaggccacagatcctttatttgcattggctttccctctgcttggaaaactctccctcaacctgtttctgttgtaggcctcttctctcagtgaatccttctttctctacagacttgcctaaactgatttttctgctgctgtatgtctctgtagtatccttgggactttcttatcaactcctacattgtttgcttaatgtttaagtctctttatacactgaagacttaatggaagaaaaatttacagttgcctattatttgaacagttcaagtcagtctcctagcccactgcctggctgagtgtagctgctcaacaagtatttgttaagtgtacatatgagtgcagtattactgtccccatttttcagatgatgaaactgaggcatagctagctgattgggaccacactaaaagctattagatagtagaatagaaataattttccagttaactacactgcttttttaaacattcaaataggatgcttagaaataggacaaagaagacaaattaaataggactttcagtaagcaaaacactaaccatgaagattatattttgctactcagtaggctgaggcggaagtacttcttgagcccaggaattcaagactagcctgggcaacatagtgagactgtctaaaaccgaaaaagattgtgtttggtttatgttctccttgctctcatggcatatgcaatataataggggaggtcagataactgcatagcaaataagtctgacagcccaagttagtaggtggcaagtaccaagaaggtttatgtggggcatgtgttgctgtggcaaggtggggtcaaagagaaagtcagaggcaagtcctaagccaagccaggggagtcacataggccacatcccttcaggattcacttctgtggacattggctagtcaatgcaaagcaaacagtaacctctagagcaggtgtgaagggacactcatgaactttttcccaggtgatatgttcctcaaactgctgcaactgcagaatgctgagagctgtccacctgtgggaatggtcagagggtcttgccaggagtggcgttctaacagatgctcaagaagttagataagggtttttctgactcatgagaaaagactctaggaacctgaaagagtttaattttcctaccagtgggtgatttgggacagtctcctaatccatcagcaagtgtttcttgaggtccttactatgtaccaagaaagtcaaatggggattctatttctgatggctgcacttttttttttcttttttgttttttattatactttaagttcttgggtacatgtgcacaacgtgcaggtttgttacgtatgtatacatgtgccatgttggtgtgctgcacccattaactcatcatttacactaggtatttctcctaatgctatccctccccgtcccacaaccccatcacaggccccggtgtgtgatgttccccaccctgtgtccaagtgttctcattgttcaattcccacctatgagtgaaaacatggcggtgtttggttttctgtccttgagatagtttgctcagaatgatggtttccagcttcatccatgtccctacaaatgacatgaactcatccgtttttatggctgcatagtattccttggtgtatatgtgccacattttcttaatccagtctatcattgttggacatttggcttggttccaagtctttgctattgtgaatagtgctgcagtaaacatatgtgtgcatgtgtctttatgatagcatgatttataatcctttggatatatacccagtaatgggatggctgggtcaaatggtgtttctagttctagatccttgaggaatcgccacactgattcccacaatggttgaaccagtttacagttccaccaacagtgtaaaagtgttcctatttctccacatcctctccagcacctgttgtttcctgactttttaatgatcaccattctaactggtgtaagctggtatctcactgtagttttgatttgcatttctctgaggaccagtgatgatgagcattttttcatgtgtctgttggctgcataaatgtcttcttttgagaagagtctgttcatatccttcgcccactttttgatggggttgtttgttttattcttgtaaatttgtttaagttctttgtagattctgcatattaaccctttttcaaatgggtagattgcaaacattttctcccattctgttggttgcctattcactctgatggtagtttcttttgctgtgcagaagctctttagtttaattagatcccatttgtcaattttggcttgtgttgccattgcttttggtgttttagacatgaagtccttgcccatgcctatgtcctgaatggtaatgcctaggttttcttctagggtttttatggtttttaggtctgacatttaagtctttaatccatcttgaattaatttttgtataaggtgtaaggaagggatccagtttcagctttctacctgtggctagccagttttcccagaaccatttattaaatagggaatcatttccccatttcttgtttttgtcaggtttttcaaggatcagatgtttgtagacgtgtggtattatttctgagggctctgttctgttccattggtctatatctctgttttggtaccagtaccatgctgttttgcttactgtagccttgtagtatatggcagggcatagctgaacaaaaggcggcagaaacttctgcagactttaacgtccctgtctgacagctttgaagagagcagtggttctccaagcacagagtttgagatcagagaagagacagactgcctcctcaagtgggtccttgacccccgagtagcctaactgagagacacctcccagtaggtgcccctcagagacaaagctaccagaggaaggatcgtgttctgcagtatttgctgttctgcagcctccgctggtgatacctaggcaaacagggtctggagtggacctccagcaaactccaacagacctacagctgagggtcctgactgttagaaggaaaactaacaaacagaaaggaatagcattaacatcaacaaaaagtacatccacaccaaaaccccatctgtaggtcaccatcatcaaagaccaaaggtagataaaaccacagagatggggagaaaccagagcagaaaagctgaaaattctaaaaaccgagcacctcttctcatccaaaggattgcagctcctcaccagcaatggaacagagctgcacggagaatgaccttgacgagttgacagaagtaggcttcagaagatcggtaataacaaacttctccgagctaaaggaggatgttcgaactcatcgccaggaagctaaaaaccttgaaaaaaggttagacaaatggctaactagaataaacagcatagagaagaccttaaatgacctgatggagttgaaaactatggcacgagaactatttgatgcatgcacaagcttcagtagctgattcgattaagtggaagaaagggtatcagtgattgaagatcaaatgaatgaaatgaagtgagaagagaagtttagagaaaaaagagtaaaacgaaacaaacaaagcctccaagaaatatgggactatcgaaaataccaaatctacgtttgattggtgtacctgaaagtgacggggagaatggaacgaagttggaaaacactcttcaggatattatccaagagaacttccccaacctagcaaggcaggccaacattcaaattcaggaaatacaaagatactcttcaagaagagcaaccccaagacacataactgtcagcttcaccaaggttgaaatgaaggaaaaaatgttaagggcagccagagagaaaggttgggttacccacaaagggaagcccatcagactaacagcgggtctctcagcagaaactctcaagacagaagagagtgggggccaatattcaacattcttaaagaaaagaattttcaacccagaatttcatatccagccaaactaagtttcataagtgatggagaaataaaatcctttacagacaagcaaatgctgagagattttgtcaccaccaggcctgccttacaagagctcctgaaggaagcactaaacatggaaaggaacaaccagtaccagccactgcaaaaacatgccgaattgtaaagaccattgaagctaggaagaaactgcatcaactaacgagcaaaataagcagctaacatcaaaatgacaggatcaaattcacacataacaatattaaccttaaatgtaaatgggctaaatgccccaattaaaagacacagactggcaaattggataaagaatcaagactcatcagtgtgctgtattcaggagacccatttcatgtgcagagacacacataggctcaaaataaaaggatggaggaagatctaccaagcaaatggaaaacaaaaaaaagcaggggttgcaattctagtctctgataaaacagactttaaaccaacaaagatcaaaagagacaaagaaggccattacataatagtaaagggatcaattcaacaagaagagctaactatcctaaatatatatgcacccaatataggagcacccagattcataaagcaagtccttagagacttacaaagagacttagactcccacacaataataatgggagactttaacaccccactgtcaacattagacacatcacagagacagaagattaacaagaatatccaggacgtgaactcagctctgcaccaaccagacctaatagacagctatagaactctccaccccaaatcaacagaatatacattgttctcagcaccacatcacatttattccaaaattgaccacatagttagaagtaaagcactcctcagcaaatgtaaaagaacacaaataataacaaactgtctctcagatcctagtgcaatcaaattagaactcagaattaagaaactcactcaaaaccgcacaactacgtggaatctgaacaacctgctcctgaatgactcctgggtacataacgaaatgaaggcagaaataaagatgtgcttcgaaccagtgagaacaaggacacaacatgccagaatctctgggacacatttaaaacagtgtgtagagggaaatttagagcactaaatgcccacaagagaaagcaggaaagatctaaaatcgacaccctaacatcacaattaaaagagctagagaagcaagagcaaacacatttaaaagctagcagaaggcaagaaattactaagatcagagcagaactgaaggagatagagacacaaaaatcctttcaaaaaatcagtgaatccaggagctgggtttttgaaaagatcaacaaaacggatagatcactagcaagactaataaagaggaaaagagagaagaatcaaatagtcgcaataaaaaatgataaaggggatatcaccaccgatcccacagaaatacaaactaccatcagagaatactataaacacctctacacaaataaactagaaaatctagaagaaatggataaattcctggacacatacaccctcccaagactaaaccaggaagaagttgaatccttgaatagaccaataacaggctctgaaattgaggcactaattaatagcctaccaactaaaaaaagtccaggaccagacggattcacagctgaattctaccagaggtacatggaggagctgataccattccttctgaaactattccaatcaatagaaaaagaaggaatcctccctaactctttttatgaggccagcataatcctgataccaaagcctggcagagacacaacaaagagaatttaaaccaatatccctgatgaacatcgatgcaaaaatcctcaataaaatcctggcaaactgaatccagcagcacatcaaaaagctcatccaccacaatcaagttggcttcatccctgggatgcaaggctggttcaacatacccaaatcaataaacgtagtccatcatataaacagaaccaaagacaaaaaccacatgattatctcaatcgatgcagaaaaggcctttgacaaaattcaacagcccttcctgctaaaaactctcaataaactaggtatcaatgggacgtatctcaaaataataagagctatttatgacaaacccacagccaatatcatactgaatgggcaaaaactggaagcattccctttgaaaactggcacaaggcagggaggccttctctcaccactcctattcaacatagtgttggaagttctggccagggcaatcaggcaggagaaagaaataaagcatattcagttaggaaaagaggaagtcaaattgtccctgtttgcagatgacatgattggatatttagaaaaccccatcgtctcagcacaaaatctccttaagctgataagcaacttcagcaaagtctcagaatacaaaatcaatgtgcaaacatcacaagcattcttatacacacacaagcattcttataacagacagagagccaaatcatgagtgaactcctattcacaattgcttcaaagagaataaaatacctaggaatcctatttacaagggatgtgaaggacctcttcaaggagaactacaaacccctgctcaatgaaataaaagaagacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactaaagttcgtatggaaccaaaaaagagcctgcattgccaagacaatcctaagccaaaagaacaaagctggaggcatcacgctacctggcttctgatgtctgaacttttaactcccatctgctttcttcatcttgatttgcacatatgtctgatttggagatgaaaagtaaatatattcctgtgtctcttcattcttcatccatcttttcacaaaatgcacccagcagctgtgccaagcttctctgaataccatgaaatcatttatatgttttgatactgtgtcatggatatattaattgtttcttctcactacaacatggtctaattagcttggacaatacttccagtctcctgtttgaagagactgtgtgtggcttttgatgatttctctaattctgatttgataggttagatgtgggctgatctttctctcgctcttttttccttttcctttcttctcttctttccccgtaggcatatactaatgtcctaacgtgtactgaatcttgattacagtgtaattgatttagagcatatggggacttttgaaatcccttttaggagggatcattgactcttgataatctgacgaaagctatgaacacttcttccagaaatgtgtacttttacatatataatttatcatccagttacaggagtctcaagggtttagccaagtcttggatgcatgtccatagtatgtgaagaccacagaatttcagtgcttggacaaccctacagatcatcgaattcactggtttttgaaaactattttaaccagagaatccctggttgaaaagggtgggtaaaaagaagggagagactgagtcatgcacacccctacgtcgctcagagtggttcctgaggaggttctgaggaacacagtttgaaagctcatgatctaggtctaattcctgtatttctttatatgagaaaattgatccaaaaagagcagagttgactaactcaaggccatgcatccagtcagtgcacagctgagactggaacccatgcccttgatccctaggacagagtctcagccaaccctcacttctcttctaattgtaaacctcctacattcataccacagtaacttctcaaagatcctggacaaatgtaatttaaacccacaattataaataatcacccccatttgagcaacaggcaaaggaaatacagctgatttgtgttttgtcactccgtcaaggccttccttctttctgtcttatttctgctggttctcgtgtctttgtgaactgtttccattttacaacatgtattttattcaaatatacatcatagtcaaaagcatcctctttttcctcgacaaagtgccatcctgttggcctcccacagacacactctctgcccctaattcttaaagaagcagtatctggtgctcgccctggtatggtgcttgtttggcttcaggccactggcaaaacgacctaagctattattgggcttgtctccatcccagtcttccaaccttctttgtaattgtcaagaaacccaactgagcctcagctgaagtatctacctgttattgacctgactatgggcgagccaagcctagtctttcctggtctctctttcttgtgtattggtgcaggatgaggacattgcttcagagtaccaaagtggagaggaagaaacaaaccaacaaactcaagaaagtagaaaggcagtgcacagacccctttcttagggttagaggcaaggtggtctttagacttcctgagttgaagactgatgtttctttgggtggaatttctctgtgctacctcagaaacaaagatagttcatctgacaaaccagagacctacttagagataacttcagcctatccagggaactaaaaactaattaaaaattgccaggccagagtttcaaaccaggagagtggtgtggtgttgtggttaagagcacacactttgtatcctgtcggacatgaatttgaatcatggctctgccacttactacctgtgtaaccttggtcgagttaacttattcttgttgggcctccatgctttcatcaatcaaattggagaaaataatacccacattaggagagtcttttgaggactaaaagagagactaccaaacgtttgctattttgcctatcttcatcaggaccccacagaagactctgtattctgaatgttgtattcaccaccaattatctgtatccctgttgaacggagggaacacaggaaacatggcagggaatgggttaaggagcattggtttagccgataactgttgtgtgaaacatgatttagttccctcccgtctctatggactaattttccccactaggcaatgaagagtttgtgcttgagcacgtgttctttatgctgactcaggacctgagtgtgtcaaaattatcttaaaagttattttttaagtgtagatgtgcagttgcaattcccagacagtctgattgaggagatctaggggatagtcacaggatctatactatatgtccagtcgcccaggtgattctgatcagcagtcaagtgtgggaaccactgatgcagggagttgtaaagattctccctttcctccctgctttcagtcttggaacttcttatagtttgaaagtgtctttccattaatgaggcctatgacttcctacatcattcaaacatggtgattttcacacagagaaaataagaaaacgttgctagtggtcctcaaagacggtatttttccccacagaaaattcattttgttttgctttagtggcttgatatcagatccacaaggcatgtaatacagaatagggtgaacgttgagggatctgcttttaattagtttccccagctgatctctcagatcattttaaaaaatgcattctctctattttatgattgaattctaagtaatgaagtttagcaatatatgtaataaagtagaattatctcacaatagatcacaataatagatactgagtaacttctcagtgtcagttgctacctatatttccataatccttatgacaatatttgaaacaggcattaatattttccctaattttaaaacaaagaagataaaacttaaagagataaagtgacttacctaaggccacacaactggtaagggatttttttagtgttgaacagggatgaaaatggtatttaaaaaatgcaacttgaatcactttctgtcttaaaaattttcagtgacttattcattatgcttaaaaaattatctaaacaactttgtgtgggcagtaatacttgtccgttttggtcagtgctgtatcctcagcaataagaacagcgtttgtcatacaacagagactcagtaaataaatattcatggaataaattaagtgatgaagcctggattcaacccaagtctgtttgattttaaagcttgctcttcagtaatttgtatgctctctcctctctctctctctctctctctctctcgttaaatttacatactatgaaatgcaccaatatttggtgtaaaattttatgaactttgacaaatgtttataactgtataacacacatcacatccctaacaagataaagatatttccttcatcctagaaagtttctctttgtttctttaagtcaactgcctcaccctttccagagacaaaggcttttctatgtttatttattttttttttaccacatgttggttagttttgtcttttttagaatttcatataagtggaattatatactatgaactcctttgtatctagctgtttttcattcagatggtgatttaagatctgtccatagtgttatgtgtatcagtggtttctttttattgctaagtagtgttgcaatgtatgaatatatcataatttgcttatcattctactgttgatgggcatgtgaattgttttcagtttttggctattatatataaagttgccgtggttgtttgttttcaggtatttttgcagacagatgttttctttttttattattattatactttaagttttagggtacatgtgcacaacgtgcaggattgttacatatgtatacatgtgccagtggtatgctgcacccatcaactcgtcatttaacattaggtatatctcctaatgctatccctcccccctccacccaccccaccacaggccccggggtgtgatgttccctgccctgtgtccaagtgttctcattgttcaattcccacctatgggtcagaacaggcggtgtttggttttctgtccttgcgatagtttgctcagaatgatgatttccagcttcatccatgtccctgcacaggacatgaactcatccctttttatggctgcatagtattccatggtgtctatgtgccacattttcttaatccagtctatcattgttggacatttgggttggttccaagtctttgctattgtgaatagtgccgcaataaacatacgtgtgcatgtgtctttatagcagcatgatttataatcctttgggtatataccccgtaatgggattgctgagtcaaatggtatttctagttctagatccctgaggaatcaccacaatgacttccacaatggttgaactagttgacagtcccaccaatagtgtaaaagtgttcctatttctccacgtcctctccagcacctgttgtttcctgactttttaatgatcaccattctaactggtgtgaggtggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgtttatgttcaatgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttgtgttgccattgcttttggtgttttagacatgaagtccttgcccatgcctatgtcctgaatggtattgcctaggttttcttctagagtttttatagtttcaggtctaacatttaagtctttaatccatcttgaattaatttttgtataaggtgtaaggaagggatccagtttcagctttctatatatgctagccagttttcccagcaccatttattaaatagggaatcatttccccatttcttgtttttgtcaggtttgtcaaagatcagatggttgtagatatgtggcattatttctgagggctctgttctgctccgttggtgtatatctctgttttggtaccagtaccatgctgttttggttgctgtagccctgtagtatagtttgaagtcaggtagcatgatgcctctagctttgttcttttggcttaggattgacttggcaatgcgggctcttttttggttccatatggactttaaagtagttttttccaattctgtgaagaaagtcattggtagcttgatgggggttgcattgaatctataaattaccttgggcagtatggccattttcacaatattgattcttcctacctatgagcatggaatgttcttccatttgtttgtatcctcttttatttcattgagcagtggtttgtcatttctcttgtttatttacctagatgtggatttcctgggtgataatggaaaaagtatgtttaccatttcaaggaactacaaagcatatttctaaacaggctatacctaacagggtactagcaatatatgagagttgtgtatgcaccacatctttgccagccttgatatatgtagttttttaaattttagccattctagcgggtatgttgctgtattattgtggttttaatgtgtatttcctgatatttccatggtaagtattgtttcatgtcctattggccactcatatatcttgctttgtgaagcatctgttcaagtcttttacctattttttaaattgggttgtttgtattcttattgtatcataggagttatgaatataagttctttgtctggtatattttttttgaatattttttcctgactgtggcttacttaatctttttctgttcttttgatgtacagaatatttcaattttgatgatgcctaatttatcaatgttttattgtttatactatatcctgtctaagaaatatttgccaactccaaggtcatgaagatattcttctttgttttcttcgagagcctacattttaacgactacagcatgcatctggctttgccttacttgttatagaggatgcattagtccatgagataattgttatcagagtaagctgatgggaggcggagtactatagaattcaacaagacagctttgaagttcaacagatctttgttcaatttctgactccagtcccagcagcgtgaccttaggcaagtcacttgatctttctgtgtatcaattctctcatttgtgtaaaggagataataacaccaacttatgtcacaggatcattattaaataagcaagtatatgatcacttcttaacacagggcatagcacatagtaagccctcaacgagtggtgtctgttgtacttacaatacttttcattcatattataccagtttcaccaagagtttttagtgccagaagcaaatataggaagggttaccttttcttcccctactagacttcaaacagaaccattgaaatagagatgacccattaagaaggggtaggctatagttacaaacagttctttctgtatgtctaaaatcgcatctttattattttgagtaatactaataactgaatctccaagcacagacatgacagatatgattataaaactccctggcataaaggacaattttatcattgaaaactgaaattatatgaaggaatacatgtaatgcttttccagaaacacaatgtgctcattaaatgtgggtaaatgcagatgttgaagaggtttttaagtcagtgtacagtgaaaagagcagggactttgacataaaacaaacatagaacttgaatacaaggacatatgacttgattgctgtgaggctcactcctatcatctatcgaaagaggtttacataaatattggagaatatgagtgcttcaaagaatatgaacgcactagctaacatcataggcactcaaaatggtacttattggttaacctcatatttgtaatgacatatatgtaatagtaaactaaagtgagatatccaatttcaaatgagttacatccttaaaaaggtgaaagatagttttgtgggtttattttttgatagatttctcttctgtgttcaggaatggtactcacagaatatatctgtttgatatgtgaggtcattttgcagctcactcattgattcaatgcatttctgaatcatagaggaggatccctggctatttgtcatgtctgaatgatggaaacacatatttgaatgattctagtaatagagaagaatgtggaacttgctccatacatttccatttttaacatccttctgttgtaggggatggggagggagaggattgtgtatgtaagttgttttctgctaatgctaccactgctgttttcagagtcaatacatggacagaagcacaaaaaactgagtattccttttgccttatgcatcaaagtctctaaccaagtgtttagaactacatctactggtgttctcccaatgcaaattattctaggccctttgtgctctggtctcaacctgattatatacccttacctcttttcttgccacagcaaaccatttactatttttcaaataattccaatgttttactgtttctgcctctttattcatgctgttccatttattctgttatcttgagaagcctttcctcccatatctgtctgctaaacatatatccatctttactgagttgaagtgattccccctaaattcacatccgcttggaacaccagcatgtgatcttatttggaaatagggtctttgcagatgtaattagttaacatgagaacatactgtattagaatgggctgtaatccaatgactggattatataagacttataagaagtcacgtgaaataacagagacacgggcacacaggtgagaaggccatgtagtgatggaggcagagattgaagtgatgcagcaacaagccaagaacaccaaggattgttggcaaccaccagaagctaagaagaggcaaggaaggattcttctctagagccttcagaggaagaatggccaaaacaacagcttgattttaaatgtctagcctactgtactgtaagagaacaaatttctgttgttttatgttacccagtttctggtaatttgttatggcagccttaggaatgttttttacatccttcttcaaggtcaagctcaaatataatgtcttttccagatttcttcaactagatgtaatttctcttcttcacctctgtagcaatgctgtagcagaaaaaaagatcacaaactttggtgccagagaatttttggctgtaatcctggcccagctactgactggatttcttcacctgtacaatggaaataataatacctacctaatagagttgttgtgtcaataaatatgactgttccttacctctctaattcacccattctgcctcagattgcaataattttgtaataagacaatatagttctgtttttttccagttcagaggctggagggagcatagataggtaagcaatcagctttgtacacaataaaacaaaatgtgctatctaacaagggtagagacaagtattgttcacattgacagtctcaggaattcagttgtctacactaggagttccaactataagctaggaaactgatttataaaattgaaatggagaagcctccttttagtccctgaattccagaattgtaatatccaaggtagattttgtcttaatgcctaaaaatggagcaaaaattctggaaatgttagagccctctactgatttcacagctcctgtatatgacactggaacatgcttatacttggctgcacattttgataaagccaaaagttcaccacatggcattctggtctctcttcctctagggcatcttcccaaaggcctcagctctagaggaaatctgttttttcactcttgcagcctacactgcctggccaaaagtagggatttagcatgtgctctttatccttcctgagttttctttgtctgaatccccaggctctatgcccaccaatctttttaaaaaaggtcaacaagtaacatcatccccttatgttcatcatcttcttttccaggcatatcatcagaatcatctgagaccctttttatcaaagcatactggagggtttataggtgttgacctctaccctggataacgtggggaaggtagtaagcacaacacacctgccccttctgtgtgggtaagcccttgtattagtttgcatgggctgacataacaaaaatacaacagactggatggctgaaacaacagaaatatattacctcacagttcttgatgctagaaatctgagatcaagttgttggcagagttggcttctttttgaggcccctttccttggcttgtagatggccggcttgacttcttcctttgtcttcacatggtctttcctctgtgcacatatttatctgtttccaaatttcttcttttaaggacaggagtgagaatggattagggccccacccacatatggcctcattttactgaaattactgtaatttaaaggcctatctccaaatacagtcaccctccgaggtactggggtttagaacttgaacataagaactttgggtagtgacagttcagccccgtagttttgtgattaggatcaaattattttgcaatcacttggtgatggatttgtttgttatttggtcttgggctctgatagctgagacgttagcctcgtagtatacacagagaaattaactcaagcacaattcacaggtcttcctcatgacaggagaggcaaaagaatcatggaagtcaccacttggtaaacacctaccatgtgacaggcatggtaataggattttttattttttcttcacaatcagttagcaaaaataaatatttacacccccattttcatatgagaaaattaagattcagaggggctaaagtgatttgctcaaaggcataaaactagtaagtattggagttaagaattgaatataaatctgtctgactataaattcatgccctttcctcatgcatcctttatctggaattgaaaaaaaagtttttttttgctcattttaagctgtgacattaaaatgaaaaaacaattatatgaaagagtttctagatgttcacagtcatcgtttattcatatgtccatttatcatatactcatactggactagcattgcttcactttgtttttgagcttgccatggaaacttaaacaactgaagaatcaggaaatgatgacagcaaagtgattaattatacattgaaaaaacaatttgggggatgatggtgcagagagcccttttagccacactggcgtaatgaagtagtttagatttgtcctgtggcctctgcaatcgacctcttgtttgttttgttacaacaaattgctttacagtactgaaatggtctatttatgttcattgtttcttttgcagttttgttcccaaactttggaagttgttggagactgacagaagagccaggaacatcccagttttctgaacattttctatgattgtgacacattttaggatgctctttctacctagtgaatggtgcagtttgtaaggatagattatttgctgagaaagtgggtattgggtcctgtgacagaggaaatatatttcagagtattggagggccatttaaaaatgatgatggtgttgataatagcaatgcttcctgctgttgcatcatttagagtttacatggatcttctatatctcacttgattttcacaaaaacatattgaagtgatcagtcagggattgttatatccactttccatatgcaataattgagattcaaagaggttaaatggaggcaggacaaactcccacatctttgatcaccaacaactcccttgctaaattattctttgtaagtccagtacactgagttcattcactttaaattggtgcacattttgtcctcctggaaaaacattatgtcgaattgggaccattaataattgcttactagtttcaaatgtccagtgggatgtcaattgagatccagcggctcttttctccccagcctctttaagagaacacacagtgaattcaatgcgcagtgctttcctcctgctgcttgtacttcctaacaaagagcccccatttattggaaatcaatcatgtgctagatactggctatgtgttatttctaattgtcacaattgataactctgcaagagaggtattatcatacctaccttacaaatagggaaactgaggcttggagctgttaggtaactttcttaacatcacagagatggtgagtggcagagccagaacttcagcttatccagtctggcttcagaccattgctttaaaccaccataactctttaaattcagtacattgactttttaactgagttatttggaagttacagcttggaggaatccattccttaggaaataggttgacaaaaaaaatcataaagttaaaaaaatgcaaaaaactaaaaaaactaaattgttaatttatctatatcatctaatttggtaatagttttctacagttgattggaaagcttgtggtataagacaagcttctctgagggtaacctacagtcactgtaagtgcacagaggatgccttctttgctcatttctaatacaaaactatttctgttctcctatgtctctaatccactgaatcgtttttccatgtacctattctttttagttcatgcatagtcacttaattgaacacatactcaccaagataattaacaattattggctacttccctgacaaagggttaattcgttctgttggcaacccctgttaatactaaaaagccctggggcagtagatcctttcttctaggaatgacccccccactgttcattggagcaggcaggagtgccgaactaaccagtcctgctatctgtttcatctgtcgagtagacatttgactacctttttttgttgctgcctgtgactcaccctcattactcaagattgtggaggacagcaactgtgcttgaggagtagaggagcagtcctaagataaatcatcttaatgatttcccatgcgtttaggacttagaactttgcaccacaaggggataaatgcatgtcgcacgtagtcttcatagcaatgaagaataccattttggtttataaagatgtaggaaacaaaaattcaagccctccattatactacatgtctatcatgggatcctgcagattctaattatagtatctaccttttactaggctgctccttgtagttgcactttgacctcctcctagtgtagactgcttttatatgctcgacacctcacctcactccttctaccaccaagaagaacagagtccttagagcaatggtgaccaacagcttttgtggaaggtcaaactggtaaaaagaaaactgtatgagacaaatagtggacactcaatacataagtttagagagaaggaaggaaggatgggtagcttattattcaaattttatatcatcttttttctaaatagaaaaataccagtgagagaattgccacttctgtttagcaactaaaaaaaatttaatatctagtcatatttgagaaatggcaatacagaacctgctttttaatctttcagcctgaaattagcctgcctggttgtaagatgcatcctatgatctattggctgctcaagagtgctttagaggattttcgaacttgaggggcccttagaaatgatctagtctagtgattccaaaagttttcattatctaaggcatctttaattaattttcccctgcatactgtgttttgaaatatcaggcctactaaacaaattacctttatcacataataattccttctctcattttttttttctttttttttgctcagagccattaatgatctctcagtagagaatctggtcagcatgaaataaccagtgtaaccacaataagatgatataattccttcccaaagtgaaggcagtagatggttgagttggtctagggtcagcttgatcttagcaatctttacaaaccatctcccttaggcttattgaaatgttaaaaatagctcatggattcccatgatgaccttcttataatctttgtggacagccatttatcttatccttctgtagggaagaatggaggggaatcagatttaaaaagcaaagtgattggcccaaggtcacacagcaccttaatggcaaggaggaccagaatttgtgtttcctgagtctcaatcttctttctctacacacccaattttcatgtgccttaggtctaagagcttaatattgtataggcattccataaatctttgctcgatgagttggtagaacaggggcactaatacttaagtataggagatacaaaaaaaatccatgatgaattcattaaacaaccagtaaaatagtacaaatatccagttcccagttctgaattcgtacccagcctcctttgctttccttttcatgaatgatttcagacatctccctatagcgtatttcagctgctgttgctcttgaaaaggtttactcaggaagtcaaatagtgtccacttatcctgttataccctgtctccgagaggtgaaaatagcatggaattattctcagcagtgaaattcaccctcctcttttgctttcatcccctttacagtggtgatccttgctaaaatgatgagaatttgaatacctctactccaggatagttcattctcagtccttctagatgaagatccacttagctattcaatttttcttcctttctattactgttcaaatgtcctataattatccatgtggggcacattttagtgaatgacatttagtgaatgacatttttgacagacaggatacctacttccaagtaggtcagatattagagcttcagcagtgcatgctttatgtgattttcataggaattcatatttgggagctcctagctagctcatattctctcagtgaaatgttgaaatatgggctcaattgcagggctttagttgccgtgtactgtcctacatgcagggtgcacttcacatcaaccagaatgagttctgcatagcctgcaagactaaatgttgagttactacacattggacactggatctcacaaggggcctctgcaaaccctcatcacagaccatgggcagtgggagtgagccagtgatattctcaggcacagccctggggcccacccactgtgatgcccaggagaggaacagattgcccagtccctgatcaacagtccccttccatatttcccatggtacaaaaaagtatatatatatgcacagtatttcattctgatgaagagtttatagtcaatgtgagacaacaggtgggtttttggggggattttagtggagttgatataaattacatgagcaaagtagaatcttggatagtctaatgctttcagaaactatttgtcaggcccaaataaaatttttcggtcttgtaaatggcctagagcaatctctaagatgagaagttatgtgttaaatggcaaaacaaacaaacaaacaaaaaaaacaacaagatacttgaagaacacagtatacaaggagtcggcataatgagaatttccccagttgtatttttcttgtaatattgacgttgtttttccccctgttgtgaactaaagagatagaaaatacctttgtgtctagttgaaaatggattcttaattaactgtccagagatttgttgttagaggtaaaattctgggaagggttctttgtatggacaggaagaattagctctgtagcaagcataaaaagggcccatttcttcctaatggcttttccaaggaagtggggaaggagagaaaaaccgaaaaggacattctcttattgctcaaatgaccagatttcttggacccagaactgtagctcatacacagctaacctagggtcaaggtttgtaggctgcctctaaggcatccctttctttgccaaattgttatgcagatgtgatgtgttaaaaacacactccagccctggttgtttggagggcatctttcctaatggaggtgatacaatgtgcttattgagtcagcaggcactttgttccagagtagacagtaatgcaggagtaggaacataagatatggaggctaagttctgtcatttattatgtatatgacctggggcaaatggttcaccctcagcctctgtttgcttacctaagacatggggagaataataataccaacttccaaggcttgttgtatggatcaaatgagataatccatggaaaacccatctccccatgcgagacatatccttacatagtggctcaataaaagatagatgagcacgacagcattttgtaggacaaggaaaggctgggactatagactctgtttatttgaaaataatgccaatgagaggtctttttctcttgggccagtaagtctcactcagggaagaattctgacacaagtacatagactgcacatttaagctctatctggtgctcttccagattatggccttggttttgaggaactccaggaataaggggacttgatcatagacacactagtggagagggagcatcaggtgcctgtagatcagcagaaatgctacttttttttcagaggaatgagatgccatacatacaacctaatctggcttcaaatttcagaagcagggactttccacttaaatatcatcccatgaggtttgaggactttctttctgtgtaagactgaggattttgaaaggaatagccttgaatctgcaaattgcttagaacagtgtggccattttaataatattgattcttcctatccatgagcatggaatgttttccatttgtttgtgtcatctctgatttcttttagcagtgttttgtaattctggtagaaatctttcacctccctggctagctgcattcctgggtattttgttctttttgtggcaattgtgaatgagattgcattggctctcagcttggacatcgttggtgtataggaatgctactgatttttgtgcattgattttgcatcctgaaagtttgctaaagttgtttatcagatcaaggtgcttttaggcagaaactgtggggttttataggtatagaatcatattgtctgcaaacaggaatagtctgacttcctctcttcctatttggatgtcttttatttctttctcttccctgattgctctggccggaacttctagtactatgttgaataggagtggtgagagagtgcatcctttcttgtctggttttcaagaggaatgcttccagcttttgcccattcagtgggatgtgggctgtgggtttgtcatagatggttctcattatttggaggtatgttccttcaatgcctagtttattgagggtttttaacatgaagagatgttaaattttattgaaggccttctctgcatgcgttgagataaaacaatgacattattcacaattacaactcctttaaaattcataggaaatcaaaaaagtgcccaaatagtcatggcaatcctgagcaaaaaggacaaagctggaggcatgacgttacccgactttatactacaaggctacagtaagcaaaccaacatgatactggtacaaaaacagacacatagaccaatggaacagaatagagggcccagaaataataccacaaagctataatcatctgatcttcaacaaagccaacaaaaacaagcaataaggaaaggactccctgttcaataaatggtgctgggataactggctagccacagggagaagattgaaacttgaccccttccttacaccatatacaaaaatcatctcaagatggattaaagacttaaatgtaaaacctaaaactataaaaaccctggaggaaaacctaggaaataccattcaggacatagacacaggcaaagatttcatgacgaacaccccaaaagcaattgcaacaaaaacaaaaactgacaaatgagacatcattaaactaaagagcttctgcacagcaaaagaaactatcaacaaagtaaacagacaatcaacagagtgggagaaattatttgcaaactatgcatctgacaaaggtttaatatccagaatctataagtaacttaaacaaatttacaagaaaaacaaaatgaccccattagaaactaggcagaggacatgaacagttttgaaaaggacacttttcaaaagaagacataaatgtggccaataaggatataaaaaaaagctcaccatcactaatcattagagaaatgcaaatcaaaaccacaataacgtagcatctcacactagtaagaatggccattattaaaaagtaaaaaaataacagatcctggtgaggttgcagagaaaagggaatgcttatacaattctggtaggagtgtaaattagttcagctgttgtggaaagcagtatggcgatgtctcaaagaacttaaaacagaattaccatttgacccagcaattccattgttgggtatatacccaaaagaatataatttgttttaccataaagacacacgcatgtgtatgtttattgcatcagtattcacaagagcaaagacatggaatcaacctaaatgcccatcagtggtagactggataaagaaaatgtggtagatatacaccacagaatactatgtagtcataaaaaagaatgaggtcatgttctttgcagcaacatggatgaagctagagaccattatccttagcagactaatgcaggaacagaaaaataataacgtatgttctcacttataagtgggagctaaacaatgagagcacatggacacagacaggggaataacagtcaccggagcctacctgagggtgggggttgggaggagggagaggataaaaaaatacctatcaggtacttgcttattacctggatgactaaataatttgtacaccaaaccctcccgacacacagtttacctgtataatgatcctgcagatgtacactcctaaacctaaaataaaagttaaaataaataaactctaacatatgaaaattaaatttaaaaagctgaggatttgcaattcatggaatatgaagcaatatttgtgttgtcttagttttagcttatgaatacagggagaaatcatttgacttagggcttgttctgggtcagttgatctttggccttgtttccataaataaacccttactagcagctttggcaatgccagcaggaggccagactatgcctggtttcactatgtcctggcactatctcaaccaagagtgaaaatcttgggacaaatcaagtttcagattttgttgttgttgttttaggaaatggctttaaataccaatttctattctccaagtactttaaaagcaaagtaaaattaacattacatttaaagccaaccacctcaacatggcaaatgcctctcaacgcctaatggactctttccttgggctaaatggacaagttccttagcagagcttgtctaacccttgccttgcattgcaccccagtcccgcacaagaagctgagtagaaaaaactgcattgtgctctgcatgagaaacgtacctaagcatctaggtttagggcctagtttgtaattagacagtttcttggaagtacatcaagctcagcctcaaatcagaacatctcttggggagcaatctgtatttagatgtttcatttaaaaattcatcattgaataacaaaatattttgttgcaactcctacttgatgcattccaaattctctctgtcttttaattacaattatgttattaataatggatggaatgggtgggggcatgggtgagactatgccaggggctaagtagcaaacagagggtagcataagcagttaagtcatagttctttggggcggcagaatcccgtgaatcccaggccaagagctcgccactctggcttccttttatatatgcctgttatctacatcctacaactgctctgatttggccaggagaaatgttttttcaagtagtaggcaaggaatgaagttctaaaggtatttggcaggcagactaagtttcccccaaaagctggaagaaggacttactctttgtgtctatactgacagcctctacttttcccattatcttttcatgctatttcagccatccctccattgagactgctcttgtcaagatcaccagtgaactcctgtgtcacccaatcagtcttctcttttcacatccgtttggtctcctagcaccatccatctgttgactgctgttgggtgtggtgtagtccagggcaggaggagaagagggagaaaatgttatcacaaattctattctgaactacactatgtttagtaatatgcctatgttgtcaccctcatcctcatttatgttctccttgttcttcttcctcaatggccactccttctcagtctctttaattggcttcttcccacttaccattctctaaatggtagtttccttaagatttgcctctgggctttcttgccttcatctacatcctgctccagtgagattatctactccccatgctttaatctttatgcagttgacgtctatatttctatctccaatcctaatccttttagccacatgtattgtgctaaatcttctctctaaagcagaatactaaagggcagtcaactgattaatagccttctctttttctttttggccttcgattttttgtttctaaattgttcacctagagttactctttccacaaatattaaaagataatctatactgtgtcagacacagtgctagctgcagtatagactggggattaggaagttacaggtactgggatataggattccatgtgatactagaaaaatgtgtatacattcatgcagtcatacgtacatagctacatacaaatattcattcagcaaatgctaatggagaatgccaatgtactgggtgctatgccacacactagaaataccatgaggacaagggcatagctcctgcttacatgcagctagtggtttagttaaagtcagaaggcaatcaaaaggcagcaggaagtgtcatatagagataatttgggtgcagaaatgagtacagatgagggttcatatctagcctgtgtgtatttctgtgtgtgttattataagttgtattgaaaatattgatatttgctacatccttgccatctcgccccatgatatacacaaaggaacactctctgggtctttcgttctcaacatactgtgtaactctagccctagtgagctgaatttgacttgtaagaccagaagggctcattttgtctaaactcagtctctctgggtttctactaagctctataaaggagggggtagagatggactggagagaaaagaggaaacttcttctcaagaagaaagggggtccgggcctgcttttgtcatactagctatctaagagcaccacttgagagagatggcctggcactgcagggagatattctcacaaacagatataaaagaaaaaagccaaagtcacactcatcctcatttttgtgccacatatgcccagacctttaatcccttttctcaatgaagtataatctttaccctataacattctgaccgctcccctcactgtggccttgcggtccccagtgtggagggatgagggagaatggggaaacattaatgctttccctggagaccacaatatgtaagttttcacagaaattttcccacagaaggtgtgcttccgtagaaaggaatgcataataggtgctcaattagtatttattgaatgagttaatgaattatagagtgagcaggagttagccagaacttattctggtcagccattatgatggatgtttggggtacacaggtgaatgacatcaggtccctgctgtcaaggaactcagctcccagtctgatgcaagaaactgatatgctaacaagtaattaccatttggtgttatacttattataacaatagctaatgcttagtgagcccttactatgtctaggtaatgcttcatgtgcattatctcattttatccttacaattactctacttgatatattttgttattttctactctccagatagtcacaatgaagttaaataattttctcggagtcatccaaagtgcttttgatgttggcttgggtctgggctgaagcttgggggagttttgacagccatcagtaagattactaagggagagctctttttgtggagaaagaagcatccgagggatagaggtttaggaagaagcagtagaacattgtaggctctttggtctgtgggagcacaaccagtgtagactgtggggccttcgccccaagagatgattgagccttatcaagaattttgagataattcccctttgctcaagtacaactttgggaccttggaatcacccaatatgccttgtctttgtctctgatactaaggatgcctaagtgaccctgaagaagcaatggagagatgaagtttttacaagaacttcctgatcccacagcccagccaggctgtacatttaaccactggcatttggaagcagcagggcttgtaagtgtgcctcatgcacatcaaaataaaacacataccacatagattccattttcacatttttacgacattcttgaaaagacccaactataatgatggagaacaaagcagtggttgtcagaatatagaagagggtttgtgtgacttaaaaagtatagcatgagggactttgtgggagtgattgattgcaatggaggttccacagatctacacatgtgttaaaactcatagaactatacaccaagaaaagtcaagtttactgtatgtcaattttaaaagtccaaatataaaagaaataaagcacacatcatctcgtgtgctctatttttcacctctcaggctgtacaaaatgtgagcattcaaagcctttaatgatttggcagagttggaagaagggtaataagtggggagattacttgaacttggcacctgattcttttcaagtcatgagaagctaatttatcctcccttgtaccatctctgttgttaagctactgagtgcccttatttgagaaatgccctgtgggcaaaataggatggtgcatgatcacagtccgctctccaggaaactagtgtgaagctgtgtgaaagagcattttttttttcattttttccccaaactgtggcccgcaatcctcaaacgctcagcgtcccagctttctcacagtatttgacatgactgtagttcttgtttgtacttgcagcacagagcaagcagaccttgacttccagaggccctgacccattgaaggggccgcccaacaaagtttcctgcaaagagtaaagactctgaaacttcgattctgatgctataggacaggaggaccactcatctttaccaaatcagggaggtgtccatctcccctttcactcttttcctcctcctgaaatctttggggtgccctcctgagggcagggggagaagagggagaaaattttatcacaaattctattctcactagattatgtttagtaatatgcatagtattttttttttttccaaactcctctccttactggatgtgggacctttggccagacatttaaaacttttagattcttttcacatcctggatatatggctaatgactactgccttgcttaactcccagaaggactgagtcaaatgtcaaaatgctgggtacatttgtatgaggatgaggatcaattgaataggatttatgatggactggcttgggcccctacgatttattcccattagagcatatgttttgatttccaacctactaagcaaccaaatcacagatgcagttttgcaacctacagcacatttcatctcgtttattttcaaagctgtaagcagagagccatcctccatgagcagcacacatttgaaataaaatacaagttcccatcaagatattctgacatgttagacaagatgccaaattgttactgtgcttcagacttattaggcaggattgaaaagcagtttttagcatgatggcaggtcatttctgcttgcccatgaaatggccaaaccaagcactttttagatgtgatcatatggggaagaatgttcctcctccttatcttgatcagctttttaaggagaaggcatcctcatcttcctcttggttatgggtccgcttcctccactgaactcctatggcattttgctaggaccacttttacagctgttgccacattttgcctcatggtataattgttcctctacttgccacatatctgagtagtgtaggagcccctccacagcagccaagtcttgctcagagaactttgcagagttctttgtggattgctggaatctgggatttagctcttgaaagttaaagcaaaagaggttacaccgaaattctaagtaacctatttttttcatttagaaaagtaaaattgtatctgttgattatagaagattttgaaatattggttagtaagacatagaaaattaaaatcatctgtagttttcaacttaggatactgggttcataacttaatccagtttaatgtatacagttactatggctggttctgcaaatcgaaagatgactatgacatggtcaatgccctcagtaacctcacagactggtagggaagacagatacgtgaacttagtcctgcaggcaatggggagccagtacaagttttgagctggacattgacatgatgaaaatatttctggaatttttatctaaaggcagcatggtgtggagaaagctgggcctgaagcataaagaccaattcgcataaagaccaattcggaagccaatgctaaaaggccacacattttactgtttggccttaaggtaaacacaatgttattcaaccagagtgacctccttctcaagttagttacccttgggacttccaaaagtgaaacttagagattagctttgccctcatcacatttactgagcaacaaggcactttgacagcctctcactgtttgtgtttagagtgggggacacaactttttctctctccatctgattggctgagctcccagtctacactacagaacctgagtcttaggagacagatatttaaccccaagtcatgccactgggtgtccatgttaagaaatatcttagggaatcttccacaagtctgttgctgttctcctccaaatatttttggttttcttaaaaaattagtatgcccttggtcagaaaggtatagaaccaaagatgtttgcttctgcaaacctaaggatgactatgacatggtcaatgccctcagtaacctcacagactggtagggaagacaaatacatgaacttagtcctgcaggcagtggggagccagtacaagttttgagctggacattgacatgatgaaaatatttctgaaatttttatctaaaggcagcatggtgtaaagaaagccggtgacctctcttttacagacagaacagctagtctcctggttatacttgccctaggtctcacatattaagtggcagaggtgggcctaaaatttagcgttagacaactaacactggtcctccatgaaacacaaattgcttctaggctggaggagatataggtgtctctataagccagggcctgtagagcaggggcactagccataaagaccagacaacagcccaggatggctactgatcctagcagacacagttctataatgtaaaaacaaccaagaagcaaaccaacttaaaagttaacagacacacacacacacacacacacacacacacacacacacactacactcctgacatgtttttcccctttctattttcagttggggttatctttcagtttagttctgggaaggggtttctttttttgtcgttgtggttgagacggagtccctctccggtctctgtcgcccaagctggagcgcaatggtgcgatctcagctcactgcaacctctgcacacccccaccccccgccctcccgcgccgggttcaagcgactctgccacctcagcctccagagtagctgggattacaggcgtgtgccaccaggcccggctaatttttgtatttttagtagacacgggttttcaccatgttgggcaggctggtcttaagctcctgacctcatgatccacccgcctcggcctcccaaagtgttgggattacaggcgtgagccattgcactcggctggggtttcgttttaatggctcagtaaactgtgatctggtacaaaaggatgggattaatgggctcttttgctgcaaatggtactaagctcttccagctttatactctgcaccttttatcttcgtggcgatatttaagcttttaaggacgttgctgggagtgacgactccattggatccaatctcaggaacagtaaatggccttcaactctttttaaaaaagatgcattgcaggagtgaactgctgcaaactgctgcaaactccatggaggagtgacctttaaaatggggggtggggggatagtttgctgctggcttttcattccctgtagccacctaagctgttggggaatggacatgggaaacacactagctaaagggcccatttgttacaaactgagttttggtcattttttcttatttatatacttatttgtttttatctgagcacataaatctatatttgaatgctgcaaatcaccctttgttacactcttcttagtagacacatatgtatttagggtacagctgagtacagtacatttgaggttttgcaaatgataaattctgccatctccatattcttggataaaactagaaatacacaggcttttgtatacgaacagcagaagctgatgactctattcacatatagctatgttggatatgttggaggcctggagcaatttggccacagagagttgtttttaggattggaagaacactcagcccccaaactagataatgtgacatgttctatttttaatgagtttattttcttgtttcagcttggaggtgttagttcatcgttttgattcttgacaaaaggattctgcttagactctcagctccctggtgggttggagtttcacaaaaacatctgcgctaaagcaaaggggattcatactatcctagacagtgttcacttgaaggtttcccagaagcatctgtagctggaagagtccctgtcagtctctactccctagctgtagatgggcccacagccctgctgcctagggaaaagttgacagttattaaaaaaaaaaaacagcccttttctgtcatattcacttcagtaaaggaccaagtctgctattgcaaatgggctgtatccagtgcacaggtattctggtatctcctacagcacatagtcactattgctaaacattttgggtagttagagtcagtagtcccaaagattggccataagggccaaataagattggaattctgattatggtagaaaatcctttttaatgtattataattcataagaaatagacttcagaagagaattgatttcagagctgtattcctgctcatttcttccatcctttctgttcatttttcatttcctacagacaatcaattagtaaatgtaggatacgtgtgtacctcagtgacccaagttgctagggatacatcaagtgcttcagcccatagcagccaagggaggtttggggtgtctctacagctcttgacttttcaacttcaattataaatccatttggtcaagttgtggtttgaactgtgtgtgtcccctgtgatgcacttttggtaaacagctgcagtacagaagcagctgggcttatttgttaccatctctactaagccgccatataactgcatggggacggtgatacagcaagtgaaaacgggtagagttttacagcatagggtcttagattcatgatgagaaatgacactgaacaaatgactatttttgactttaaatagaagagattaaaagactttcagatctgttctcctaggtttttgttcatacatcttcatttttgcgatttctccggatttggagtctgttttgaaggggaaagttggcccatccagaaagcaccggatcatattttccattctgtatgcattttgctatctgccttgtttatgtgaacattaaaataaataaaaccttacaatctaaactttgcttttactaaataaatgaacacagcagttattaattgaattcagtcagctttcaaatagaatcattactttattacagtataaacacagtggaaagaaatcagacaccctagcacagtgcatgttttgctaggaatttaacaaatatgttggcctcaatgtgaacaagttatatatttttttcagacttgaggcttgttaactctttcaggccacttgctgctaggcaaccaataccctgctggcttgagtccatggttttaaaaattatcagtttcctgccagactgacttgaggacttttgaaaaagtaaattttgaatgcatgctgcgctttttaggcaaatctttattaaatgtcttctctggcaaagatagtactagaaatatactgagaagtgggagaaagggtggccccttccttccaagattttataatcttttgatatcaagcacacacacacacacacacacacacacacacacacacacacacacacagctaaggcagttcacaacaatggaccagggtgaatgctgtggactgcagttgctctagagtaatacagggaaaggatgtcttatctgtggactcatgcagccaacaaaggagctgtggaaaaaatagaggagtttgaactggactaagtagaaatgggggtatattttaggcacaagggacagggattcaggatgctgtcaaagtgaggcaaatagttgttgagggcctcttatttgctaagtgctagggacagagtgaggaatgagccaggcatcatctggcctttaatggagctttttagtatgaacacaattattttcattcttttttactggctaacttatgtgcaaatttctgtaagtaagttgagaacccatttgaactgctcaaataaaaaaaggagattatattggaagagtccatgattacagcctgcccctagatcttgtggtaggattcaacaactgaaagtttgagaacccaagattacttgtttcatcatcttgggtcatataaacttttgttgctgcttcaaagaccacttcaagcttatctcttctccacactaaacacacacacacagagagacacacacacacacacacacacacacacacagagttttcctcttctgctttcacacacttgtagtcacatcagcttccactttaaaactacttcctagtttgaggatccaacagagattgacttgaattcctgtgtcctgatgccaaagtcacccagctttggtcagttgtccattcttatccaatcagtgatgcctatttgggcaagttgtatgactttgagaagagaacaagagaaataaatgattgtcatttcaagtacagtcagtcattgttgagagaaagagcaaatcccaagcaggggcttaatatctgacctgaacacatgtgtttggtaaacagtagtgagacttgtatcactgaaaaccaggctttccatggaggggcatggtgagaatgaaaactggaaagatatggtgggtctatattttaggacgtcattttaagtgtggaaaagggaagtcttcatgtctcattgatattgaggcacattctgactggctaagttgcagagaaactgtagacaaaattcttgtcatcagtgaggaggtgtgggactggagtgagcattttctaagattgtttcccagcctatagttatttggtttgaggctcctgcagattcctttctgagaggaactttgtttattactcttttgctgtagggattatgctgccctctggggattgggagattcctgggatgtgagggcacccctgggtggggtctttttctttctgagagcaccgcgataacatcttcctgcaagaggagtgtgtccctcaaaggccgaaatggaaaagattcaaaaatctctaactctcacctctctagatataatgcaatacacatatagaatatacatgccctttttcttggagaaaatttccaaaaataagatatatatttttgtgtaatgcctattgcttactttaaaatatttaaattatttaattttaaaatttataaattatgtatttattaaaatttaatatataaattaaaatatttgctcagtctggaggattcaggaaagcacacaaatttggcatattacaaagtacatgtaaccctaaacatccaaagaagatcaaattggtattttattgtattctttttcaatgttttatgcatgtatgttatacaaaataaaatgattacaatactatacatacagttttgtatccattttgtcttagtgaacatttctccatgtcattaaatattcctggtagctatatagttttactgtaatatattttaatatttactaatttaggggaatttaattgtcctaaataattattccgataaatagctttatatgtaaatatttgatcacatctttatttctttagtccagctttcaaggcttgaaattattagggaaaatgatgtgaaattttaaggtcttgttatatagttccaatttatatagacccccagtctatggtagcggctgactacctcatccttgctggtactaagtaatagcatggcttgtagtttatatcagcttggtaggtggaacgcttctccatggtaaagaccatggcattttctcctttaatggtgttcagcacatatcaggcacactatgcaagtttgttaaataaatcatagtcaaaggagaaggtggtaagatctattacgaagacatgtttttttgttctaagtctgtggggaattcaagaagaaattagtttaagcttgtgtaggaggatgcagtagagaggtgggattgagaagcgaagggccagtgaacaatgatactgttaaatgcattgaaacttcaaataagcaaatggggccaaggagagaaacttgttaaaaatgaagtgtggtctatttcatggagcacagcataggtgactgcagagtagatcatggattgtttcaatgtaaaaaccagtgggttgaaccctagagcccagttggatgggtctatggatgggtctatggagcacagttggatgggcctccgactaagtgtgaactgtgcagggagattaggttgtaacaataaaagttacagttctacattcatttattcattctttcattcatccatttaacacattgtttttgaatttggcctgtttctgtagtgacgatggagctatgaagatagtactagagctttcatttgggtggtttgttcaaatgcgttaggtcggttggtgcaaggtttgtactctggccctaaataaatcatcttggctttctaagaggtgactgaataagactcacttactctgctctggccatataggcttagttgttgtatttttgtttttgtttttctttcttgagactgagtcttgctttgtcgcccaggctggagtgcagtggcgtgatctcagctcactacaacctctgcctcccggattcaagcaattctttctgcctcagcctcccaagtagctgggattacaggagcccgccacaccacaccctactaatttttgtattttcagtagaagtggggttttgccacgttggccaggttggtcttgaactcctgatctcaagggatgtgcccacctcggcctcccaaagtgctgggattacaggtgtgagccaccgtgcccagccccttgttttaaaaatatactaggcatgctcctacattagagcctttgcactggttgtttgttcaacatggaatgggcttttcttagatgtctattggaccaaatccttcatctcattcaagtctttgcttatcgctcacaatgtcaatgaggcccacattgatcatcctatttaataccacaacctacctcccactctggcactccttgttctccttattctgctcacatttttcttttttcatcaaattataccatacttttaattatgctacataatttacttatatgttatgctgattgcatactgtctgttttctcccacttcatgaaagcaagaatctttgtttgggtcatgctgtgtcactgaaccctaaaggagtgtcttaaacacagtagtgcattattatatttttgtggaatgaataactcatcatgtgcttggcaggcaacattaaagaggatcttcagatttttcagaagagcaagggagaactcccctcacctgctgagctgttggctgtggactccagatcaaagtctgaggaaccactcacctccatttcttggcagtggagagtgagatcaacaagagagataggagaaaatcatggggagactttgagtttagagggtcctgggcagctctctcacaataacagtaaggtagggaagcatctcagagctctttatgcaaaggccctcatccaaaaatcgagaccagatttccatgaccattgctgttgctgttcttactacatctgagctcttccatgccctcttttccctttgatcagtggtgtcagaaagcagatgcatactaacatttaccaattgtaggacatgtcccacaacgaagctcattctgccttcaacaccagagcaagagggaattatgggaagaatattcaccagggtagacttttggggaagtgatgctgaagcctcagtattaaaaacttggagcagtgggggatgtggatgggctttctgaaaaagttttgaatttattagtgaacctgttactcatcccttttggggtgtgggtaatggagtggagggagagccacagctgctttgtgctgagtcatacgcttgtgtttgtactttgccttgcatagaggaatccaaggttgcttcacaatgacttggttaaaattagcactgtcagagagctccgtaaagagtcttgtgaaaagtcttccaaaataaatcaaccttcctgttggggttgagtcatccccttctttcttcaactggaaatgattttaatgggaaggtaagccagtaagatctttttggttgccgattttgaaggtatcattgtgataacacagggtggtaaggcagaaagtgtcagacagtggtagggggtcaaatgttggctgtggcgtaacttgctgtgtgaccttgcatgagtatcataacttttcagagtttcaagtgtcccaaaagtaaaaagtggggctaccaacatctgctttgccgagagacaatagatgtgtaattaagtggagcaatgtatatgaagcatacttcttggcacataaagtccctcaacaaatgggaacagaaatgatattgatcactgctttccacatattcttcaaactaacatgtctcaaagcaagcttatcactctctgccctgctgttttcattgagacctgctgctacttgaattcattgtagctctcaggaaaccatcattcacccaggcatattgatatattgatggctgatcacttctcaattaccactaccaggactttaattctgcccttcaccacttcatacatagaatattttaccaggtttttttttttttttttaactttccccctacctcaaacacctgggagttcacctactagggtggtcccttggttaggatgtcccttacggtttccttcctattctgcttactgtgtggcagttgagtgagcatagcatactactgtatgtcattcagggttatggactcagttactcaattctgcaccccaaccccttgacacagggaagcacagtataggtgctctataaagactggctagaattgaagtatatgggaagctgtgaccaagacgtcctaaaggcatattaaatagtggttgtcaccatctaaaattaccttatttatttcattatttgcatatctatatgtccttgctgccttcattattgtccattttactcctgtatcatgtcacaagaggtagatgtccagacagctcatcattcctcaagtcatacctctaagagagcaggaactgtatctttcctattcatggttatgtctccagaccagagcctggtgcttctagtggccatcttttccaactgtgggaaaaacctgtctgacaatagagccaacacagagaaaagcaaagctgagagatggagaaaaaaggcagagtgctgctgatattgttcaaaccataagatcctggcatgcctgaagtgaacatacccccttggacatcccatatgtgagccaataaattcccatcattgctaaagctaatttgagtggggtttctgccatttgcaataaaaagcaaactgactaatacatcctctcctcagtacctcataaagcttcatgaaaatcaaaaggaactttccatttgcaacaagttattcattctagtatcaaagtttcaacatggttatcctttcctgccttactcaattcaggaatgcaccaataatgatgccactagagagagatttccttggtaatgggctgaagagcacctgatgtggtggtaagggttgctcctttaaataaaggaataagcatttgagctaacacatggatgatgagaagcagccatacatatgcttatctagaggaaaagcattctaagtagaggaaacagcaagcacagaggcccagagacaggaaagaagaagctgattgttggtttaagaactccacagaaggttcatgtggctggatctttgtgaaagaggaggagacatataggaatggagaagaagccaagggccatgtgcacttttcaggagaatgcatgaattcaagattgtctgacttgggacaggagtcaaatgggcggcaacaagggcagcaaagaaggcctgcattcattcagtgaaaatgcagggtggcttgcctggcactgtttcacgcagtgtagctgtacaagatggtgtctgcagggttgtaccagcaaatcaattgctgtactaccaacctagaaaagtcagtgaatcatccttatattttgatcatatagttaaatatattccgtttgatcctttagtaagttagtggagctgaaaataaatggattaggttggagaaataagttaacctctcacattcatcagagcttaatttagtgattgcctccttattgccctagatgggccagtagtatgacccatctcactgtgagtaccttactctgagaattttgctcagtttccaaaaggcagcaccatagatatgaacacacaatgttaataagctggtattatgaagcacatcatactgcaaaaattctgatggtttcatagaatgtgaatatagtagatagaaatgtatttttatttcaaagtcctgggacattatgcttgcaaaataccttgaaatcgtgtttattctctagcattcatagcatccctaaatcattaatatgcacatgttccaaataaggaaactgtctgtcatataggaatattttgtaatgcaatttaattcatctcatttcaacaaatatatatggactgtttgatgtggatttatggtgttgaaagtagactgctttttgtaaggagaatgaatggatgcaggctagagatgaagcggggcatcttacaaagaaatgtttctagtaccatgggttaagtgaaattctaccatgaactacgaaagtgacagtggaaatgaggaataggcaaatacagatatttaaaagcaaaaccatcagggcttggtgacagattagaggtgaagaaatagagaaggacaggaatcaagtatatgtctatgaagtcaactggaaatattgtggtgttcttgatagaagtgggaattcttgaggaactctagtttgggaagatgatgtctagtggacaattggaaggcaggcctagagctgagcagcaaattaagtcctgaagatggacatttttagatcacccccctaaagatgatgactaaagctatggaaatggataagctcatccagtaggtcaatgtagagagagactccccacagattgaggcgtgcagagccctatgcaggccaccttgacataactcaccatacctttccccatgagtgtgattggcacccttggggccattttgatttcggatataagccttgtgctatagaataggaaaatttatgaagacattcaaattctgccattgaaagccagtgtggtatctggataatggacatgttattttgagaaaaaacattgcttacactcaggatattagttagaaatccccaatttagtttcattttttttgtgtgagaaaatatggcagtggaaacattttcagaaatgggaagtcatttcttagagagatttatttggagcatagccagtagcaaaatcagctattgacaccttaagctacagacttaagatgaaaaacaatgatagagaggtcgttttttttgttgttgttgttttgttgtttttttttttttttttgagttccataaggagaacatgattagcctattcttctgattgttttatgtttgcgagttctgtctcctcagttaattttcatcttttctgaagcatgggttctacctcataatttttggatctccctgcagtgcctagcacagtgcagaactagtgtatcacacactcagatatctcttgtggaaaaaaatacatcacaacaagtagaattacaaggttagattcaaaggtccttgaaatgcagtcaagtctgttctcacgcctctgtgcaggatagcaatcaagctgccccataatattgactgtcttcttgtaaatcacaagatatgtttcttaggctgaggcaaaaaggacaagtagagaaaccatagtttcatgggctctttacagctggaagtcagaaataccacgaaagttggaagtaatagtgacaggaaagggtacatgtaggactcacactaaggaacttggtagcatttcttataatacctattcaatcaacattgtcagtaacacggtcagggctacattggagtaagaattaatactattaaaagaaataataaatatgcaaataacctgaaaaatatccgtagtatttaccacctgaattcacacagtgaaatgaagcctttacacactttggagttcacattgcacaacttctgcatggtggtagtgatgagtgcatgaatgttctaacccaattcgttttctatgacctcttaattccctctaggaacttttgtgaaaaaaatgtcatgctcagtagagattgcttttgatgtaagtaatacttagtggtttggtaggtaaatattagctaatttttgagtgctaactatgtacctggcaccagactgagacttttacatagattattttatttaatgctgataatggccctctgaagtaggttttatcatttgtatttttatagataagaaagtaaaggcttagagaggccatgtaatttgtctgagggtatacatgaagtaagtggcagagctagtggtcagctaaacctaaaatccatgctcttaagagaactaggctaaactgcttacataatatattaactacattaaaattgataccagttcttttgtgcatagttggccgagttcatagagacttgccaagaactgttgaaacctttatctacagagataaggtagacagtagagaagaccaggagcacttggaccatatttcccagcagttactctcacctcgctcgtccagtcctttctctatcattacaacattgaacactagtaatacaactctgtggcagagttgatagcacatcagttatccccatttaccttctgtgtgatagcatttcatggtattatatgaaattatctaaaggatgatatgatttgatgttgctaaagtgaagaaaaccaccaaaggtagacttgttctcatttaagaaaaagcctccataggttaacttgaataatcttcagcttgtcttgtgggaccatgtcaaattaatttcagctgatgctgtataggaaggaacaacctttatcatcatcattatcataaattcataccagtcattattccattcatagtatatgccaggtgagttatgttcattattttaatcaatcttacgaaaaaaactctctaaaaacagggatttttatgctgacttcataaaagaggaaatagatactctgagagattgacagtcccatgatcatatagctaattagtgacagtcatatgatttaaatgagttatgcttgacttcaaacctgttttttctattactattattatttaactatgatcacaaaataatttaaacatacagtgttggtgcagaaatattacctactctcacttgcctgctgacaagataaacaaatgtcatttggcctactttgcctcaaatctactctcccctcttcttaatttttaaaaaatttttattttgaaataactataaattcacagaagattgcaaacaaatacacagaaaagtcctatacaacattccccagcctcctccagtattagcatataacataattatagtacaatatcaaaaccattggtaaaatctttagagctttcccagatttcaccagttaaacatgagcccctttgtgtttttctgtgtgttgttttatgtaattttatcatatgtgttgtctcatgtaaccaccgtgacagttaacatactccactatacagaagactgttctgtgctactcctttacagccatattcatctcctctctcttctccctaatccctggcaactaagttgtcctacatatctacaattattatttcacaagtactagataaaagaaattatatagtatgtaaccttttgaaattgacctttttaactcagcaacaatttccttcagatgtatccaagttgttgcatgcagttgtgtcggtttacccattgaaagacgtttgaataatttacaatttacaaaatttatttatttttctaggataaatgcccaagagtgcagttgttgagtcgtatgataagttcatatttagttttgaaaggcactgccaaactatttttctgagtttttgtaccatcttcctcttattaatttacactttcgagattatatgtgataaagtcattagagctttctcttccttgaaatttccatttatataatttgcccgtctttttctaatgagatttttggcctctttcttgctgatttgttagagttcttttttaaattattagcactaatcctcgttaaatataccacaaatgttgtcctgtctgtgacctgttagtttgtacgtggtgtattttttcatgcatacattttaaattttaatgtagcaatgtttatcagtcatttcctttatggtttgtggtttttgtgatcttacataataaattcctttgcatttttttccataggtaagcccctagggaccaaacagcctctttgctcttaattgatacacagtattaatacttctgctgatctaatttggaagcacctcataagttagaattacactggaaggcataagggaaattctacagacagatactctgatggcaacaaatgatgatttttcaggccatctcaattaattctactttcttccagttggtcatctacttttggtcatccttcagtgctcaaatattaactcctctgcgaagcctttcattacattcctcaagacttgttttgagctcctgctttatgtttaatcatcatcttgtgctaccctccttattgtacttctcacactgcagtgtagctgtatgtttactcacctgtgtcccccaaccaactgtagattgcatgagagaagagactgtgacttgtttaatagttgtatccctcagtgcagtgtctgatggatagtaagtgatcagtgaccctttatcaaatgtggggatgaaagagatgcattcaaaataagcagacctaagacctcacagagcaaagcagccttagtgtgcttagttcaaaggcaaattcccttatagtccatgggtccattcctcatgagagaagcaggactggccagagctctgtagtctgacctgcttagaacagtgaataagggtctgggggccacaggatgcagtgtgggggatttgtgctcaaggcagtgaagaccttggtaataaaaggggttgtttaatcatgacagagtgaaggaaaaccaaagtccaattcccagagtatgtacgaataacaaggctcagtgtcaaaagccaagagctgcattaaaataatactgaagcacaagaaaacaggaaatcctatttttttttttgtcttctgtttaaagaagcagagaattgtgtcaattgttttggaaaggttttagtccaaaatggttaaactatctgttggtatgattcgtctccccatcataggcacagacacatgttctttccaagggagatggatcagactctataaaattcctagtacctccttatgtcagatgaagtaataatggacattcctttcagattcatcataactcaggaagattgttctgatggtaagtgagggaaaatagaacctcctttcgagtcaattcctgctgcttctggactttgccattatgaagcaaaaagtctgtttttaattagagacctgaaagcctaattttatgccatggtaacctgtgggatctgaaatacacacccccagatgttgcctgtagcaaaatatgttcatagcaaaggcaacttaaaagtaaaaaaaggaaaaataaagcataactccaaggaagcagaagatataaagaacacactttgataatctttagtgaacttgaagcaattgtccaaaagtgagctatcatttagaatttattgtaaatgataggaaaataaaataccttgagtgggacttgctgctcaaaaagtaaagtgaagtgtgggtgtcttagttagctggggctactgtaacaaaataccacagactgagtggattaaagaataggcatttatctcccacatttctggaggctgaaagtccaaggtcagggtgccagaattgttgagttctggtgagggctgccttcttggttgcagatcgctaccttcttgctgtaccttcacatggtgaatagaggatagtctggtatctcttcctcttcttgtgagaacagtaattataggggcttttcctcacaaacccatttaaccttaattacctctcaaaggactcagctcctagtatcatcacattgcaggttagggcttcaacatatgaatttgggagggatacagacattcagtccataacagtgcaggaggcaaaaactaaacgtgcattttcctaagtgttaggccacttagtaattcaatataatgctgctctctttttctttatttctcattttttttgcataattaatagtattatatgaacccacttacatagttatagtcagggtcagctttaaaacaaaactttcacgtcttctactatcttgctgttccctctctttccctcttttcccttcactcgtgctccctccatccatttggttttgtttgggtaatttagggataatctgatttagtaaaaacagctttggtccagaagccgggacaccttgactgtgccactaactcactatgtgaacttgggcacatttctttttctttgtagaaatcagtgttctaatctgtaccaagagtaggttggataacttggtctctaaagtttcatttgcttctgctcatattggtctcactgaaatatgatcagtactcagttgaatattgatgtgatacctgaatagcatgtagaatgtgatcagtctcttaggcgaagcagctttttttagagaatttaatttgttataaagcagttaacttgctctgccagtttcatattaatatttcactgaatgatatctttgtcaacatcagaaatagataatgagtttataatcaatatgatgtcttgaaagctggcctttttctgattcattgctgtccctgtctgatggtggtctatcaaaatgcagaccctttctttgcatcataatcagacatacctgtaagctttcccacattaaatgaagactgtttcttctttgatctagtttaaacagatcagggattgcaaatgagctcatttcacttgtcaactccaatcaattgtggaaatataacaggagtccgtatttagaagtattgtgaaaagtgttttgggcactgtgcactaagaattgtcagagtgtcccatatgtcaggagtttgctatcctagacttggagagtgagattttcaagtcatctcctgctgtcttgcaatcgactcactgcgaattatggaacagatgttgctctgtgatcaacaggtctcccaaagctctggaggcacctttatgcaacaccagcaggaccaattgaaaaagaaattacccaaacattacagagctgcttgctgttcatatcttgcagcttctaatgacccaaaacaaagatgtatttatataatttatttgctatggaatgggtaagaattaaatgtgatcagtgaaggtactaggaccagaagaacttagagaagccaacagagttcaccatttaaatttacctaccatttgttcaataaatactataagccaggcatttttaaagacactttagttcacatctaatccttcaaaaattctgtgatggaaatggagaggtttaagtagttttccaaagttcatatctcaagaaatgagcatttttacatctctgaagagggggtataaaaattggtgacaatgatgaagagaagaccatggacccgtcagcctgaactcttgaagatttgggattactcatctgtagatcccatctgacaacagatgttgataagacacaaatacctgttgaagctttagtggatcaataaataacaccccttcattccccatttgagtcttgaaaaaatgagggaaagtgtgaggtagataaaggtgaaaatatcacctcaatttttggtaaagctgcttgtagaacatagattaggtcggtggccaagcaaacaagaatgcatgctccttcaagcaagcagttagcaagaatgagaaaggaactcaatcgaatatgtccaatttcttcttccaagtttattggatctgataatgaggataagtgtcttaagtcagcttcttcctaaagtaggccctgagacaggatctgagttccagtggtttctttgggaggtgatttccagagcaccagtaatggagtagggaaatgaaacagggaagaaaggaatttatttaagccaatataaagtatattaatgagcaactggagctcagtcatcctgggaaccctaggaattgtgcagaacatgcctctgagttgaaaaaactggagtagccattcactaactgctatcagtcatggctaagggctcctcctaggaatgtcaactccctggaaattactaactctctagcttactctatgcccaggctgatcaagcttctggggccagagaatgcactctggcaggcagaaattgcaaataattgccataaagaattgtccatgtgcacaggagcaggcagtgccaagtggttaccagtggagtatagatggtgatacatttgtcatgggacctgaaacaacccagtggattttctaagataaactaaaactaactaaactaaacttggagcagttttcctactacttccttttctctgcaaggaattctcagcagggcctttccaacataagcatgggaggtctttttgtacaaataaaaaagattatttttccttatttcttatatttttctgtttgtaaggcaaaaaaaaaaaaaaaaaagtccaacacaagcttcgaaactagtgaggtcttggctgtacaaaacctttggaaaccattggtggttttggaagctgccaatgtgctgtcaggcagattgaatctaaagaaaaacgcagagatgaatgtttcccatgccatgaataccccaaccctgctgtctggggaatctgagaaggaaggcagcatgaagggctagactttcactttttgcaaatggtttcagaaagagcaggctgagaccacaaagttggagtaacatacagtgtgggatagctgcaaaataatggtaggagaaggattcatgaaaatgggatggggccagaaggattgtaatggtatttgtgtgaaaggcaatggcagctcggggggcacaagtaggaggaaccatcccatctagtatcctgttgcctggatctcaatactttattggccatgagctacttgctgtccaggggagtggtaagaggtgaggataaggtgctctctcagtaggagccttgagcgtaggatctctgagaagactgatgattgatttgtaattagtgaatggattttgtcaaagtcttatgaaaattttccatgatgttttgcattttctttatttttaaggcccggaaggggaggaattatctcagtggtggccttgccctcattaatgaggcattagctcacctggttcaagcacagtacaaagaatactaacagaataacagtgagagccttccctgagggttggtctggatgtaatcctggggtggagacatgttgtttctattaagttatttcatcctggagtcttatctttgcaccagaaacccaaaacaaaaaattcttctaatcataaggattggaaaaaacagtcaagtcatattattatgttctaagattgatgttaaaatactccttgttcgccctgatagttttctttccttccttccttccttccttccttccttccttccttccttccttccttccttccttccttccttcctccatccctccttccctccctccctctctctctctttttcttctcttctcttctcttttcttttctttccccttcctgacttgtttattgctgtgattctgagtaatctaattcaccaagttttcacaagtctaacagtaacccaactacaattgggacttctaaatagtagatgtggccgggtgcggtggctcacgcctgtaatccagcactttgggaggccgaggcaggcagatcacaaggtcaggagtttgaggccggcctggccagtatggtgaaaccccgtctctactaaaaatacaaaaattagccaggtgtagtggcacacgcctgtagtcccagctactcgggaggctgaggcagaagaattgcttgaactcgggaggcggaggttgcagtgagccaagatcaacagagtgagactccatctcaaaaaaaaaaaaaaaaaaaaaaaaaagtagatgctttttctttccaggtgcaagagaagaaaatcataacaaggtccttcccttaaaagtaaaatgatgctgtctggttacaaatgggtttgagatgtagtgaaattttgtttacagtttattgctgtggaatgatatcttgggtttaaatgagctgtctttgctaggggtttgttttcttttcataccaggacaacacaagagtgaaaacctggctttgaggaaatgtcagggccaaacactgcgtgcaaatagaggaagggtcaggatgctctcttccagagacttgttcaggactctttaaaggggttcattttccctggatgcagactgaaaactatccacatcattccccaacccccactgccattttgaatggcaacttcatggcaaagcagaacagaatctgggagtgagagttcgaatcctacatctttgcagttacataaatccatgatgttaatcatagctgcccaacagaatctcttgggagcctactaaaatgcaaataactgggtagttttgccaagctattgattcagtgggttttgggtagggcttggaatctgtgttctttaatctgctcgttaggccacccaattttgatcaacttccatcaatcttttactctaagttgattaaatagtgatatatttatagaagtttctaactctaattcagtagcatttttctttatttcctttgtatggacaactggcttgttaatatgccttcagagcccaagtctctgaagtcagtgttctcttctcagcactgcctctgatttgaaggatgacctttaacatctcaatggttgagtctttccctgtttcctatgtggacctaaccactcttttttagcatgctgaatgccgacagaaaacgattgtgaaaagttcaaaatgtaaattgccatggaaacattatagcactggtaaaacatgtattctcagtagataaaggggaagacagattggggtgaatgaagctatccattcatcaaccttggattaatcaatctctgcttgtcatcttaaacagaaggattttaaaggaattatggatttcaggtcagaatttgtctggtttagtattttttatttcaactccaaacatttttataaaatgtgccatgctacttctgggatatataaaaataccagtctccaagatagtaggaaagctgtttgctcagagaccaagggtgttactcccttttacttcaaaccaggaagctggaaggagctattctgttacgatatgtattggacatttccatatgcatttaagtcaaggaattattcctgagtatcttctgagacagggtgttattctgggtgtttcggaacatatagatgtgaggaatatgcagtctccactttgacaagtttacagatggttgcaaagttttgggtaaaggtaaattattagctgcctgtgatacaagataaaatatttgccatggagattcagagcagtgaaggcccttgcatgttgggagaacgagcaaatacttccaagtgggaaattagatttgagatagactgtttttttttaacttttattttaatttcaggggtacatgtgcaggtttgttatataggtaaacttgtgttgtgggagtttgttgtacgtattatttcatcactcaggtattaagcctagtatccattaattatttttcctaatcttctccctgcctccccccaccactctctggtaggccccagtgtgtgttgcccccctctgtgtgtccatgtgtcctcatcgtttagctcccacttataagtgagaacatgtggtatttagttttctgttcctgcattagtttgctagggatgatggcctccagctccatccatgtccctgcaaaggacatgatgagatagactttgaaaaacacacaggatttgaccagacacaggcattctcactacagaaaaaagctggaacaatggcctggaggtgcgctcaggcaaagtatgtatgaaattgtcttcaaaatctactgcaagactttcagatttccctggaaatgagataattgctcctttattgacataagttggggttcattttactatttagtcacctgaggatatgttagttatcccagcatcccagcacctcctttgcttgaaaaaaatccttagtgctggggcctttgagctgtgggagtgaatgaataggcatgggaccaaattgtaggacactggtaagtatcctgcactgggatactgacatagaggccaataggtttaggaaagccaaacaacctgcttacctcacagtataaatgaaaaagcctgggctttggaaatcagatcagcctggatttcaatcctggttcttgctattaatgttttcctaggcacattatttaatcattaaatataatgtctgtcatgtagctgatacagttggtatattataaattttcaataaattaattacctgggtcctgtgtgtagagaccatgtttcaaggagggatggtagatgctcacctgggtttccatagagccaaagtatatttctcttgctgttttatagcatactctgtctccttcaaatctcagctttttgcttggctctagccaagattggaatgttcccttaaatatttctgatctagcagaaagaccagcctttcagaacttgcagtggcttcctttgttgacattagattcatttgggacttctttaagttgatgctgccatcttcctatgctttggcctctactttgaactttctaatcttgctggttttgccctatctgcttgggaatttgaccacaacagtaccaaggtaccaatgtcacctctaggctaaactaatgtcttcttgtaacttggtcttttcatatggcacatcttgccaatcttatgggttgctctttgtgatcaaaaatgaccaacctgatcatgacggagggtattgggcaccagtctggggccagtgtgagtatttcttgagcttgaggtggactccttaaccttgaagactcctaacatgatgtccttatgtcctttagccaaatgcaggaagacctgtggtacatagcttgatcttgtctctttatactctaaacaagctggtgggctagattaacttcttcaggccatcctgactctctggcttttctttgaactgtctctggggcttttgagcagcctctggactccatgatggaatgggaagtttgtgatataagagctatgatacactaacttaatttttttttgctcctgtgtttcccagactcattagattatggcacactcctgctcatgtgcatgccaattcacatatatacccaccaaatgcctgctaacatattcagataatgtttttctctcactttggaaaaatgtcctagtttaatcctcataaacatgctgtgaaatggatttattatctcccttttatggatgcagaaatggagtttaaagaacttacaggatttgtccaacatcacctaactgtaagttgcagagttgtacacactaattagtaatcccgctgctctttgaccacactcactgtgcctgcatgcattagccctgctattggcccttgtgataaaaatgtcatgctagcacaaagttgggaaacaatacccttccatagggtggccatgccaatcagaagccaatgttacctctcttaatcttaaagcatgaatgggctctacttcaggtctaattgaactgagaccataaaaccaaattgagaaggctccatgggtgtgtcatttagtctcacatccaggagctttccattgggtctgctgccacatttacctctctctgggttttgggacattctcacatggaaggagccgagatcgtggcataattaccacctgctccatttgggtactctgtcggcttctacatctaccctcaagtctcccactccgggtgagagcaatggtagaggcttttgtagtgctgatcattatctccatccccgggaaacaggaaaacagcacaatagcaaaatccttttggctataagatttcctgtccctaagtcacagaggaaaaccacataaagacaactagaagctcagtaacccccagcaaacctagctatgcacatttagcatgtctaagcagccttaggttcaaattctggtacattgctgtgtttctctgagcctcagtttcagcattcataaaatggggataataatacttgtttccatttcatagtgtgattcaaggagataattgatgtactatgttctgtgtatgtctgatggacactctaaggcagaatttgaaataaagacattgcttcagctgaaggcagatgttaggaatagtttgttgttaatcccaccctttggcaacaaagacatttcaacatccagtatcaggctgactgtgactcacaaatgaattcagaataatagcaatacctgtgagctctcagactggcagtcagaaccctgctgaaaggattagcgcccgcagcacatggcaactctggtaatggtgacttgaagaagtagtaatgtctcagctctttaaattgtgtgtttttttaactaatataatttttaaaaacttcattagcagcacagaatgttagaactgaaggatcttccttatccctgcctctccttttacagatgggaaaactaaggaccctcaaaagggactgtacctggcttcaaagtgacagaagtaatagatgacaaaaatgagattctaacttgatctcttgtataatgtcaatattctgattttacatgctcattagataaaattgaaaaaaaaaaaaaagaaaatgatggccaggcacggtggctcacgcctgtaatcccagcactttgggagccaaggtgggcggatcatgaggtcaggagatcgagaccatcctggctaacacggtgaaaccccgtttctactaaaaatacaaaaaaaaaaaaatttagccgggcgcagtggcgggtgcctgttgtcccagttactcgggaggctgaggcaggagaatggcatgaaccttggaggcagagcttgcagtgagccgagatagcgccactgcagtccaacctgggtgaaagaacgagtctccgtctcaaaaaaaaaaaaaaaaagaaaatgattaagaagaaaaagatcaccaataatcctactctacagacatatacatcattaacattttggtgtatttgatgcaccaaatagcaaatacctctctttctgtcttctctgtgtgttcattttctttcacctgttcagaaacattaaaactcaggtcttctgacttcacgctcagtgctttctcttagcatatcaggctgcctttctaatcagcattcttatttgatatttagtaaccaagagttaggttttaaattctcaaaaccaagtaaagctgccagtgaaaccccatgtgtatatggctcattaagaaaacaggtgtaataatgaaatcatgaataaatagatcaccaaaatggcctagatcagagagccaagcatgatgctagacagaggtgtctcaaaaagcacagccacatccctgccctcaaggagcatgctcagtggcatgacctctatctgaaacaagggctgtctgcctgtgctcatcccagctcagaaatgaagcagaaaatgaaaaggccacatgggatgcttcctacagtcctgttaatgtcaggagtgcaatgcctaggccctaggcattttgactcagcttcagttctctctcccaaggctgaattactagaactccagctgcagcctgaactttaactccctgttctcttcccaacccacaatcttgttatcagtctgattctgatctgttagggagaggggagggggagctagcagagatgtgactaagggcaattgagataggtcagaatggccttgcagtatattctgtcttagtgaaggttttgctaaaccattgctgcactggggagagagtaggagaacccctgcctccttgtccgcattcccttagttaagctgagctaagatgatccctccaagcttttcctaacagggaatctacattctctgtgtcttgctggctggccacaattccttggggaggcaggagctaactctaccgtcctagccaacttgaataataggaaataaatgggatggagagccaggcagcctctttgttacacagcacgttagtgaagcagctatctatttttagaagagggggaaaaagtagtagcttactcttttgggatcagcaggtggaataatgatctgccaaattttaacattcaagattttttagctgggctacaaatgagacagacttttgtgcctgcctcagtgcaatgctgtcagtgtaatcgcacatccctgggcaactaaaacatgaacgctggggaaaggagatataggactccatgtcacagaactgaaggctgagggtgcatgctataccaatagcctgattgatttaattagaaaaaaaataggtggcctagtcaccaggagtattgaaacctcagatctctgctcaaatgttacactcagtgaggttttccttggcattctattaaaagtaacgcttgccgatgacgcttcttttagcctgcattattgttctttcctgtacgtatcgctacctgacattgctttttatctgtttattaatttttctattttctgtctcagccactggaatgtagggctcaaaaagacagaggcttgcctttgttcactgctatgtccccacggcctagaactatgcccagcacatgataggtgctcaggaaatatatgttgaatgaattaatgaatgaacatgtgaatgaataaacttagtatccaatagacaatgagtatgccaataaaaatgacaagagcaattaataattattgcatgctgcacattaactcacttaatcctcacagtaactctgcatggtacatactgtccttattttcattttacatttaaggaaaattagacttgggggttaagtgacttgcctccgtggcctttgggtcacagcatgaataaataatacagccagggtttgatcatcagcctggggacaatgattccagacatatcagactgagcattcacttaatagtattttgcattggttttttggaatttccttccatgattcttacctggccctgtaaaactctttcgataaaatgaccatatgagatggatgtttcatttccatctgcttaacctatagcatccatggacttgtcattataaactccaaccagaagagcaggatatgcctcattgttctgtgacaaaaagaacccattgaacattttttggcttagctgtggttcattggtgaagctagatcagatagagaatggtggtttcttccttaaaggtttaagaataaggattaatggctattctgacatgctctaatgtggactttctcccactggatccacgacctaaacaaccacgtttcccaacttaaagtgttttgcaaagccagagcatgtcagggcttcctggtcatgtttttagtcactttcattcacaaaagtgaaatttgtttgtactcccttctccccaaataaaatgcaacaaaaatacatcagaccacaaaatcacacctagtaaaagctgcccactgagctctctagggcagtgcatattcatttatacgtgcatccaaaagttgtcaaggtccccttagagtcttattgccttctggggtctcccatgcactgtcaaccacgtggcttagggagtatatggagtctcatttttatcctgagcatagtttatccacatggcaatatctggtatattccattgtcagagtagtcacattatcttgtgcttataaaaattaaagtctctattatgtgtttgtattataattacctaattaaatagttttattattccttttagaggagacctacatttgagtgagaggctctgttttcatgcaaaattcaaggggtcactgctctgttttcaaagaacaggcaagctctaggaccgtctactccatgggttctgtgctcagtaaggtccctgtcccaagaatcccagattttaggggaattctacgccactcaacccaatctggacatagagtccatctcagtgtacagaccactgccagatttcttaagtcattcttctttctttccgtcaggtttggtcataattgtacttacgtttactgtgagttaactgagatttcaaaatccttttcaatatttcatattgatttgcaggtaacgactaaatctctaatagaaagagtcctgacacttagattcctgtcacattagagaaaaatctattttttaccaagtttcactttcaacatattctactagttcaagtcataaattgtcaaggaagaaaaaaggcccatgtgatttgttctcttggagcgcgcatgtcccttttcccaactaactcagaggttctcatcctggctgcatatgaaactcatttgagagggcttctaaaaattaccagtgtccagcctccaggttctaccacaggccaagcaacttagaatgtctcagggtaaggcctaggaggatttaaatgtgcacccaagagtgagaaccactgaattacagaatttctaatgctgtccaccaccagagtttatttgtgcagccagtgcaagttgagcaccacttatctagaatggaagtgtcttaagggaaggccctatattttatctgttttcccagtgcctagcaaagggcttggaccctggtaggtgctcagcctcatatgtggaagataacagctattcgaagcaattcaatttgtgtcaaacaccttatgtcattgccagaaacatcaacacagttccaactacatttcatttaaaagatactgcccccctcgcccaccccacacaaccacgatacacacacaaattctaaatgtcatcctgggagttgcaaagtgcttctttgaaatcttatttgtgctgcttctgtgtatccatacttaaagtatcttgacacgagccactgtctttttgtgcttgaaattgtctttaacatattttactttgacattagtatttactaggtttttgttcatatatctcttttctaaagctctgggagaaagagaggcagaacaatcatatctgccaaatggaaagaagactttaaaatatatatatagctagaaactttcacctagagaatcaatctctatccatttatacatagtcaatcataactgccactgtggccttcctttgtttccccttcctacctaccatgcatatacacctgctcacagaagcattgttgggccagtatttgagacttgaggtgcccagaattgtatcattctgctattgagcagcatagaatactctattttgggggagaaagaatatgtgaaataaacagagcaaatatgcaaggtaatttagtttaaaataaatgctacagtagtcataagaggcaagaattttctcaagttttaatagagggagcagataccttgactctactataatagaactaagatgggcatagaggcctgggaaggcatcttggataagtggaaagcaagatcatgggtgtggagctagaaatgaggtggatatttgggaaaagtttgtctcaaatataatggtagttgtgtccgtttaatctacttgttggggtttggagacttcttatttggaaggagcagtgatcatgatgcagcctaaggtccacttgaaccactcctttctgttttgagaaacaaagataccaaccaccagtgaaaataagatgctttgaatactcaagagaaactcattctcagcctgacctgcaatgtggtagagatgcttggggagagtgctgggttatgccctgttaaacagttgtagacatctcgacgccataagaaatcattttcctggaccagattgattgctttcagctgatagagtatagttttattggttcctactcattttgccattttatatttttatagacttgtcagttttcttgtcttcctttctacaataacatttatccagtagtatatcaaccttaaaatttgattgttggcatattcagtaatgggaatttagaaatccactttttattgatgtcctagaagtttgtatgcaaggaagaatcattaagcttgtcctttgatgatggacaaaatctagtaattagtatttttttttcatttttaattgtcaactggcttttaaactttagatctttttttctccttgttcttttcactatgctctaaaacaatagctaatctcagcttctatgaaattgatctttatttaaaactaagaatgtttagtcaaatgtggtaatgggttccttaaaggcacttatacatgattttgtggttttacttaggcatttaggtgatgctgcatataatttgtattaaagagaggccattagcaaacatatatagacttccttcatagatttcaaaaaaccattacccaaataaatgtatttttggtatttaaatattcctaccaagagttttctttgcagagttttaatcaatatgattttgtattcctcctcttttatcctttctacttgttgttatcacagtgatagaaaaaaaatgaggaagtaaaactccaatttagattttgttcctacccccaaaatagctaaaaagttgatggagagaatgttaaaattattagttaaaatgagactgtgagagtatctgtggaaaggaaaacgttaaggggtgatcaaactgttagaaaaggagggatggtttccttcagagaacaagaagatcatatgagaacaagattgaattactcaaataagtgaaatataccctcactttgttttcaagcttataggccacattaagaacatttctgtattatacaaaatgggtgcaacatttatcccttgctataaccatcaaaataacctgtgttgagtgctttgctctagcagtctaacagaaatatctgacatccttaaatctgcaactcaacaggctaaaagaccggaaaatagatttctgcattaccagtcaaacactcagaaccataatcaaactttccctttctgttattttactggtttttcttaaaatgtcaggaagtatgattagcttcacaaatcttaaactattcagtttctctactctcctcccaatacttgtaaggaacttagagtgttttaactttgatctcccaattactacataccaaattattgtctgtcagtatttagttctaccttacttccacaattcctccattagccattatttcttttaatatttacagttagtgtttatttaaattcactagcaacttctttgcttgccgtttttttcttacatcctactccatgccttttgtttaaactacagtgtatccttttagtgaagtttttataagcaatgaactctctcagttttatttttttctgagattgaaatttcactttcactggtttaatgatgggttagctggatggagatatctcagtccccaccaacaacctcagtactttaaaaatactactccatttggtgctgatgagaagtctattaatacaagtttgccagggggataaatcatggaagagagaaaggaaacactttatatccaaaggctcagagattcaagagagtctaggtgcctggggacgaccatatcaatagctcctgtcaagtggaatgctataaacatcaaaggaataggtaatcctctgccctggcctcttgcacaggcacttgtgccctcaacacactgagctccccactttcccatgcaagtttcctgatgattacaaagagatgcaggacctatgggcttagggtctgtgacagaactaccaggcttgggtaaagttccagcaaacagccccaccgtgcgcttcatcatttcataaatgcgtatcagtccagatgctaaattctgaaactggagaggaaagaggaataaccaacttaaaaaaacaaaagcagttctagcatgccttttagcacatacttactgattatgtgccagaaaatatgctgaggatacagcagtgcacagaccacatccctattcatgtgtatcttatgtgccaaagtgaggagacagaataaatgtggaagccaatatacacctaatgtctaaaagtcatcaatgttctaaagaaacacagcaaggtgagtggacagggaataattggagagcacttctttacttaaggtggggtcgagttggtattaagaatgagacccaaatgataagaaggggctagcctcatcaaggaaagaggttaatgagtgatccaggccaagggcagaggaattgcaaagcctctatggcagggacatgttgattatgttcaaagggcagaaaaaaagcagtgaactaggggaagagtcagaggagataaggccagggaagtggccaggggtaatgtcatataaagccttgtaggccatgccaaggggtttgggttttcttctgcatgacatgggaagccattggacagttttaagtgagaggcaacacaatcagatttcagtttttaaaggcttgctctgatgattatatgaataattgagtagaaggggctgaaaatgcagaaggggagatatattgggaagctattagaatctagcagaggagtagtggcatcttggactagggttgtggctgtgaggatgatgagagtgatcagatttgggacctgtttttgacatagagctcatgggaactgctggtggattggaattgagggtgtgtgggaaggagagatacccagattctctactgtgttcctggatagtaccttttattgagatggagaagattaagagaaggaacagaggtggaaggatgagtataaagagttgcagttttgagggatggagggatgagaatggagatactgtgtaagaatggtttgttgaggagtttggacatgatcctgtctggatccctgagttagtggagttttagacattagtaagtgacatggtcagcttatggtatgtaaatgcagctgagagtccagtgggagcctcaaaatattgactggtgctcttgaatcacattacattttcaattagtaaaaagaacctgactgacttaccaggcctggtaggacatctcatcatttttagctttaattctccttccttttctcttctcccattttttttatctccaaaaccgagctcctttcatgagaataaacccagggcatatgcacatatactcacacgcatagacacttacatattcatatacgtacataactgtgctatttctaattttctgaccaaaaatgagtgacctcacttagggaggtggactagctagttgtctgcttcatgcttctaattgcaggcaatttcttgagggcggtgggaactagttatccatttattaattaccttaagaaaagctaaaaatattctttttggggtaaatacactgcatagaaggttcttttttggagaaatccaagatggagggcatcctgagctggtatcattcagttcattcttgtcttggcccatcatgtacatagttttgaaacttctttctctaattctggcagcttcctggtttgagatccagaaagcttttctgggtatgtgtatcgtggaccaagtagcctcagtttctcatgaaatcttgcaagcatttcaagaatgtcaactttggcaagcattctccccaagaaatggagagaattgtgccgatatggctggctttttgtgctaaggaaagggatgataaagtgaccttacccagcacctggaaggatgccccatgggatatgagtgcagggtatagtctggacagggtgctatgctgcacatgacagggggattgtaattggcttaacaaccatgacattgaaatttgtatttaaatacaagcttccatttccccatgtttctcctactcatgcatatcaaccttagcctatagccagtaactgttgagtttctacatgttcttataacccaacccccccaaaaaacacaagctttttttctcatctgagtctttccaatatgcaagccaaagcagcaactgacttagccttgaataaaagactaaataaaagctagagaacctgagaaaacatgagagacacagcattgaatctggtttctaattccatggacttgacggctggaatcgtgatggagcagggaggggaggccagtcccaccagtgtgaaagtaaacaccagaaagatttttcctcagtaaaaggagatgttccaagcattttagtgtgacaacctccttctgagcctttgataggggcatagaagagagaataagagagaagagaagggaggcaacaataaatcaccaaagagcttttgtcaattatttctccctcaaactgccaattgcacaggaaaggcagatgacgcaaattctctcctttccatctataaaattgctctaatattttatgaagatgttaaaagaaatgattctcttttttatcctctccctctcacgaatctcccccttcccaacaaacttggggcatttaatcacctctcaatattatttaaaccttctatgaaaaaaaatctatgaatgcttcaaaatagtaaaaggacacagaggggaaaaaagggagtctggacacattgactgaaggtgaaataattctttgtgtttctttttcaaagaactgggacataaagtgggtgctgggcctttcatggtccttgcacttacatgtttgcctcagtgagtgagtagaaggaaatgagacaaaagcatccattgaatccacatataccaagcgtctacttagcacgtggtaaattgcctggcctggcccccactagatgttcaagaaatatttatgaaccaactacttttagctttgaccctgtactagtcactgatgacgcataagtaaataatataggtagtgcttgcactcaaacaactcatacattttaggtagttaaagggtgtgcaatggaatgctgttcataccccctccctttctcctgcttgtttgcagctctactaggaagtcataatttgtattgttgttgttaatgtcagaggatgcatttttaaatagaagagcaaatatgcctcttgtagcgggagaaagatcccatggcatttatttaggcaagtgggatttaacttcagaggcagctgatgttctgtctaagctttgtacatgtggtgtgatttgtcagcagtgctactgaaagcctgagagggtgttccctgatccatgaggtgtttgtgagagtcctatgaatatttgacctcatcaagataaaacaaaggtatgggcttttgggttcctttatcacagagataataattctgattcagatctgaatctggaccagtgcccaggctgtgaagtgcattcttatgacaaattgccatggctgatcatgcaagccctagatgtggtgtgagggctgagactcatcaacctcatagtagtttggtggtgtgaactctttggttctgtgcctgctgtgctcagcttaatcagcaagtgtgcccagcctcagacggacccttaaagtcttccagatccaacacgatggaaatagtgctggcccagcagacagagatatgacaagtgtgtagcatctgctgtggctggctctgcttccctgatgcttcactggtaggtttttcttctagattctcaacaactctacctgatgtcatgtggccttagaacttgctcacataattgttcatagcagttagtgatcaacagaatgtgaaccattccaagactgagatccatattcacttagccaagcaaggctgaatagagtcccaggcccttccaatatgcaagccaaaggagcaacagacttagccttgaataaagaaaaaaaaaactgaaaataagctgggcgtggtggctcacctctgtaatcccagcactttcgtaggccaaagcgggcagatcacttgagcccaggaattggagaccagcctgggcaacatggcgaaaccccatctctacaaaaaatacaaaaattagctgggcatggtagtgtgcacctgtagtcccagctactctggaggctgaggtggaagaatgtcttgagcctgggaggcggaggttgcagtgagccaagatcataccactgcaccccagcctaggtgacagagccagaccctgtctcaaggtgcattttctgtcttgcctctgaagtggccccaacatgtacatgctacacgtcccgtgttcccacccccggaactttagactggatccaggatttaggtgctcaccgtcatctgccatcatctacgtgatctcattacttttctgtcaaatatgccatagctactgcagtggtgtcctgagggataggtagggcacattcagacagagtggcacaggtaaggttgagggaggcattccaggaaggaggaatggcatgtaaaagtgtcagatgtcgaagggcaattattttcccatttaacaaacaaggacactgatgtttagagaagttagacatcctgcttaagttaacatagctaaaagcacagccaagattcaagctcaagtctgcctaactccaaagcctgtttatttgtacatatgctgtcttatgaaggatagggtgaggagtttggatatatcttataagaagtcgggagccattgaatggttagagaggagacttagatgatgaaatcaatgttttatgaagattaatttggcggccatgtgcaggatggattaggaaagtgagaggctagaatagagactggttggtgaaagaaaagtataggtgaaaatgatttatgactcattattgtgtactgagctattgatatttaattcccctatcatagtatttatctcaagtatattttttaacttttattttaaattgacaagtagtattggtacatatttatggggtacaatgtgacgttttgagatataaataaaaatatatatacacacacacacaaattgtggaatgattaatcaagctaattaacatatccatcatctcatatacttaccatttttatagtgagaatatttgaaatttactattagcaattgtgaaaagtacactacattattattatagtcagcatgctgtgcaataaatctcacaaatgtattcctcctaattgaaatgctgtaccctttaatctttgtaccctttgagcccaggagttcaagaccttcttccatccccaacctctgataattcttctctctatttctatgagttcaacattttaaaatttcacatgtatgtgatatcatgcagtatttgaccttgtgtgcctggcttatttcacttagcctaagtttttcaggttcatgaatgttgtagcatgtgataaaatttccttatattttgtggctgaatagtattccactgtgtatatatgtcacattttcttcatctattcatccattgatggacattcattgactccttatcttgcctattgtgaataaaactgcaatgaacttgggactgaagatatcttttcaacatactaattttatttcctttggatatatacccgtgtgaaattgctggatcatatggtagtactatttttagtttctcaggtacctccatactatttttcattatggctgtaccaatgtacattcccactaacactgtacaaatctcttatctatgtgataatgaccatcctaacagatgtgaggtgattacctcattatggttttgatttgttgaataccttttcatatacttattggccaattttatgtctcctttgggaaaatgtctatttgaatcctttgcccattttttaattagatgatttggggtttccttttttgtttgtatgaattccctatacattttagatattaacccatcagataaaagtgtcctcacccttcctcccaacacacacatacatggtaactgtggatggtgatggatgtgctgatttgattggtgtaataattacaccatgtatacatatatcacatcatcaagttgtacaccttgaatatatcctgtttcatttgtcaagtatacatcaataaagctggaaaaaataggttgtcaagtaagggagcccaagaaaagtatcaggtatatttacagagccaaatcaggtgtttcacattcccagtatggatgtgtagcatgtttatactctgggttacatttattgatttgcgtatgttgaacctgccttgtatccgagggaagaagcccactcgatcatggtggataagcatttgatgtgctgctggattcggtttgccagtattttattgaggatttttgcatcagtgttcatcagggatattggtctaaaattctctttttttgttgtgtctctgccaggctttggtatcaggatgttgctggcctcataaaatgagttagggaggattccctctttttctattgattggaatagtttcagaaggaatggtaccagctcctccttgtacctctggtagaattcggctgtgaatccatctggtcctggacttttttttttggttggtaggctattaattattgcttcagtttcagaacctgttattggtctattcagggattcaacttcttcctggtttagtcttgggatggtgtatgtgtccaggaatttatccatttcttctggattttctagtttatttgcatagagttgtttatagtattctctgatcatagtttgtatttctgtgggattggtggttatatcccctttatcattttttattgcatctattggatttttctctcttttcttctttattagtcttgctagcggtctatcaattttgttgatcttttcaaaaaaccagctccttgattcattgattttttttgaagggttttttgtgtctctatctccttcagttctgctctgatcttagttatttcttgccttctgctagcttttgaatgtgtttgctcttgcttctctagttctttccattgtgatggaaagagaagatactacaggtcctttagtctttcctccgaatcccccgagacccggggcattttgaaatagagaacacttttgtgtattagaatggtaaaaaagttggattaataaagacagtaagtttcctcctggcagttcagataaaattttgctgcccaataagtccattcggctcatataataccacagaaatatgtcttttctatgtagaactttttggagtttggaattactaataacctcgtaaggtatggtagacctgtattataccaataataatgaatgtaaacatcatgaatagaaaaatatgagctctctgcttggctcattcagatcatgactctgattagtgcattgaggagcattttgtggacaggctggagtcagcattacaattgtgagtctgtttacccataatagctcctatttttgagcaatatgtgggtgtctatgctgggcactatacaaggtggctcaccttacaggttgcacaagtaattcagacttatttcacgttatccacctagtgaagtgttaccaatataggcttcaggtgaagcttttctctaatacctgtttttttttccttacccttaagtgattgatgacatgaaatcattctcggacaaaaagctcaactccttgcaggaggcagcatagcagggtgaaggaagcatctgagtggtcatacctgacttgtcatttattaggtgactcttgggcaagtcatttcatctctctaggcatcagcttccctatctttaaaatgggggtggtaatcccttccgagcccacctgacaagagagctgtgaggattttgatagataataaataaacgtgagggcaccttgtaatctccgaggcaccacttcaacataaggtggaaaaattataagcgcaaggacaagcctcgtgtatcaatttgctatgaggcaaatggccaaaatggagtgagaaggatatctcaaaaagcaaaggatctgggtgtgggtacagggtgaagggaagatagatgtcaccagggaaagccagtcactcataccatctgaccttttcagccttctcagttacctccgaggtccttctcatatccctgggagtctcttaattgtcccctttctcttctaatccctgtgcttcaaatgttgcatggattttttgagctgcctcggtagctaccttttgtagtctgctttgtagcttcttacaacatcaccttcatcttcctctctctccctccctccctccctttctgcccacccccctttgcttcctccccacttgtatctatgtattcctgggtcttggtgggtagtcactaaatattggatgggtgcattcttagggcactttaaaccttagaggagacaaacattcatgtagctaagtatgtctaccacccatatatgctccccttgaattctcaactaggttctctagaacccactatatatgagcccccatctcctcttcctggcattcgagggctcatctaaatcagccaaacttataactagaggctccccactaagcaccagctattcttggcagcctgatccctggtcactcctttggaggcttctactcattcccactcccagacctctatattagctcaagttgtttccccatctgaaacactctgcctcctctgcttcacttattgttaagaatcctttagcccttacctcctgcaaaaaaccttcattgacacagtttatacagatcttgtctgtatattacttgtctctgctgaccttctgtagcactttaccctctgtaccactaattccctacttaatctttctctgcttcttgtgatatacatatatgtattgctagtatgaattgtttgctttgtgtcagacactgtacttaatattttacatcaataacacaacttaatccctaccattcagtgttatccatttgcccattttataaggttcagaggggttgagtaactttcccaaggacacatggtttgtaggtggtgaaactgaggtttaaactcagttattgtatgaattcagcactgtataactaccacatatttgggtaataatctctgccctaaaagtgcttgcactctagatgggaagataagacttggacatcaactcttatttccctgttatagactgtattagtcagggttctcttagagggacagaactagtaggagataatacacacacacacacacacacacacacacacatatgtatatatagagagagagacagagattggagtttaagtattaacttacacgatcacaagatctcacaataggccatctgcaagctggggagcaaggagagtcagtccgagtcccaaaactgaagaacttcgagttagatgtttgggggcaggaagcatccagcacggaagaaagagggaagctaggcctgtctctccttttcatgtttttctgcctgctttatattcgctggcagctgattagattgtgcataccagattaagggtggaactgccttccccagcccactgacttaaatgttaatctcttttggcaacaccctcacagacacacccaggatcaatactttgtatccttcaattcaatcaagttgacacgcagaattaaccatcacatggactgaatgtgtttctgacaaattcatacatttcatgcattgaggtcctaacctctaacgtgaaggtgttaggaggtggggcctttgggaggtaattaggcttagatgagttcatgaggggtgagccccagtgatgggattagtgttcttataagaagagaaaccagagcttcctctcttcacaacatgaggatacagaaataaggtggccatctgaaccaggaagtgagccctcaccagaagccgaacatgctgacaccctgactttggatattcagcctccagaactgtgaggaacaatttttttttctgttttttgagtcggagtcccactctgttgcccaggctggaatgcagtggcgcaatctcggctcactgcaagctccgcctcccgagttcacggcattctcctgcctcagcctccggagtagctggaactacaggtgcccgacaccacaaatttttttgtatttttagtagagacggggtttcaccgtgttagccaggatggtctcgatctcctgacctcgtgatctgctcacctcagcctcccaaagtgctgggattacaggcgtgagccaccgctcccggccacaaatgtttttttaagccactcagtctatggtattttattatagcagctccagctaagacatgcctctccattttgtatcaagttgcacacattaacagaaatgacaacagcaataataccaatcacagaaacatacatccattgaaggatctccccttaggaccttagaatggacctaggaacttgttttatgctcagtatttgtgagttgatcccaaagcccaattgattggttaataagtgaggggctgctgaaccttagtaaaggctagcatagtgtatcttagtttggcacatggtaagggtactgaaagcattcctgaaatggtgtatttcaacaccagactgagtgagtaagcaaaaagaatgctaaaacttcttcaagtggcttaagctctctgtactttaattatcagtaaaataagaataataatagtaccttcctcacaaggttattatggggaataagtgaattaatgtatgtacaatactcaatacctggcaaagagaaagacctatttttttttgtcattggtatcattgctgttgccattgctgttaatgtgtgcaacttggtacaaaatggagagggctagtgttaataatgacaccaatgattcatatatctcaaggaaagagaagcactatcactatcttatatgtaactcggcactgtacttgccacataacaggtactacaaaaatatttgtagaatgaaaaagtcatggaatgatgtcaaaccctcacagtgctcaagtatctacatagaaaaagttcaggccgggcgtggtggctcacacctgtaatcctagcactttgggaggctgaggcaggtggatcacctgaggtcaggagtttgagaccagcctcaccaacatggtgaaaccatatctctaccaaaaatacaaaaattagctgggtgtggtggcaggtgcctgtaatcccagctacttgggaggccgaggcaggagaatcgcttgaacccgggaggtggaggttgcagtgagccaagactgtaccactgaactccagcctgggcgatagagtaagactgcatctcaaaaaaaaaaaaaagttcaaaagggagaggttgggtaacatattcctctcatgttaaaatgaatgggtttccaatatacactaacatctagcctctctctccattctgagctccgaaagcccgatttctggctcagtagtgcttattgcttccttttcatggcagacttttctctgttctagccttgatatacagttctaaacaaggatgccaccgtaataactctttgctctggcatatgaatgagaatgatttttcatggagctctctccatgcctgctgcttagagttatttgtcatttcttttatgggccatttcaagagagccaggctatgggatgggttgtgaaagccacctgtgttgtcttctctaagacaccagggagatttgatgggttttcattttctaagattctaaggagatgtttttatcttggacagactgcctgttgttacccttggggtttgccatggtgacaccaaatcaaaggatttttatttgcttgaaaggaaaaacaatcaaatattcttgctgggaggtctttttagtacatctggtccaaattcccatctaagggtggggaccatgtttgccttatttccttttgtatctctagtgcacatcactgtgcttggcatagagttgttatgcaacagacatgtgttgattacataaatattttgcagagggaagaaatgctttgtgttactagcctatttggatttggccattctcttctgtagttcagcaaagaaggccttttctctccccctacaccccaaccctggattatcctgctctcttctgcaccaacagacatactttgtatccaccattagagcactcacgatactgtgatatttgttttcgcctgtctttctgttcccactcctattcctggggctctgtgtctgacagtgctgagcacatggacatggttggtgctcaaaaaatattagttgaatgaatgattctaatgcccatggaagacagcaaaaataattacagtgtcatgcatcatatttatattgcactaaggacttcttgtggacaaagatatcagaagaatgatggcattcatgagattgctgctaacagaatggttgacgatagagtttcttcatttggaacgtaggcatgataatactgaattgcaggaaggttgtagagattcagcaggaagatcttttaaagggtgctgctgactcatgacttttatggtagcaggtggaatttttttttttttctttttcttggtcctatgagcaggtagaaggaagaagaaggaaaaatggcagtaacttgggaagcaagcaaagacaacacctcttctctctcctcacctccatcccctccccgccacccttgataagccaaaaggagtgctaaatgtcagctgccaaccttagggagcctgagaatcaccatcacagataaagacctggtgagcatgggtcttagaagacccaacagtagagcactaagccaggttccatgctaagctatagatataggtggctgggggctcaaatcctagaagtagaagagatagtgagagtccaaagacaagaaagttagtctcttgggatcataatgaaacagatgggtgctcacaaagactgaggtggagttctggccttctcaatttcagtatctgagaatattttatagtgcatttttcctgataaataataggacttgcaaagtgatattcccaagagcattggaatggaatgatacaactcaatggcgtattattattgatgtaggttagcaaatggccaaggttaacaaatgtagattagcaaatggccaaggcacaaaaaatagagtggtgagcaaggtagacatgggccctgccctgacagtctttatagtctagtaggaagaatgaaacaaccatacaaatgtaacataattcaagttccatgaaggagatatgggaaaaactataacggcaggagaagctctgaggagagaaagggccttttgagctgagaactgatggatgaataggtattaaactagaagggagaagaaggaggagagaaatcatgagagacattctattaggcagaggaagccaacataaaaaggcagtcacatttaagtgggataaatgctagggaaggaaaagagaggttactacaggagccactgctcagtctttaaataaccttgacagggaggcagggtaactatcatcatccccttgaatgcataagttgggactcagacatattgatttatttaatttatttaatgagtcattgtcaagcccctactagtttcaaatcattgtgctggggctggatgaacacatttatatattgtctctcccctctaggagctttcattctagtggggaagtagcgggagtttatctgtgtcacaatgctggtaagtggtagggccaaaacttgaagtcttttgacttcaagtccagtgctcttttcatggtgtcacattgcagctcaacaaggaagaggcctggttagttacatccatgatgacttggccggatgaggtagcttagcttttgttctaatagctgataaggatttccatagtgctaacttagcacggtgggaacttgattctattaaagtaaaattgaaacaaaaacagaatttgggtatagctcatctgtgtgacaatcatagctagcccttctggagtttgctgtgagctagacattgtacacatttcatatatttatttaatcctaataacaatcctataagtgaggtaaatacttgtactgatttgcccactttccgaatgagaatgctgagactcagggagataattatgcagcattattaagcttgctcagttagtaatttagggttataggatgcaaactcattcaatctgatgccacaacccatgatcttaaccaccatgcaacattggatctacttgccagactagaacaaagtagatgacactatcccagagacaaaggagcagtctgggataaaggccaaagtttgctcttcctggcaggactcccagtcatagttgtttaacaggtacaaaagcacaggactggacttaaaagtgactattgaatccaggtttcctaccatcgtatccatagtactttgtggtcataatttacaaggactttatatctgcctagtgtggtggagtttttttttccaagtaattaaaactatgaaacacaacgcttatacttgctgaattttagaggcctactgagaggccagatttacctcaaaccatgtgtattattgtttacagagtactttcacatccatgatctcatgagatgctcacaacaaccctgaggagggttattcacattttatagctgagaaaacaaagctgagaaagcccaaggtcatgaaactactaaggttttggagccattgctgtgcacctttactatgggaaatgggtgaaatctaccagagcttgcaattctgtttttgtgtcccaattgaaatgaatcagttagtaaaacatttggcttttcaaaatactaggatttctttttcattccagattcaaaagactgactccgtaagtattgactttgttcataaaacactgtattataaataggaatacaaaagtagcatgcattattttctaggtttcaaaataaatagtacataatggatgtctttagttaataaaagctacttggatttctgttcagatgcagctcattggggtgggggtaggggctttggtcttttttagaatgtagaacgcaccttcattccatttgaatgtcatttttgcacttcgtaagtgaaagtacattctttcttatagtgccttgtccctcatgaccggcagaattggtagctttaagtattttcattctcaaaacaaacatgactcataacccatgtggatgcaatgactgtacttgatttggtgaacatttgaaaatacgaagtgggaataaacaataccattaccgtagttatttttttaaagggaaacgaatgcactggaagtggtgtagatgaagtacagggaaatatatgaacattggaattatattccagttagctcaagcttagggtagaagaaattaaaattaaggaaatatttattcatctatttaacacatatttaatgaacaaggcattgctctagacactggagatacattggtgaagaataataataaagatgaaaattcatgccctgttggagttaacattcaagaggggccgtaatgggtggtagtattggcggggggggttagagaagccctcatggagaagatgacatctgaataatgaactaaaggagttaagggaggatgtaacgcagatacatgctcacagagagctccaagcagagaccttgcaatgatgatatactccaatgtggctgaagtagagtgagcaagacagagaataatgggagatgaagtcaaagaagtggccaggagttggctgacccatggaaagaagtttacaaagtaactggtgatattcaactgtgtagtggacactgttgatcccctttaccaggcagaggtacctatcccttagctacttggagcgttgtttgctaaagcttatagtcacccccttctctatagcagaagcactgggggcagcccacagccaatgactggctcaaccccttggcctcaaggtgagaccaatcctatggttccattcatggtcctgagcttctcctggggtcagttagagctagactccaggtgagaccacagccttgcttttttagttccttcatttccccttccttcttaatcccattctaccccaaataatccatctcaggatctgcttctacctaaggaacctgacctaaaacaacaaactttcaacaacataattttagaagctaatatgctgtatttttctctgcaagtgtcaactttgagttatattttattaaactaggcaccctgatggtaaggcagatcattcttgccagtctaaaggagctaggaaagatatttttgaactagatggctaatggtgccattttcgacatctgtgaatgtctttctaattctgtcactcagtaaaggggagcattttaactagggtctcaatggcatggtgttgcagcgattgattcatttttacattgataagtgaatccacaggaaggtcccattagatgcctccttttagttatttgaaatcctagtcaataaatatcgacttccttcctgtcctcttgcaattgtgtgtgtgaatgtagtatttgtccttttctgagataccctagtgctttatgtcactttgtctttacgtcatttaattgatgatatttctcaataatagccaaccaggagccaagacaataaaaagatattccttgtatcaactttaagaaggggaaataagctgtggctggaaaatctgaactaatctcaataataccaagtaacaaatttgacttttctccacttctcactagtttgggcaaatggactttgttattggggacaaggtttagagaacaaatactttgggtaacaggtgtctgcttataagtatgaactttagcaagcagtgtgagaaaattccaacaggaggccctctcccttgcatgggctctgaatgagcaaatccaagattgggaaaagctgctccaactctttgaggttctccactacccatctttggcatgtgatttgaccatggtcctgaggacatttgattctccctttcacaaaaccacttctaaggtataagaccagggaaactcatattgtataatatactccttttgtctggctctctatttctccaacacctgtagtagtccaaatggtgtgaattgccctgtctcttgccttaattaatactatcctgtgaattaggaaatggagtcacaattttttccagtttgcagatgaagaaataaagactcagagatttaagtgacttacccaagatcacaaagctagcaagtggctaagtcagaaatagaccccacgtcttctaactgctatacccttctggagaaagtgtcagggaaagataatgacttattttttagcattttgcttgttaatatgatcattttacttcttctttgtgtggggatgccaatgaatttccatttattcaagccaaatctttgttttctccaaataatttgctgaggtagtgctcttctcattaaagccccctgaagattggctgtgattcccacagagtggttctgtgagctctgatattctggattgtggctgtattattcctggatctcattttacattgcttttcatcagatgtaagacacctatttctttgtctatctctgttatctgctagcatatttgccaccttctttttattgtcttggctcctggttgactattattgagacatatcatcaattaatcccatacaccattgtatgagattttcagtaaccatgactctatacctccgcttcgtggtggcatgccttccatccccttaaagtgattgatcttccctccattagcctgtgcttgctcttctaaattcaaacttggtatcccagtttggacatgagctcaccttatgacctgaagaaaagctttcttttatgaggtaggatcacatgtactcgtctctggtcctctacccaatatctaattcccatatgttggctaagatgctgctgtatacaattctggctgacagagatgaagttgggctttacctccaaatcagaggcgattacttctgcaatctcaggaatagagaggaaatgttcacactaggctgaatttatttgtttggtgcatggaaaagttgcagtgaaatgagtgctgacactgcagcagaaaacttctttgttgaagctgatgcaaggcttggacagctgatgccaaagatgacaacactgtaatttgcttgatccatgtgtctgtgcttcttctttacatcatatctacttctgtgcctgacagtattccataggccagtggtggctgccactatcctagaggcagagaggatagacaagttttggggggcaggtttctctatcttttctcctagcctcaaagcctgtgatctagggcagaggttttcaaacctctgggatgaagagggaggcttgagggagggaaggggaaggaggaaatctagcagggattcctctttaacccttcctcaaacaagtttatgtattgagtttccatgcaagagtttgtttgaacaaagggttcggctgttgaagaaagtttgggaatcactggtctactgcactaaacaggttaacttctgtactgaaaccagcccaactgagtcctacaaaatgagagctgaggctaacagctagtttaccctggatggcttgagtttcctgaggtgtaaaatgaaaccatgcttcccttgatgtaacagcttacatagtggggagctaaaggttttgttggttatcctgaataatttggggctcctttgaggatggatgatagaagaaagttaattattttgagaaagttatttgattccaacctgataatgccaaacttcttctcataaaatgactgttaaatagaatcacgctgtacatcaactagacctaacaggcatatatagaacactccatccaacaacagcagaataaacattttttctcaagtgcacatggaaagttatctaggatagaccatatgttaggttacaaaataagtctcagaagtttaaaaaagatctaagtcatccaaagtatcttctccaaccacaatagaatgaaactagaaatcaataatagaaggaaacctggaaaattcaggaattttgaacaaccaatagccaaaacagaaatcacaatagaaattagaaaatacattgagattaatgaaaacacagagccacataccaaaacttatgggatatagcaaagggactactcagagtgaaattaaaactgtaaatacctaaattaagaaagaataaagatatcaaatcaataacctaactttacaccttgagaaactatagaaagaagaactaactagacataaagcaagcagaggaaggaaataataaagattagagcagagatttttgaaatagagaatagagaaaaacaatatggagaatcaatgaaatcagaagttggtcgtttgaaaagatcagaacaattgagaaaactttgtttagattgacaaagaacagagaagatacaaataacaaaaatgagaatgtaagtggagacattactaccaaccttacagaaatataaatataaagaggataatataaacaactatatacaaacaaatcagataacctagacaaaatgttcaaacttttagaaacacacaatctgccaagactgaatgatgaagaaacagaatatctaaatagactgacaacaagtaaggagatggaatccgtaatttgaaactacccaataaagagtccaggaccagatgactctgctagtgaattctaccaaacatttaaagaagaattaacaatgatcctgctcaaacacttccataacatagaagagaagggaacacttcctaattcattcactgaggccaagattaccctgctacaaaattggagaggaagaataaaactgttttttttgcatgtgacataatactatgtacagaaaatcccaaggaatccacaagaaagctactagagataataaacaaatagagcaaaattgcagggtgcaaaaacaacatgtaaatttggttgtatctctaaacaccaataatgaaaaatccgaaaaggaaattaagacaacagttccatttattataacatctaaaagaataacgtacctaggaataaatttaacaaaggaggtaaaagacttgcacacactaaaaactataaaacattgctgaaagagattaataacctaaattagtggaaaggcatcctgtgttcatgaatagaaagacttaataatgttaagatgtcagtactactcaaagtgatctacagattcagtgcaatccctatcaaaattccaatagcattttttacagaaatgtaaaagctcatcctcaaaacaatatggaattacaagggcctcctatatagacccctatcatgaaaaagaagaacaaagttggaggactcacactaatagatttcaaaattttctataaagtacagtaatcaaaacagtatgatactggcataaggatatacatatagactaatagcgtagaattgaggtttcaaaaataagcctatacatctaagataaattgatttttgaaagagtgctaagtcaattcaatggagaaacagtttctttaacaggtgctgcggagtcgactggatttccacatgcaagttgaacccatatctcataccatatgcaaaaataaactcatctagtgtttggttttctgttcttgtgttagtttgctgagaatgatggtttccagcttcatccatgtccctgtaaaggacgtgaactcatccttgtttatggctgtatagtattccttagtgtatatgtgccatattttctttatccagtctatcattggtgggcatttgggttggttccaagtctttgctattgtaaatagtgccacagtaaacatacgtgtgcatgtgtccttatagcagcatgatttataatcctttgggtatatacccagtagtgggattgctgggtcaaatggtatttctgattctagatccttgaggaatggccacactgtcttccacaatggttgaactaatttacactcccatcaacagtgtaaaagcgttcctatttcttcacatcctctccagcttctgttgtttcctgactttttaacaatcgccattctaactggcatgagatggtatctcactgtggttttgatctgcatttctctaatgaccagtgatgatgagctttttttcatacgtttgttggtcacatgaatgtcttcttttaagaagtgtctgtttatatccttccaccactttttgatggggttgtttgtttttttcttgtaaatttgtttaagttatttgtgcattctggatattaaccctttgtcagatggatagactgcaaaaatgttttcccattccgtaggttgcctgttcactctgatgatagtttattttgctgtgcagaagctctttagtttaattagatcccatttgtcaatttgggctttgctgccattgcttttggtgttttagtcatgaagtctttgcccatgcctatgtgctgaatggcattgactaggtagtgggagttgaacaatgagaacacatggacacagggaagggaacatcacacactggggactgtcagggggtggggggctaggggagggatagcattaggagaaatgcctaatgtagatgacgggttgatgggtgcagcaaaccaccatggcacgtgtatacctatgtaacaaacctgcacattctgcacatgtacccccgaacttaataaaaaaattaactaacgttaaccaatatctaaatataagatctaaaaccataaaactcttagaaaacataagggtaactcttcatgaatttggatttggcagtgggttcttagatattacagcaaaagcatgagcaacggaagtaaaattggattatatcaaaattaaaaatcgttgtgtatcaaagaacattatcaagaaagtgaaaaagacaatttacacagtggatgaaaatatttgtgagttgtttatctgataaaggcttgatatatagaatatagaaagaactcctaacagtcaacaacaaaaagacaaaagaaaattgaatggacaaaggacttaaatagatatttctccaatgaagatatacaaatgtccaataagaacatgacaatatactcaatatcattaatcattagggcaaagcaaataaaaaacaaaatgagagaaaattttcgcaacctactcatgtgacaaagatgtccagaatctacaatgaactcaaacaaatgtacaagaaaaaaacaaacaaccccatcaaaaagtgggcgaaggatatgaacagacacttctcaaaagaagacatttatgcagccaaaaaaacacatgaaaaaatgctcatcatcactggccatcagagaaacgcaaataaaaaccacaatgagataccatcgcacaccagttagaatggcaatcattaaaaagtcaggaaacaacaggtgctggagaggacgtggagaaataggaacacttttacactgttggtgggactgtaaactagttcaaccattgtgaagtcagcgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtaggggcagggatgaaactggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgttaaatgacgaattaatgggtgcagcacaccaacatggcacatgtatacatatgtaacaaacctgcacattgtgcacatgtaccctaaaacttaaagtgtaatgataataaaattaaaaaaaaaatgagataccacttcacactcattagggtgtatacttttttaaaggaaaataagtgaagatgaggatgtggagaaactggaacccttatgtggtgttggtggaaatgtaaaatggtacagtcactgtggacaatagtttggcagctcttcaaattgctaaatagagactcatcatctgattcagcaattccattcccaggtgtatatacacaaaataatttaaaacagggactcaaacagatatatgtatgccaaagttcactgtagtgttactcacgattagctcaaaggtggaaacaacctgagaatccatcaatagatgaaaagataaataaaaatgtgctgtatatatgcacaatcgaatattattcaaccataaaaaggaattaagttctgatacatgctacaacatgaataaagcttgaagacattatgctaagtaaaagaagctagttaccaaaggataaatactatgtgattccacttaggcaaattcatagagataaaaagtagattttatgctactaggggctgggggaagagaaggatagaaagttgttgtttaatggttacagaatttgtttgtggtgatgaaaagattttcgaaatagtggtgatggcttcatagcatggtgattataatctatgccactgaattgtacacttaaaaactatttaaatggctggtttcacgctgtatatattttaccacaataaaaaattcccattaaaaataaagttattcaaaagtggtttcattatttaaaatgaagcaaaagtgttttcacgtctttttctctaatagagaaaataaagatgatcacaaatgtgtcccttctatgaataaaaatgaaatgttcattaaaaggaggcttttttcctttttttttcttcatttcttcttaaaaaaaaaacagaatacatgtgcagaacgtgcagtttgttacataggtatacgtgtgccatggtggtttgctgcacctactgacttgtcctctaagttcccgtccctcaccccccaccaccccctgacaggccctggtgtgtgttgttccccacctggtgtccatgtgttctcattgttcaactcccagttataagtgagaacaagcggtgcttggttttctgttaaaaggaagcttttatatttcatatttaaaatgactttttgatggaagaaatagtaccgacactttatttgctttacttagattctattaagaaatttttcttttgttgtatcctttctgaggtaactaagtattgagataattgtttatctttatcatggtaatctttatagaccacatagagagatccatcttaaatattctggtccatcaccatagtttgtttcttcaaacttaacactcaaagtctcaaaatgacagcacatttggggctagtaaactctctgccagtgaatgcttagaggacgtagcataggtagctcagtatctcacaaggcctacggctgtgctcttttctggaggtcagcatcctcttctaagctcatgtgattgttggcagacttcagttgtttgtggcaataggaccaacatccccatttattgctggctgtcacacagggcctattccgagctcctagagacttcccaaagtcccttgccatgtggccccctcgtaggcctgctcacatggcagcttacttttttaaggcctgaaggtaaatctctcttttaatgctttcacttgattaagtcagacccacccagattagtgtgccttttgatgaactcaaaatcaactgatcaggggcatgaattacatcttaaaaatcactttacctttactatattctattggctaaaagcatatcagaggttctgcctacattttaaggtgagagggttatacaagggtgtaatccattgggcatcattctagggtgtgtccaccacaatgtggaactatcaccctgtattgttgagagatggaaagaagagaactgatttttacaatgaaaaaccaaagcagccatgtcaaacttggtaaaagaaatgggcaagtggtccctttatgtgtttcagcttcccatagtgtgcgtttgcttcaatcagggttctccagagaaacagaaccaataaagtgtgtgtgtgtgtgtgtgtgtgtgtgtgtgtgtgtgtacaagccgatagggagataataataaatcagactttcatggttatgcaggtatgcaagtcccaagatctgcaaggttagtcaacaagctagagatgcagaagagctgatttatatatctaatccaagtccaaacgcctgagaaccgggagagctgatgatgtaattctagtccattggctggcagtgctgagacacaggaagtgccagtgtttcagcttaagtttgaaggcaagagaaaagctgatgactcagttcaaaggtcaccaggcatgaagaattatttcttacttaggagaggatcagtcctcttgttctattcaggccttcaactgattgggtgaggcccacccacattatggagagtaatctgctttactcagtctaccgattaagaaaaaaaacactcataggcatacctagaataatgtttgaccaactatctgggcaccacatggcccagtcaagttaacacataaaattagccatcacattgtccttcagtaatcgcatgtcatttcccctaacaagtgacactaattcagttattatgacaaatggactcaaccagtttctgctattccaataaaccagtcaaggatgagtggcctccatcaggctgtttcctgcatctgttgctggagtacattacaggtgtggttacaaggttttaagctgtgtgtctccagtgaactgctggactgctgggagaagagaagtaagctgcactttctttcttttcttttctgtttttttttttttttttgagacagagtctcgctctgtcaccgaggctggagtgcagtggtgcaatcttggctcactgcaaccttcgcctcccgggttcaagtgattctcctgcctcagcctcctgagtagctgggattgcaggcacgtgccaccatacccagctaatttttagtagagacggggtttcaccatgttggtcaggctggtctcaaactcctgacctcatgatccgcccgcctcggcctcccaaagtgctgggattacaggcatgagccacctcgcccagtcacaagctgcactttctcaggagcagagaggctaatatgaagctaagtacagagagaggcccgaggctgcttgtagtttcccagctaggcatgcctattgcctcctctgtctatttgcctttgccacattctccattcattaggactgacctaagtatagatatcaaaaagagaaccaagttactcttctgctgaccaggaatttggtaaggagctcccaatgttccctgcagagaagaggaacttacagagaaatggcctgctgaaaaaggctgacaacccaaatttgcatgtaagtcagtccatgatcattgctgcttcttagatttgagtgtgacccatcctgctctcttgcccaaaacatctttttcaagcttgccataacttcacctaatgatcgctttgccagatagagacttgcgtcaagtgatgtcttgagtagcttagaatatctcatatatagtaagcttgtctttgagaggctgtcagttaaacaggtgttacaaaaagccgttggggaaaaaaaagagaagaaagaattgccctctaggcaactcttaaaggattgtgattattctgcatttcataggaactctaaaagtatctcttttaccactcagcaagtaagcatctaaattggctgggagataatttacgtggaactttttgccctgtctttcttgagtctaatcttaaattctacttaactgtccattaaggaagacgcagagagctgtccttagtatgagaattgggaaatggttttttttttttaattttactttatatatatatatatatatatttattatactttaagttctagggtatgtgtgcacgacgtgcaggtttgttacatatgtatacatgtaccatgttggtgtgctgcacccattaactcatcattttcattaggtatatctcctaatgctacccctcccccctcccccccaccccacaacaggccccggtgtgtgatgtgccccttcctgtgtccaagtgtcctcattgttcaattcccacctatgagtgagaacatgcggtgtttggttttttgtccttgccatagtttgctgagaatgatggtttccactttcatccacgtccctacaaaggacgtgaattcatccttttttatggctacatagtattccatggtgtatatgtgccacattttcttaatccagtcgggaaatggttttactctggctgacatttttgaagcttgtgaaaactggcatgtttcaatttctagaagacaccaataaacactccccaaatgaccagtttctcaacatgaatttaattaatgggaaaatcggaggcacgtcaggagagactcactgacaggggccactggaaaagacagggaggtaagatttgggaagcttgtgctgcctcccagtgtggacattactccaatgccattcaagaagaatgaattcacagctttatttcccctttgcgttagttttcctgttcccatgtatgacctacattatctttcccacgtccttattgctgctttgaaatagagattttgacagagcttcctgtgggactacaagaacttcagtcaataactagtgatttccatggcagcagaaggtttttaaattaatgtggcagtctgtaccttccatctgtgaaggaccaaaccggcactccctcacctctctctttccttctacctggtgtttttaccattcctccttccaatttttttctggccttatagtgcaggtctcctggtactgatctggaccatgaaacacaggaagccagagccaaattggccagcaaagcttcacgttttgtagaggatttaggcttctccaatactatgaaggccatgattctgagcattcacaaatattgctgggagttgtggcagcggagcacaaaaaaacctcaaaacgttctttttctccccctgtctaagttgcaaacaaattaagaagtaaaatgagaacagtgtataaaaagcaattggatagacgtaatcacttggccacagaaaatcctgagtgacagtagacccttgtccccctcttccacccctcacttgtcacaaaggccctccccctacaaacttaaggcataaaggagcagagaagaatgaatgctttctccagtgagctgactcccaaggagaaagtaaaaaggaaggagctgagctaggaatgctagtttatcttttgaaacctcaccagtcagtctaccacttccataaaagagtgaatcatgggccagagggaagccagcactgttatgctaatgcgattcatatcaaaaacagtatcaagaagagggaagaaccccctgccccatgtaagctctgaaaaaaattagaggtcatctggtcaactccagttgaggaaatctggattcacacagatgatgtggcttattcaataaggagtagagcttaggctgatttaggctgatctagaggacagaaacaagaatggtgtaggagttctagagaatcagtttttcaaggatgttgttttgcaaactgcccatcatcatttccatcactgccatcagtactctcctgcaatgttaatatttgccgggtacctatttgatcacattctacatagatagatttagtgcaatgagacaccacaggagagagctaactgtgggatgtctctcctccttgcccaaagagtagagttagctaatccacagtaattattttccgtttgtgaaatgtatatcccagggagttattattatcaaagggtatctatattaaatagtgtcattagatgctgcctgccatcagccattacttctgttcatcagagttttatattcctagtgtgtataaccagaatctaactacttcttcccaactacacaactgccactggtcctaactactgtcacctgttgcttagattatagccgtagcctcctaaccagtctccctgcttccatctttgcgccctgcagtctgttctctacatagcagcaagagtgagcctttgaacacataagccagctcacatcattcttctgcctgacactatccagtggctgcccgccagtcagaattaaagccagagctgttacaatggcctacatgagcagacttccttttacccttctggcctcatctcctacctctctcctcttcaatctctcagttcctgccatactggtctccttcattttctacaaaaacagcaattcacactcctatctcaggacctttacatttttgatacttctactggaaactcttttctcctgggtatctctgtggctcactcccttccgcacttcctccagcctctgcgccaatgtcttcttcttagtgaggacttctatattatgtagattaggctgaattatactgcaatagcagaaagctaattgacacattaggaacttaactcataaatagttatttctcacttaggtggatctagcagcaatttggagcagcttctttccaatcagtgactcagatacccttggaggtctcagcttaacaatttgtttactgtctctttactcctcaccaccctcaaatgtgtaaactatatgaaagcaagaatttttgtctgttccccccccatcttctatatactgtatgctttgaatagtgcctggcatacagtagatttccaataaatatttgttggaagaatgttgaaaggtagtgagatgagaaggaatggaaaataaaaacctcaaaggaagcttctttgtgtgtatgttttcttctcaggttaaatacagtgaagctgtgtcaattctgcatacaatatttggttattgttataactatagaaggcatgtggactttaaaacctacttaggttttcagtatcaagatttgaacatttcatttgttttctattgctgccataacatattaccacaaacttaggggctcaaacaacacaaattgattatcctacatttctgtaggtcagaaatcagacacccatctccctaggccaaaattaaggtcttggcagggctgcattcctttttggagactctaggcaggatctgtttccttgctccttttgatcctcagcacgattcaattccttgcggaatggagatctctgctttattgttggctgtcaactgagggccatccctggcttctagagactatgtgtactctttggcacatggcttccttcctacatctccaaagccagcaatggcaagctgagtctcttcaaacttttgatccctcctgcctcttctttcctttcatctctctgctccactattctaccttcctcattttattttaagagttcatgtgactacattgggcctacctggataatccaggctaatatcccccatctaagggtaaattgaatagcaaccttaatttcatctgcagtcttaaggtaacatagtcataggttccagggatttaggacatgggcatttttgaggaccattattcagcctttcagagatacgcagacaaatagaaggtatgggatagttggtaagaatgtaggtttgggaggcatgcagaccttgctttgaatcagctcttcatcttgatagctgggttaatcgggatatgttgtaacctctttgacattcagttttctctctgttaaatgtgaacatgggttgctatgaatattaaaaatgatatgtaaaagtgtatggtatatatcaagaactctactttactacttaaaaaaataatgtgacaattcctaatgttctgaatctaagcatcaaatgcagcttagagctcaatgtggaggacattgcctttaataaaacaaagtaggccaagtgctcttttgctaaaacctcaattaaccagctaggtttatagggaatgagaggggagttacatataagtgttgataattcatttatacctaaatcgttaaacgctattttaaggacatttgatgacttgaggctttcaaagaagtcgtaatgcctttttcttaaatagtaatgctgccaagagtaagcaaactaaaataccatttgctttgaaattcttctcaaacaaatttggagcgggttctaacctggcacaatatattcttccatctgtaatccctgcaaggacagcccccctgaaaataaacaccagcgctatttactgaatggggaattagaatctgtggcaggcaagaatgcaaagaaaagcacccatttagttggaatatttatttctctattagaattgtttaatggatttcaactatcgtaattgagagttatgttctagtgttttccattagctaaaaatgtgcttcttttaagtatctaaggaggacaaattcctccacagcaaataggtagagaaatgcatttcctggaggtgttgaccgtttgagcttgcaaattgatgaatacaatgttggggccaaattgaactaactgccttttgatgagcttgagtgcagcttgtgactaactagggagaggattttaccagtgcattctttaaatgaaacaagaggatccaaggactcatgtcttgatcaattggaagagcttctcctacatcccttcctgtacttcctccctgcttttgctactactctcatcagtggcacagccacatcatatggaaagccaggtagcacaaagccaaaatgtcatacacatacttcatatttcagaaatggttctgtagatcagcccacctattggtatctgcttcatggtttttgccaaaaggtcagtcaagatgggttgttaatgtacttgagtgaattttcaccattgttcctgggcatggagaaaagcatcaataggtgacagaagcatatatgatcacagaacgttggcaggaaggaaaagaagagcaccctacctgcttgaaaataaaagtatttcctgactaataaggtaaaatgagtttgctacttagatacttttggggggtggttatggaaagatggaggtgcacatgatggcattgatcattcttccaatcatataattttccagcaacatttgcactataattttttttgccgctagcactagaaccaaggaattcctagcggtcaactgagcctggggtggggtcttcgtgaggcagggagctctggacacatccctggaaatttcgggcaaccatcaggaccaaatttctcgcttgacccatgaaatttggatcagagattaggtttccaaacaccaaataaaagtgtgaaggggatagtgatgatgcatagtgcagggctcttccagcatgccatgtgaagaggtgtggtgttgatgagcacattttctaggaagacaggagtgtaatgcctgagaatgcactctatagtatattggtgaggaaacctcagtcctctgagctttaatactccaaaaattgaaaagattgagagaagaaaataggctttctctagcaatttagcctataatattgcctgagaaaggtgttaagatcaaaggctgagaagatttcgggcaagaaagtttatatgagtaactatgacatcactctgtgagcctaactggagtttctctactaattgttactaatgtcaaagacatatgtccagcctcacacacacgtgcatgcaaacacacacacacacgcacacacacacacactgggccccgctggctggaacaacatgcatagggcagtgagttttctagaaactttgcctgaaatgttggcagtgacctccataagtatgcatggaggaagaggcaaaatttagtgcaaaaacaatgcctggaatcgatatgtaaataatctttaaaggctgcctagataattcagttcctgggacactgtggccagaggcactttacatttaaagcaaagtgagtgagaccaaacatttttcaatgaagccagtcacatattgaacattttcatgaaatttcagacagcattttgaaagaaatactattagtcaatttgataatccataagcagtacagccatctttttctccactgagtcatctctcctactttggttagaaaactaaagtgaagttcgtgtgaggccttctctggaccagcagttataagtggttgaaaattttttgtgcgtggtgggagtggaagacaccttcacgttaacttgaattcagcttcagttactacttagggaggatagatagatagatgatagatagatagatagatagatagatagatagatagatagatagatagatttagagacagtgatacggtttggctgtgttcccacccaaatctcatcttgaattatagttcccataattcccacatattgtgggagagacccggtgggagataattgaatcatgggggtagtgcccccatactgttcttgtggtagtgaataagtctcagaagatctgatggttttataggggaaaagcccttttgcttggttctcattctttctcttccctgatgccatgtaacatgtgatttgctcctccttgccttccaccgtgatgtgaggcctccccaaccaagtggaactgtgagtccattaaacctcctttccagtctggggtatgtctttatcagcagcatgaaaatggactaatacagacagagtcttgctttgtcacccaggtttgagtagggtggcacaatcataggtcactgcagcctcgaactcgtgggctcaagcaagcctcccacctcagcctcctgagtagccatgactacaggtgtgtgtcactatgtctggctaatattttttacattaaaattttttttgtagagatgtggtctcactatgttgcccaggctggtctcaaactcctgcatcagcctctcaaagcccttggattacaggtgtgagccattgcacccaccagggagtacttaatacatagggaatagctatcatggggtaggcactatgctggatgctcccacccacattatcttgtttaattgttaaagtgaccttgttaggaattaaacgtcgagattcagtttggtcatctgtaagagataggaaattgacttgcacaaggtcatgttgtaggtgatgttctttccccaacctttagttgtgtttccatgtgtatatatttaactgatgcccaaataatgcttggcctcagaagagaagagaattgacccatacttagtactgactatgtgactgtgtgccagctattgtgcaatgtgcatctccaactttaatgtgcatagcagtcgcttcagaacctcgtgaaaatagattctgattctgctgatctggagttagcagtcctgcaagtctgcatttctaacaagctcccaggtgaaacccaggatgctgggccaggatttacacttaaccctagctatcatctcatcttatggttgaggaaactaagcctcaaggagtatacaggacttgcccaaggtcacactggtggtaagtggtggtgggggtgggagcggaactgtgatttgaaagcaggataggttgattataaggccgttgctggtacagtgcaatctgccacatcgcccaaggtttttgaaaccttcttcttaagagaggagaaaatccatttgaattccaggcttgatgaaggggcctggcactttaaagtcctagtttcttctaaagctctttcttctaagctcagaaaaacatggtctttgcagttaattgtgcatacgtttatgttttttctcttggcttcttcagatagacactttggtttgccacccttgcttcaccttgggaactctaaactactaaggcccaagccccactcataggccaattaaaccagaatctctggaggtggggcccaaacatgggcatgttattaaagctccccaggtgattctgatgtgcagctaggataaagaaccactgaattacagattcaaggaaacaatttctggaaaaatgtagcctcagtcccctttctcgtggatgtcattaaagaaggtccagtgtatttaactagacattcaccaacaagatttccaattagttcttggtaccattttattttgtgactgcgagcttggactgctctgagattgcagcctatataaagtttgaaatgattctgtacagaccctaagggtggggagctggtaaggagggatgagagtagaaagatacaacatcatagaccagctccagggcaaagacacatgttgtaggtcctgattttcttgctaacctaagttcttgggggggtattttgaaaaactgaatttgattttattcaattcaacaaaactggctagtcaagagatggtcatttttaaaaatgagaacacagtgcagggttggattaatgctatagaactctgagcagaccaccttggtgggtgaggctggaacagggcttctgtgtagagacgtgtgctgctgtgcaattttacacagtgaacagcgccactgcacaagagtacatactctagcctgaggtgtgggaagaaacgcaaataattggataatcatgagccagagcctgccctcagggaagagagaggagagagagaggagagagagaggagagagagagaggagagagagagagagagagagaggagagagagagagagagaagagagagaggaattttcactggagagagtaaagaaaggctttacttagagcagtaattttcaaccttggctctgtagtcaaatcatctgaggagcattgaaacctaccagtgctcaggccccagccaggtgtttctgttttaattgatctggtgtggcaacatgggtgttttggtttttaaaagtcctccaggtgatgctaatgctaaaccacaactgagaaccactggtttagattgcgttcgtactgggcagaggagaatgcatacaggcagagaaacctgggagagacaagtagcttgggagagtcgttctccaatctaagtatgatccttgaccagcagcatcagcaccacctgggaacttgttataaatgccaattctcaagttccagcccaaaccacctcaattagaaactcctgggtgggggtccacagtcagtctcaataagccctctaggtgactgtgaggctcacttaagttcgacttggacatgaacgtttatggaaagggagtgcaatgagctaaagctataagacttgaacctaacaagctgatgtcaactctcctgatggtaccattgagatgtacagcaataaccagtgttctaaggtggaatgtactcctctctagtcttaccatatctttcttatctgtttgaaactgtagcacagaaaaaagtatatgtcattcatgcaggggcagaatacttctggaagaagactctgcttttctggtagaagctgcacttttcttcttagtggacctatttctgtcttcagcagggggatctatcctccctggccacatgggcctttggctgatggaaaggctgggctttgaggaagctgcataggtaaggtgaaagagggtcccccaacctcccctttttgcttctcgttcccacctgggccaggacttcggttggctgggccccacctgccattcacagcaggcccctgaggctactcacagaatgccaagtgatgccactcagtagagaaagtctttgtcctatgctgagtaaagaccccactgatgtgtagcagtggtgctttatgttttgccagtcagaggctttcttttacctgggaggttgatgtgcacaccagtgcattcccctctcttcctggtctgcattgtatgggccaaactctccaaaatggaatagctgagtccttgcaggatgctgagcatctttgagggtcaaaaaagtgtttccaggattggagctaactcttcacaaagaggtttgtaggacaaagggactttacccatcaagtccagtgattctcaaataaggcaattttgccttcagttgtcagggcggggattggggggatttgacaatgtccggaggcattttttgttgtcacaactttggggagcagtgccactggcatctagtgagtagaggctagggatacagctcaacatcctacaatggacaaaacagcccttcacaacaaagaattatcaggcttcgaatatcaaaagttccagtgttgagaaaccctgacctagtctaaaccccttatttttgaaatgaggcagctgaggctcacagaggtgaaattacattctaaaggttacacagaaagcatcaagtcagggtgaggctcctggttttccaactaccagagtgcattgctcaacagtttcatctctggcagggacagtgtttcctccattgcagataccatttactttgtgcctactaggtgccaggcaatgggctagactcttcatttattaccgcttcatagcacacaccttcaatgtaggcatgactatccctagaagtggctcattttgtgcatgcaaaacaactgtatgaaaagtgttataggccattaagaaagcaaaaatgattgcaaaagagactgagacatggttcttgtcctgggagcttacattcaagtagtggagaaaagatatatgtcaaaatagtgatcatctagctttttacttaaggcccatgataataaccaaaaacctgtcccgaggcaccacaagataaatttcttaaaacgtatgtggaaattgagagttaggagagggagctgactgtatgccttagcatcatgggaaggctacataggtcaaagagaattatttgtgtgtattatgagtaagcactatcctagatcccacatataaatggtcaatgagacatataatgtctctgcctcagggggcttatattcttgtagggaaagccagacaagagagaaatacatacatatataagtaattatagactgtgacaaattgaaacctccctaacgtggctaaaagggcatctctgaggaggtgacattttagtggaaccctgaaggacataaaggggccacttgaaggacataaaggggtacaaggccttgaggcaggagaaagcctggcatattctagatactaatggaaagctaacgtgagccagaagagaggcatataataaaattgaggaggtgaggggccagcatggtagggagtttgcatttcattctaccatgaaaagagcaagttagcctgaagaaacataggatggatgaagacctagtaatgcttggagaatgagggaggttgcaaaggagaaggtaactgaaatttccaaacattgaaaagttgtttctaccttgaacaaattgaaagaccattagcattgatctgttccattcagtgaattatttacttaagttactcatgcacatttaaacctgctaacttcatagtgtccatggtggcagtaaagcttaaatcttatatagagataagtagatggttagctgggaggaaaaatggaggtcttgagctaacacatcctgtggttgaatgcacttttcagcatgacaggtgctcagtgacatggaagagtcattgctctaattaccccatttttttttctctctttctgattaggtaaggatgtctgataatctgtatgttttgccatattttctgtttcatagattttttaagtattttattgttggagtcactaatatgtgtctaataattttgattggtagtcccattgctgtctacattgctgtggccttggtgatctcagatttgctttgatttaaaatcatgtatcattaattatgttctgttatctttcggaagagttaatttaaaggcaaacagcatcatcatcaaataattgagggcttgttaactgcttccagcttgaagccagcaaaccttgcgaattacagtggcctgctgagggggcagatgcctctgtggcattgtcaaaacagtttcctaggctgtctctggttgcttttctgtctttgaataagggaaaaagttttttggagacaggggtagtcttgaaaagtaaaaaatactgaagaacccaatagctatctaatatattgatgcttttacaaagttgtcttactttatttatttatttaatttttttgagatggcgtctcactctgtcgcccaggttggtgtgtagtggtgccatcttggctcactgcaaccttcgcctcctgggttcgagcaattctcctgtctcagcctcccgagtagctgggattacaggcgtgtgccaccatgcctggctaatttttgtatttttagtagagatagggttttgccatgttggccagtctagtctcgaactcatgacctcaggtgatccacctgccttggcctcccaaaatgctgagattacaggcgtgagccaccacacccgacaaaagctgtcttactttagacttgttgacaaacacactggaatcctggctacatgataggctttttcaataacttactatgtgacttttaagaagttgcttcccctcctgagttttattttccttatgttttaaaacaaaggagtggcattaaattatctctaaagaaattttgtttgaaatgacatagaggatttcatcatagtgtttgtcacgtactaaatatttaggtagctgttttctgaggccaatgttatgtctattgatacaacttttatagagtaaaccaaaacattctaaatataggaaagataaatgattaacttatttagcttcaaatatatttaaaggatacattgcattggaatttttttattctatcagagattaaggtttactataagattggttctttctttacctctagtttgaaatgggaatactgtatttctgtgaacatgagtacgttaggccaggtcagcaggcttagactctgttaaactctctcctcttaccatgactgctccctgactgtgtccttaaccttgacaatggcagaacagcactgctgctgctgagaaaccaaacctagatgcaagcttgcccacctgatggttagtcaatggaaaaacatttgcaatgggaactagctcttttataaaagttgcttataaccatcatcccaccactaaagtcacttattcttatcacctctgtgtctgagtatgccacctgtcagtgtctgtgtgtctgtggatgtgtggatttgcacatgtgcacttgtgtcctcctactctgcactactcctgtgagacttcggagtcctgaatgggagggctgtgttttcgaggctgggggcactgcctatatgggcaaaatttccccccaaaggcctgttctttggcagctattctcatggggctcagcagcctttcaaaaagcatggggcttccagatccagaaataaaccaggagccacttttaccaccttatctgtcttgaagagtcaagttgaatttctgaaatcggaggaagctttgtataaatctaatgtctacctaatcactggaattttttgtccacctccaagactggataaatctatttttgggtagggcagcaggagtcactgaatgaaaggtggacaaatggttcagatgaacagtggcaagagtggttgtcagaggatagaggtcatgtgcaagaagggaatgtaccagattgggtaaaatggcagaaaacattgcattaagccagggaaaaaagaaacccattcccttttcctatcttaatgggctggattctttgcaggtctccttttcccttcataaagctggtaccccatggacgcattgcatcctcatcactttcttagggaatcagaacaaagctacccacctatcttactgctggagtcctgtgggaagtcatctttcattctttctgctgtcaactgcacatacagccaccatcctacttgagggagccctgggaataagtgcatttgatataacagttttaattttccatccaaaatatctcaaattaaagagattttataagccagcgtaatgtgttgcctatacagtgccacttctggtttaaaaaaatcagtgtttctagctcttttgccaacataacatcaagctactgttggttgactactctttttttttctgttttgcttgaattgactgacatttgaggtattgaggagagacagcctgagacccaaagctgacccattaactcccagatgttcacgatttccgaggaaatgttctgtgcctatggttactgttctgatgactccttgaacactctcatcttggcaccttttgcacttgctaaattcaatttgaagaaagaacaaaagacagggaaaattttgtggaaagcaattatcctgcacttttatgaccttcatgtttttcccatcatgatgaattttggggttagcacttgtatcagtcagcatgtagctttcactagaattttgttgtgtgttacagataaccagtcgtatctaattaaacaataatgatgccagtacaaggcattttctgggaattaatgaccagctgggaaaagctgatggctggagagtcagccaaaggctattagcttcagtccactattaatctccagaaatgtcaatttgtgacatcattgttggtactgagcaatgaaaatggaagacagtttactgttatctgtcacgtacttctgaataacaaattccttatgcattgtcaaaaagtcattttttctcttttatcctccaattgtccttcagtcttataatatgttttctatacagcagtgggtgaaaatggaatttctcagtttccatataatcatgggtgcttctttttttaaagagttccaatttggggagttttatttaaatattttggatggtaaaactagaatttgtcttcagctgtgatgctggaatttgatgagtgtctatattatcataactatctgctcatggcaggaaatggttacaaatgttttgaatagcagctgttgctagcaaagatgtgcattcaacaacgagattctaagaagttatagtcgcattcctagtagatgaagggaactctctacggaaaaagctatcgtggtgtgtctatgtaatatttttgattgctgctgctgaatgctagagggaaatagagaactgactaaaatatcagcatcaccatcttgcataatttaatgagttataaaggaagacaacaatccctcatagagtcaatctattaagaacttgttctaaactcataatactaatttaaaagttatgttggtttttatactattttttccttgacatgaaaggaaattcttaaagccccttaagatcccagccaatgagctaggaatgttttacccaacacagaagcttcatatcccatctaaattcagccaccatttgtttatttatttatttttttttttacaaacaccacggcattattcaccccacaagaaatttgctagtagtatcagtcctcctacatgcgtgttaagtgtatgcatttcgggtagtagaatgagtcagctcgtcattaatcaaagctttggaggcactgactcacttctggtgaaatggaatggcctcattgggaagggtgtgaaagaaaacaattcatgctggggtcagttccctgtttctgaaaatgcagatcaaatttgcacctattttcatggaaggttttcagaatagagaatgtagcagtgaaccctataaaggcaaatatcttgcttttgcagggaataaaaataatagtgatacaaaaacactagtgatacacttaggaagcatataaagagcctagaaagaaaaatgtggactgagaggatcctggtgtatacctaaggccaaaattattaaaccaggcctggctcttttacaatccaacaaggtagtcctttgaccaagcgttgtttcgtaggctctcagctggaatctcttgtcttcattaaggggttttgaacatctgaagaatgtttgcaacagcttcagttctctttggaaatcaaaagagtaaagagcagtgactgattcttctgtctgtctccgtgtatactgcttggaagtaaggccctcaccaggagcagaccaagaaaagaaacagaagcaaatttactgataattggtggatattagccagtttaacctatgaatacttatattgtactcaatctgaaacctataagttctacatggtgtttatttagatacaacatgagcatccatattaaaatacgtttttgcactttgggtatgatttaacactgttttcattgtactagcaacagaggtatatatagtcgagtagctatttccacggctttagtattttaaactaagcccattaaaataaaatcgccaagctattagatgtttttctttgaaacttttcttagggctgttgtttctttagtcttccctgggagtatatttgatttaagacattcgctgcttttctgaggctctaacttgagttcattttgttatgtggtgaccacagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaaggtttgtgcacgacagacgcgtgttttgcttgttttctctcattcttctttctttctctttcttttggattgtgcattgccctctggtgtgctgtgtgttgttcaggccctgccatagctaggaggccccctggctggctggtgaaagtgttatacagtctcagatgggacgctgtataatatggtcatctctggcacagcgcacagcgtcaccctgcttttcacagctgaaacattttcagttgctgtcattttactgccccatttgggctggcaaagttgcttgcttctgtagccaacatctggccaattctgttcccatcaccttgcattcctgaagcagcagtcagctgaggaatgaaacttctaaaatgaaataatgagaagattgtttcaaaaattttcaactctccttcactccataaagcttttgcattgcacttgaagaatgctcatgatctacttagtttgctgaagcaggcccagattacctgtataatgcacgccccgttgcactttgccatggtaaaatgcatgcctcaaggaaactatgagtagtttgttttttcttttcagctcaagtacaggtttggacaactctacttgctgttacttaaactgaggttaataaggtactcattgcaatccatatcacaaatatatcttcaaagtatttcatctggccagaaatggtatttattcattgtttccaacatttttgcatctatcaaagagaaatatttttcacattacaaataaaatgtggtaaatttattgccatctgtttacattccagcttccaaaataacttctgagaattataatgtaaatgctaatacttgttaaacagcccattttcccctcacattaaatatcactgaggcagtttaccaatgaataacatttggaagtgacaaaattcacctgttctttggcagttggtgtatacttttgcattagtggtttttgtataatttctaaaagcgaccttgtttctatttcaagttgcccttttgcatcattatgggaatccttatgataattgtctttctgatatgggagagactggcatgtgggttaaaattcggtgagtaaataaatttctccaaatgcactctagtccgtagttttggaagcaaaacttcacaactcaaagtttccccttttcttctttccaaatagagtttaagacaatcattggcagaaaatgagaagcctacatgtatctgtgtttaattcagccatagaatagagcactcatatttatattctacccatacttttggtgtctaaactattcacgttgagtgtgaccaccgacttccacatatattcatctggaggtataaatggtgaacttttacagtgagtaaaagcaatcatttggttgtttagtggagaagataactaactttattttgtactttaatgaaacaaaaaaattttaaccagtgacaattactttactatatatactacattccaatattttctgctttctttactctaaaaattataaacacacacacacacacacacacacacacacagtttttgtacttgcaaatcagcctaaaaatcaaaatttggtttcgttaagaaaaataagccagttaagaagcagctggttaaattcgctcaagcaatcagttacataattaaaatatttttaacaatatttcagattttaaaaaacagttaagaccccattccttttattattacatataattttgacagaatctgttattttcaagtaccatctggagtgtattgtaaatactgttatgaatattttcagatatagagaattcttaagagaataggtagcagttagactctcttctgcaaagttaggtagtttttgatctgtcatttaatccacatattgagctgttgccattgtgtttaatggggctgccatcctttcacttgtgtactgtgatgatgggcattgtcttctttcagattggagattttcctcagtcttgccctccttccaggtcctcctgccacgatatcaaagctaatatttctgtctttattcttatgaatgatttgtaactagtattaaagtcagaggttttctgggatgacatttaaatactatttgcaatcttactgtaccccctcaaacaagatcccagaatctaatgatgaactcagaccttaaaatgaaaacacttgatctctacacaagttaacaggatccagaaggctttagatgggggcgaaagaaaacatgctgtggagctgatcttggataaataaggaaacattgccaagaacttaacatgcttacttcatgtaggatatcgaagctcatcatttccaggaggcgaagtaactatgggtttggaagggttcactggtcattctggcaacctggaagatttttgcaggactgttttttaattgccgtaagttatagtgttcggttccctcttaaggttgttgtgacattttgttataattagtagaaataaaagacctctttttttttttttaacaaatggatagtgttttgcatttaaactatgtctataccttgaaacattttattgttacgtgaaacattttgaagagatactccctgtcatggcctccgtgccaaaacatgagaccttaattgaccttggctgtggatgctcaccaattctacagcaggtgaaggcaatggacagggtggttaaaccatacattgtttgatctatgcaatgcccgtatgctagtataacctcttctaatgagattatttttttatgcaatgttaaaacccccaaatgaaaaattaaaaaaaaatttttaagccttttggggaaataaatgtttgaattgcgtaagctttagaaatgattaattaaacaggtttatgtgtattgtgatacagttggaattactaaattgataaaaattacccaactcttttttaattagtatagataaagtcttgctgtttcttttgtttggcagtggtttataagggctgggctgttttcatagtttatgacctcttaagatttgctacagataatttaacattgtttatagtcacccatctttttatagatatttttgtcttacgtccagggccctcagaatccatataaaataatacacaaagggactgaaatatctcactggcttttcaggatacacgaaggccaaattacactttgccaataccaggtttctatttatgaatatccaattccaaaaaaatttttaatctgttccaaacatttgcgattttcagtgacatgattatttctataaaaaccacttatgatataatattatgtgagtgctggaatttggctgaagaagtgcacacaagtatctgagagtctaatttggcccagtaccagcaatgttctttgttaaaagaaagccacatggagagtggagatcattaccaaaatctttttcttaccgctccaggagccttttggcaaaagaaagtataagcttcatagctttattcttttgttcactttatcttcctatggcatttgtgccaaaatgaaatcactaatttagagtaactcctggaagccaatctaatattagcatagttgtcatttcctaaatgccactccttggacttttactgatgttcgaagattgttaaagagaatcacaccaagataaatatgcttgcaagtagatagtgttggaaatctacagggaaaaataaatcatggattcccagtgtttgcttttagggtttaaaattctgattacgatagtaaatgtgaagaaattaatgcaacataggaaagtactacagagcttggtgatttgtcaccatctttttatcaggcatttgagctctttgctatagtcctgttttcatgtgattacacacacacacacacacacacacacacacgcacacgcacacacacacacattctgtcttccttagggcattcgtaacctttttattcagagagccatccaaccattgcggctttggttggagaagagaatctgtgctggagattgatgataaagtatggcagcttccaccaaccaagagaaagcaaaattacatgctaaatggtaagggggtatatttgtaactaccatgtctgttactctgataatgcgttgggttattccagaaagagcatacatcaccatgaatatcagtcttaccttaatgatgggagaggaagaagtcagaggaatgctgaggaacatgctgagggaaatgtttttcatcttcatgttttttcaacattgttgttttcctgttgtgccttcctcatcttaatgctaattttcctttcgagaaaaatgtgtcagcattaatttgaattaatagttgaataaaactaaactatggttattaaatcattttgtcactaagctagagttgggtaataacctctgatgcttgtcagctgaaaatatcttgactttcaggaaagacataactaggttccatgtctgtctcctttagaataattgaggggacattcctattctgttagaaaagcatggggccttggtttgcatttctttaattatcagtgataatgagcttttttttttctaatgtgtttgttggctgcatgaatgtcttcttttgagaagtgtctgttcatgtcctttgcccactttttaatggggttgtttagtttttcccttgtaaatttgtttaagttccttttaggctctggatattagacctttgccagatagacagattgcaaacattttctcccattttataggctgtttgttcactctgatgatagtttcttttgctgtgcagaagctctttagtttaattaaatcccatttgtcaatttttgcttttgttgcaattgcttttgatgttttcattatggaatctttgcccatgcctatgtcctgaatggcattgcctagattttcttctagggtttttgtagttttgggttttatatttaagtctttaatccatcttgaattaagttttgtataaggtacaaggaagaggtccagttccaattttctgcatatggctagccagttcacccagcaccatttattaagtagggaatcctttcccaactccttgtttttgtcaagtttgtcaaagatcagatggttgtaggtgtgcggtcttatttctgagttctctattctgttccattgttgtatgtgtctgcttttgtaccagtaccatgctgtaccgttacagtatactttgaagtcaggtagtgtgatgcctccagctttgttctttttgcttaggattgtcttggctatgcaggctctttttggtctcatatgaattgtaaaattgtttttttctaattctgtgaataatgtaaatggtagtttaacaggaatagcattgaatctataaattactttgggcagtatggccattttaaacatatttattttttctatccatgagcatggaatgtttttccattggtttgtgtcctctgatttattttgagcagtggtttatagttcccttgaagaggtgtttcacttcccttgttagctgtattcctaggtattttattctctttgtagcaattgtgaatgggagttcattcatgatttggctgtctgcttgtctgttgttggtgtgtaggaatgctcgtaatttttgcacattgactttggatcctgagactttgctgaagttgcttaccagcttaagaagcttttgggctgagacaatggggttttctagatataggatcacatcatctgcaaagaaagacaatttgacttcctctcttcctatttgaatacactttatttctttctcttgcctgattgccctggccagaacttccaatactgtgttgaataggagtggtgagagacggcatccttgtcttgtgccggttttcaaggggaatgcccccagcttttgcccattcagaatgatattggctgtgggtttgtcataaatggctcttattattttgaggtatgttccttccataactagtttattgagagtttttaacatgaaggggagttgaattttattgaagacctttgctgcgtcattagagaaatgcaaatcaaagccacaatgaggtaccatctcatgccagtcagaatagtgattattaaaatgttaagaaacaacagatggtggtaaggctgtggagaaataggaatgcttttccactgttggtgggaatgtaaattagttcaaccattgtggaagacagtgtggcaattcctcaaagacctagaaccagaaataccatttgacccagctatcccattactgggtgtatacttaaaggaatataaatcattctgttataaaaatacatgcatacatatgttcactgcagcactattcacagtagcaaagacatggaatgaacccaaatgcccatcaatgataggctggataaagaaaatgtggtatatatacactgtagaatactatgcagccataaaaaggaacgagatcatgtcctttgcagggacatggatggatccagaggccattatcctcagcaaactaacacaggaacagaaaaccaaacaccacatgttctcacatgtaagtgggagctgaacaatgagaacacatagacacagggagtggaacaacacacaccggagcatgttgaggtgagaggtatcgggggagggagagcatcaggaaaaatagctaatgcatgctgggcttaatatttcggtgatggtttgataggtgcagcaaaccaccatggcacacatttacctatgtaacaaacttgcacatcccacacatgtacaccggaacttaaaaagaaaagcatgggaccatgtgttctggtgactctgaagagataagaagactttgttctcaacctttttatttcaaagtcacttttttctttcatgacttagggccaccctgcctttgatttatgacctgaaggatcacaaaatgacacaagacaattttctttgctcattgaagcaaatggcagcttaattgcagagtcacaagaaagataaaaaaatattagtccaaattaatgccagaaatctggtggccttggtcattagcagtgagtaaacactatcctctccccacaaagtatttaattctatttctcttacagcttatgtcctgataacattagtaaaccagcaatggcaatgaaacccattctttcttcccccttatttcccctaccttatggcagcaaacacaaaatgaagtcatattttggggatagtttctactctctggaaaacttacagtctaatcaaggagtatgtatagtagccagtaattcactttcatgataagatggacatttatcattctcttattgaatatatgcatctccattcagtctctaggctggaggctggcttttagagtacaaactaataaccgttcgttctttaaaatatcattcactttttaaagcaactgacctcccctctcccttgagcttatgtgttccaatcatggtggtggtttccttgagacaaagttgtttctcctttgtaactctcttggctgaagtcttccttagttaatacttggagcagacatttctcctgtatgaagccagcactgatgacccgtttcaggcatttatgtttaaagtgacacttatctgcgaaagtgctttgaaagttctactagatgaatgacagtgtatgctggtgattttgattttaaaaagtcaaaatcaaagatacttgaaaacatctggaagttatacatccatatgggtgcttcccctttcaaggccaagacatcagggattgtgttggcaacatgctcttgggatgatgtcttgccaacttttctggagtttttttctcttcccagccagttggtaaaccacttaagaaattctgccttctggacccagcatggtatgacccagctaggctatgttccatgtccataaaggcatagcctgaaagactggttgattccccaaatcaagcccaatcctgatattagaagtctacgtctattaaggagatgcacaagaatgttctgctccctctgctccaattttcaccctgtcttttgttttaaatgacaattcacttgcctggttgaagagaatacaggagtgaactataatctttttcacagattcttacatagttatcagatcaatgttttccaataatatttcatgcaacactgatcatatatttatgtaaaaagacagcatttgtggtcaaatatgtttcccaaattacacgccattcctagagagtcacaatgcatatgagtatatgaaagattttaaagagtcttgcagattaggaagctgtctaccttaggcagttcagtggtaaacagcatcttctagctactggacccttttactgataatacagatgaacatcttccaagtaacactttgggaaaggctctgctggctctactaagcagtgtgttctcatcaaacatgagctttgtcaagtagcacacttttgaaaatgattgctgttcccttcctctcgattcccacctactatcgttagagaaaggctactcaaatgttcttcatgtgtctcaagttctttgttaccaatccatgactagataaggatcttatgccagaaggtaaatcactgcttccttcatgaagaaaatattgctgtcttgctgtgaaaagtaatgtcagctgaactaaataagaactgtattaagtaacatagttcacagactagtgctatgtttgtgtaccatacattgagtaacactgctttagattagtgattctcaaacttggctgtacattggaatcaactgaggatatttaaatactactgacgcctgagctcaacatcaaaccaaaaactgacaatcaaacaaacaaacaaagaaaacctgcaaaatctcttgtcgtgcttctggtcccaagcatttcaaataagagatactcaacttttagttactagtttttatatggataaaacatttcattctatgtcctcattgtatattttttcttgagaagaaatatttcttgagaagaaataattaagtaaaaaggactttataactggaaaaaaatttattgtggtagcggctcaacaggggtacttttttttaaaatctatctaagtgattctaatgtgctaacagggttggaatcactgccttaggaaataatcaccttggcataaggtctgctgagtgatgtcagctgtcaatccaggaatcttatcatgctgattgcatgggcctcttcaaaaggtgccctgtgatagagggctcagctggagaggcagcccttatatgacctttagaacttatggccatgtaaggtatccgtctttcccaccatgtgcacacacacctttctgaagttcccttacttgtttgccactctgtgcttttagaaaaataattaggattctccataagcgtgtggtaatctgccaccttgtgaccaacattctttcttgcaagcaattgttgaaacacttgttctgctctcagaatctgatgcagcttgcaagtatgggtcaaagagtttctcagactgtacttaaacaagaagatggagaaggagaaaagggtgtcacgatatgccagaaaagtactgacaattctttacttgattgctactgctctagagtaagattgcaaagcttgactcaagcagcttgtagcctgtgtatctgtctctgtgttacaccagaggctgtcatcgaggcattgccctcttatcatctaaatgtaatcggctactgcagcataaaaggattacagcagcccatatgtgaaacttgactctgacatgattaggaggctttaattgctatccatgtttataaatcattcctagcattttaaactacgtggattctgatattcatttcttatactctacggcattttttagtgtgcttaagaatagcaccttcaataatgaccactgtgaaagcgttaaacaagagacattatattctgcattttatcagcacttgcccttgtcttgcctcacagccaatatccacactcactccagcacatgaaaatcacttgtccacttccacccatgtgctagcaaatttttacttatgagccctagctattttaagatatatattctcagaagcatgtccagctttggaagcagcaagtgtacaatggccccaagactatatctacaaaagggaaagggaagagagcgtacttccactgggccacatcttcagtgacaacactgtgcatagccccttagaagcatgatcacgaaaaccctgtcagatagggttgctactaccatttcacagatcagcaaactaagatgcagaaagagtaagtcacttcaccagtaaatgagaggacttgatttgaacctaatttttctggcttctaaaagccatgccttctcccctccatggcttctccatatgctcagtttcccccctcttgctccataagtgcatttgttatctaaaacaaactgtagtgctaaaaagtgatcttaagtgtaaaggaataaaattctgtctacagtccttcctcagctttgtgacagcaagagtttgtcataagcagaagggactcgactcaggaggtacttgctcattctgtaggcctaagattaggtagagtgcagcactcaaaaggaagagatgaaatgacccttacctttaaggaactgatgacttggtcccggcatacaaagaaataatggagtgattaatgaatacttaaattcgatttgaatgcaatagatctgttcctagataaaagatattaaaagctcacttgtctactctgctttctttaggctagggaatgtgcctttccacctatgtgttagtcagttctcacactgctataaagaaatacttgagactgggtaatttataaagaaaataggtttaagtggctcacagttctgcaggctgtacaagaagcatgatgctggcatctgcttagcttctggggaggcctcaggagacatttaatcatggcagaaggcaatgctggagccagcactgagagaggtggcatcctttttacgatagtctgtccacaaatacagggagactcgaggaaatgacacatccatattgaaattatttgcttcttctctctctttccgtgcatgagcacaggtgacttgccctgaattgggtgtaaaaccttcacagaggacttcaatggggcaggagctgtctcagttgagctccaccagagacctgccattgctctcataatggcacagttgattctgtcccttccaaaagcacaaaacactgggacaagggaaacatgcccctttgtggtcgctagttgccattcaaagagggtttgaatacacacacacacacacacacacacacacacacacacaaatggacacatattactatttaaaatagtttatttgggggaaaaaacacttaaaagcagaatagtacagctcacatggttcctctactggagtcctttctacgatacatccagcccaacaaagcccagattaatcacagccctctatgggataatatgggctcaagcaagccattcatacagcgaggacatttgtctagcaaactgcctcaggctgtgaacaaaatcgggttctttttaagcaacaaggaaggaacaaagggcatttcaaaaagtggggattatagaagctgccagcaagtaacttttctcttatgttccttcttcagccatttcccctctgtacttacttgatttttctctgagaagatagcatttagaatccatgttagaagattcatgaactaattcagtaaatctctaattggcatacatggtaagctgttcacttagtggataattggttaaatgtacccagaatatttagtgagggagaaaaaaaatccccaaagcaaatcagcatagtttaggaaccttttcctctagtgccgctttttctttgtgaatggctactggtgcttaaaagtggtctctctcccttcccagtcaggactccatttaaatatacaacctccattgcatccctacttaatagagctttattaaatggataccataagcatagcacagtgtctgtcaacagtaagtgctcaatgaatatttattattacaaataacttatttatctaacacattttgatattctgtgttcaacggccatttgctctaattccaggtggcaaatgactgagtgcttctcatcaccattagcagaattgatatatttgttaataggtgtttattgagtgtcttgcacaagccaggcattatggtgggtaggcacagcatgataagacagattacatctctgccctcaaggaggaattaaagactagcaggaaagcagacttagaactacttgattatcaagattgtgttgcattcaaaaacactctaatacatagtggcttaaacccgctaaatatattttatttctcttgggctataggttggctctgtggttctgctgatctaagctgggcattgcttatccttcctgggctcaacaatatatttgtggtcagctggtaaggcagggtggcattgactgttctatgatgagtttgtacaggacacctcagctctccatgtgtttttcaagtcttatttatctattttaatattcatttattaatttttttcattgaacatttactgagcaacttttctgtgtgtcaggcactatatggccttgcatttcaattgctcaggaatgagttctatgctggtaacacacattcagtattgttagcctctggccagtattaaaaccatgaaagcagatgagacacatagggagagagactagagaagcaaggcctggggcatagaaacattgtaagatgttatagagaagaaaggactccagaagaaaaagaaggaaaaccaaaagaatgaggtctaaggaagccaaggaaggactcggcttcaggaaggaggaatggatcagtagagctgaatgcggtaaatcgttgctaatttaatacaatcctttcatatatcccttttagcatctaggctttgtaatccagttcctttcaatgtagaacagatgtctctgcctctcacgctcttgggaataaatggcataaatcactgaaatagttaaactgacccttgatagatagagtgatgaggaattagatgttgtctaactgctaaggaaagagtaggtctttgtaaagatgtcatcgatttttcttctctataatgcctgtaaagtttaaggctttggcaagaccaatttattcttttgttgtttatccttttgaatgtagttaagcttgctcggtaattttttctgtaatctaaaaatattggatcactgagaattaaaattaaatcaccccttgagtttggtattttaaaactgacaaactttgaagccacattaatatgatacaatcaagatgacattacatgtgtttccaataaagcaagttttctgccaactttacaaacgtgcacttttgctagaaattgattccttgtctagcagtgaacgtttcttgctgaatgaaagaagtagtgtttaaaaagaacaaatacacagttttgtggtgaagaactgttaacaatatgatatagagtctatgtaattaggctaagtttttatctaggatttgtgaatgttgatcctaaggaaatgataacttcctatgcaaaatatgatgaaagttttctgtacagagtgtcccactcaccaaggtcaaatgctacttccttagtagcctcaagggaggaaataggctatgtgtttttgggattaaaaaaataagaaattaaatgaattcatttttcatagtgtaaggtagagtgtttgggaaaaaaattctttttgaaggtctgtcctatgtatttgaaggtttttttcccttgcacttggattgtcccttaattcagactgtattaggatactacccatttctaaactaacatgagagactagagcttttagacactttttgctgactgccctttttcctaagacaggagaatgtcatgacagaaaatactgcattcccaaaacatctattgaaataaaaaaaatgtagaaagaaaatactgcattcatggacctacctctagcagcattccattttttccttagcatatccaatactacttttctccctgaatttgtttaaattaaatctgtgctgagacaggatcttgtgctttgattataggttggaatctcaatagtggaacatgtgagctaaccagggagcttgtgaacccctttgatatcctgtcatccttttctcacctatgtggtaacctagagaaaggactttgaagaagaaggagaaatatctctgtaggtagatggaagaaggttacatttaacatgcgaactgaactttatcttctctcttgtttagtaaaatcactgctggttggaggagcagggagtggacactgggaaaatcagaagccaacctgtgcccctacagtgctccagagctttagtatttattacatttatggaatgttacctattttttttctacatagaaggttttaacaaatcaagcaacacattctcatacttgataatgaataacattggcttaaaaattacaccaaattatcatgagaagcacaagtgagacctaaaacccagtgagcaaatctgttagtgattcttttcagctgtaaaaattagttgagatatttatttttccttcagtcagtagtgccaggctctgtgttgagctagagcaggatttctcaactttggtgctgttgacatttggggctagataattctgttgtcaagggctgtcctatatattgaaggatattgagcagcatcccttgactctacccactagatgccagtagcaccccatcctagttgtgacaactcaaaatatgtccaaatattgccaaatatcccataaggagcaaaatcaccttgttaagaaccactgggctgtgtaatacctatacaaacaaaacacatatattctgaaaattactctgcttctttgagagccagtcaaaatacttctgtttcatcataaccaaggttctccatccttgggttactaaggtagtagtttcaacttaattcaaactccgccttactcttcctgatccttcccctgcccttctcaaacctttaacttatctcagctatttatacaaatataaatatatttatattatataaggctctccagtagagctcaatgcagtgatttggtataagaaaactgaggctgcttcgggttaaattccactgtcattgaatgagttacaacttggtttgttccctgtgtctactataggagatctggagaaatatgacagagtccctgccttttaggagcttgacatgaaaactctgtatatgaaaaggaatgtaagtcagttatatcatgggctcaggctcaaatataagctcattcagaaaaatcttttcattgctgtccttttagaaggcttctgctcagtctagcctttcttcagcagggctgatgatgagcagaggtgaaggtattcctcaagattttatttttcatgttttcatatctagttcaacattgaaaaacttagaacattcaagctaactattcagactcgactaacattgggtacctataatggtgccaggcactgggctagttgcttcactcagtatttaatctttaaaataactgccaaaatgaagcatcactttttccttacctcatcctggttcctttacactgtcagcaagtctatgagatcaggaaagaaggaattttggaattttcacataatattttgggggacatgcagtaactaaactcattaaaattcagagaaattaatactccaaaagactatcaaagaatagaattaagtttacctcttagctaatttaatgtattttgatttattttttcaaaagcaattgtggtttatctggttcctgtttcttagctttgattttgttcctttatcgtagtaaagtgtcctcagtgactcatgttactttggataaggtccgttccttccttgagtctccatatccttatatatatataaataaaaaaaatttttaaaaaggattggataggtactgaattctcttattttgtatatctcaagatagtttaaaataagactcaatttgttattatgtttcctgacaactttatgcatagttaaaatggaaattcaactaatagatatggttgaagtctgacttcataattgtttcaagtttttgctgcgttggttgagcttgaggggaggtttcctggccatataatgatggccgtgggcttctcctttttcacatttttgctgaaactcgtgatcttaattctggactttgagaagattaaagcctaggcatgacctggtatgggcacagggagaaggaaaagtaacattttgtaagtacttgcctgtcttccttttgaaaattaggtaatatgatcgaattagctaagtaacttacccaacatctcaccattagaaaatggggagatcgaagtacaaaactatattctctttccaagccacactctgtttcttccaaaagggagactctcaagacctgccatatggattaggaggtaagcatacttttcctgttaactctgtgacctgttaactcttccttttagtgcctcaaatcttgacttcagggacctaatgctttcatgaacctaatgcaaagaaccccttgctttgtgttattttgtggaagaataatttggagcaaagaaaatcccctcaccataggcagaaagtcagaaactggaagcaagagaaaatgcttggttggtagaccaccaccctggccactggacttcgtacctttatatcctgattcaaaatggtagatatcaattttaacatcactcctcaattcaccagcccctgtcttggggcttccctggcattcatcttctacctatatttccttccttcccttccagataacacaatgagagtcaggtatggggaggctttattctgaaaggaaccacatctgttttcactttccctttttcatttagatatccactgttttattattgttttattatgatttcccctgtagagaagtatacagtggcagggcgacctgttgtgcatattgaattttacccttcatttactccaatgtttgcctatttctgctagaagctgaacagcaatccatattctccctgtgtgtaaactgtttctggataagcattaggtaccatggcgggatgtttgtttatccaactgaaagtctaaaggttttcaaactccccagttctcttttaggtggtagcctattcatagaatcagcactgctgatttatgagcaccatagctgctcagatctctaatatttctacagctattccaaattccagtagtttagataatggaggaatttaatgaatagctagagaaacatacagatgttccagtttcagtggaaactagagaaacttgtagaatattgcctcaagtcaggttttcatttcacctttctttacccttgtccccagcatctgacattggattaagagcagcaacaccatagccaccattgctaaagtgcaatctgggccagatatcacctcaagtttctataatctcgatagaaatgctagaatgtagatattttatcccatttttatacagaaggaaattgagcctcaaagactttaggtaaggcagaactgaaaaccccagtaggtgttaaaaaatataatgtgatttgaattttgaactataagttttctaagccagatggcttttacatctggggtgttacctgggttactgacttgaactgttgtttaagatgtgactaaacttaaatttatattctctattgacaaaacattttattctagagtaattgctgtactagatacaaaaacactgcattggtaaatcttttgttagctgtaaagatggtagctgcatatgtatgcattcaaatctgcttgttcataaatagaagacctgatttattaaagattttcatatctgacattttaacttgagatttttcactttcctttttctgtgaacagcacggctcatctctgtaagttcaaagtttgtcaagttcataactcttaaaaaccttgcacaaaccataacctcgccctttgccttcccagatctattcccgaaactgtcatcttgatagattcgtggaataacccttccttctcaatttctcagcacttttctgaccccctctgtcttagtctgttttctgctgctataaaagaataccatagagtggaaaatttttttttaatgatttatttggcttaccattctgggagatgggaagtccaagaccgaaaggccacatctagtgagggctttcttgctgtgtcataagataatgaaaggtatcatatgacaaagaagtgtggagggatgaaagatagaggaaattgaaccaaacccatccttttatcaggagcccactcctaccttaactaacctactcctacaataatggtattaattcattcatgagggtagagccttcacgccctaattaccttttaaaggtgtcacccataaataccatcacattggcaattaaatttcaacatgagttttgggggacatattcaaaccatagcattcttctcctagtccctcaaaattcatgtatttctcacatgtaaaatagattcattccatcccagtagccccagcaatcttatttcaataccaactcaaatgttcaaagtctcatctaagtcatatatgggtgagactcagggaggcaaattcctcaggcagtttctctccagctgtgagactgtgaaatcaaaacaaactgtctactttcaaaatacaatggagggaatggggaatggccaagaaggctgactagaagctccatagctctcaaagagaggaatggaaaggacagtaaacacagcaccttcaactgaaacattcaggtactcgcattgggactaacgaaggaaacaactcaacccatggagaacaaagaatgacagcccacctgagagtgacacagaaccaagtgaacctcccccacccaaggaagcagttgagtgaatgtgtgaccctgggaaaccacaattctcccatggatctttgcaaccctcaggtcgggagatcccatcgtgaatccactccactgggaccttcagcctgacacacagagctacacggagtttctgcagagtagccactcaggcacatgtggagacccaggagctttagatacgccagcatttcaggcttctcagcaaaagtaactgcaactccagcaaagtgggaggttggacacctgtacatacccctagaaaagaggctgaatccaggggaccaagcagtgatagtctgtggacaccacttccactgtgcctcacaggataagacccactggtttagaattccagccagtcaccagtagcagtattgcacctacctgggacaaagctttctgggggaagggtggggcgccatgtttgctgtttgggcaacttagctgatccagactgtaagctttggagagtctaaacctaccaaggtttgaagggatcccccagcacagcacagctgcttatcaaaacatggccaggctgtttctttaagtgagttcttgctcttttcctcctcactgggcaggagctcccaactggggccaccacccactcaagccagttttctctggccaacagagatttgaaaactccctgggacagagaacccagagtgaggggcaggctgccatctttgctgtttaggtgacatagccagtccagcctgtgagctttggagagtccaaactgacaggggacagaagcagtaccccagcacagtgcagcggctctacaaaagcatggtcagacttcttctttaagcaggtccccagtactcttcctcctcatggggcagaacctcccagccagggcctgcagccaccccgactggtgttccctggtctacagagttttgaaaattccctgagattaaactcccagaaggaggggtgggctgccatctttgctgtttaaacaacttagcctccagcttctgcagagccaaagctgaccaggagtggaagcaataccacagcacagcagagtagacccacgaaaatgtggtcagactgctttttaaagtgggtccccaaccccatttctcatcaccaggtggagcctcgcacctggggtctctggctacccctaatggtgttctctggctgacagacgtctcagctctccctgggatgcagctcccaatggtaggggcagaccgccatctttgctcttaggaaaacttaaccattccagtcttcaggcttcagcgtgtccatggtgaccaggggatgaagtggacccccagcacagcatagcagctctacaaaaatgtggccaggctactttttaaagcatgcccccaatctcattcctcctaactgggcaagaccacccaactgggattgcccgccacctcctatacatgtgtttaggctggcaacaggtccatacctccctgggatggagctaccagaggaaggggttggctcccttatttgctgtttcacagccttcactggtgatacctccaggtactggcaaatccaagtctactagaaactggagcagacccccagaataccacaacagccctatggaaaaggggccagactgttaaagaaaaaaaaaaaaaaacccaccaccaaaaggtcagcaacctcaaagattgaaagtagataatttcacaaagatgagaaataataataatcagcagaagaaccctgaaacctcaaaaagctagagtgccctctttcctctaaatgagtgcatcacctcttcaacaagggttcggaactgggctgaggctgagactgagatgtctgaaatgacagaaggagaattcagaatatggataggaatgaagttcactgagctaaaggagtacattgtaacccaatgcaaggaagctaaaaattatgataaagcattgccggagctgacagacaaaatagatagtatagagaagaacataaccaacctgatagagctgaaaaatacactacaagactttcataatgcagtcacagctattgattgccaaatagaccaagtggaggaaagactctcagagcttgaagactggctttctgaaataagacaggcagacaagaacagagaaaaaaagaatgaaaaggaatgaacaaaccctttgagaaatatgggattatgtaaagagactgaatctgcaaccgattgatgtacctgaaagagatgaggagaatggaaccaatttagaaaacatatttcaggatatcatccatgagaacttctccagcctagcttgagaggccaacattcaaatttcaggaaatgcagaggataccactaagatactctacgataagatcatccccaagacacataatcattagattatccaaggtctaaatgaaagaaaaaatgttacaggcagctagagagaaaggccaggtcacctaaaaagggaggcccatcagactaacagcagacctctcacttgaaaccctgtaagctagaagacattgggggccaatattcaacattctctctctttttttttttaacattcaacaatcttaaagaaaacaaattccaacctagaatttcatatctggccgaactaagcttcataagtgaaagagaaataagatcctttccagacaagcaaatgctgagggagcttgttaccaccagagctgcctcacaagagctcctgaaagaagcactaaatgtggaaaggaaagactgttaccagccactacaaaaacacactgaattacacagtctgtacacagcccagtgacattatacagcaccacataaacaagtctgcaaacataatgatgacaggttgaaatccacagatatcaatacaaactttacatgtaaatgggctaaatgccccaattaaaagacacacagtggcaagctaaacatcaaagacccattggtatgctgtcttcaagagaactatctcacatgcagtgacatacacaggctcaaaaataaagggatggaggaaaatctaccaaggatatggaaaacagaaaaagtagaggttgcaatcctagtttctgacaaaacagactttacccaatgaagatcaaaaaacaaaacaaaacaaaaatccgcatcgcataatggtaaagggttcagttggacaagaagatctaactatcctaaatatttatgcacccaacacaggaggacccagattcataaaacaagttcttagagaccttcaaagagacttagactctcacacaataacagtgggagactttaataacccactgacaacattagatcactggcacagagaattaacacagatattcaggacctgaaatcatcactggatcaaatggacctaatagatatctacagaactctccaactcaaaacaatagaatatacgttctcatcactacatggcacttagtctaaaattgatcacgtaatcagaagtgaaacactcctcagcaaatggaaaataactgcaattataacaaacagcctcttggaccatagcacaatcaaatttgaaatcaagactaagaaattcactgaaaaccatataattacatggaaattgaataacctgatcctgaatgactttggggtaaataataaaatttaggcagaaatcaagaagttcattgaaactaatgagaacaaagatacaatgtaccagaatctctgggacacagctaaagcagtggtaagaggtaaatttatagcattagatgtccacatcagagtgatacaaagatctctagttaacagcctaacatcacaactaaaagaactagagaaccaagagcaaacaaatccagaagctagtagaagacaagaaataaccaaaatcagagcttaactgaaggagatagaaacatgaaaaaccattcaaacgatcactccatccaggagctgttttgttttttttttgaaaaaaaataagtaaataaaatagactgctagttagactaataaagaaggaaagagaagattaaaataaacacaatcagaaatgacaagagggatattaccactgaccccatagaaatgcaaacaactatcagagaataggatgaacacttctttgcacacaaaccagaaaccctagaagaaatggataaattcctggacacatacaccctcccaagactgaattaggaagaaactgaatcccttaacagaccaatagcaggttccgaaattgaggcattaatagatagtctaccaactgataaaagtccaggaccagagggattcacagctgaattctaccagttgtacaaagaagagctggtaccattcctactgaaaatgttccaaaaaattgaaaacaagggattcatccttaactcattctgtgaggccagcattatcctgataccaaaacctggcagagatacaacaaaaaagaaaacttcaggccaatatcctcaacacaaaaatcctcaagaaaatactggcaagccaaatccagcaagcacatcaaaaagttaatccaccatgatcaagtaggctttatatctgggatgcaaggttggttcagcatacacaaatcaataaatgtgattcatcacataaacagaactaaagacaaaaaccacatgattatctcaatggatgcataaaaggctttcaataaaattcagcattgatttatgttaaaaactctcagtaacctaggtatcaaaggaatataccacaaaataataaaaaccatctataacaaagccactgacaacattatactgaatgggcaaaagctaaaaacactccccttgataaccagcacaagacaaggatgccctctgtcacaactcttattcaacgtagtattggacgtctcggccagagcaatcagtgaagagagaaaaaataaagcacctccacataggaggagaggaagtcaaattatccctgttagcagatgacatgatcctttatctagaaaaccctagtctcagctcaaaagctttttaagctgataagaaacttcagcaaagtctcaggatacaaaatcagtgtgcaaaattcactagcattcctgtacaccaacagtcaagccgaaagccaaatcaggaatgaactcccattcacaattgccacaaaaagaataaaatatctaggaatatagctaatgactgacgtgaaagatctctgcaataagaatcgcaaaacactgctcaaagaaatcggagatgacacaaacaaagggagaaacattccatgctcatggacaggaagaatcaatattgttaaaatggccttattgcccaaagcaatttatagattcagtgccattcctattaaactaccattgacattatttatagaactagaaactattttaaaattcatatggaacctacaaagatcttgaatagccaaggcaatcctaagcaaaaagaacaaagtaggaggcatcatgctacctgacttcaagctatatactacaggactacagtaaccaaaaccacatggtactggtacaaaaatagacacgtagaccaatggaacagaatagagagcccagtaataagtctgcacacctataactatctgatcattgacaaacctgactaaaacaagcaatggaggaaggagtcactattcaataaattgtgccgggataaatgactagccatatgcagaagtttgaaactggaaccttttcttacaccatatacaaaaatcaactgaagaaggattaaagacttaaatgtaaaatccaaaactataaaaaccctagaagaaaacctaggcaatatcattcaggatataggcatgggcaaagattttattatgaagatgccaaaagcaatagtgacagaagcaaaaattgacaaatggaatctaattaaactaaagaggttttgcacagcaaaataagctatcaaaagactaaacagacaacctacagaatgggagacaattttggcaagacatgcatctgacaaaggtcgacatccagcatctataaggtacttaaacaaatttacaagaataaaaacaaacaaccctattaaaaagtgggtaaaggacatcaacagatacttttccaaagaagacatacatgtgaccaataatcaaatgaaaaaaaaatcaacatcactggtcattagagtaatgcaaatcaaaactacaatgagataccatgtcacaccagtcagaatggctattattaaaaagtcaaaaaatacctgatgctggcaaggttgtggagaaaaaggaacacttatgcactgttggtgggagtgtaaattagtttagccactgtggaagacaatgtggcaatttctcagagacctaaaacagaaataccattcaactcaacaatcccattactggatatatactgaaaggagtataaatcaatctattataaagacacattcatgtgtatgttcattgcagcactattcacaatagcaaagacagaatgatagactggataaagaaaatgtggtatatatacaccatggaatactattcaaccataaaaaatgagatcctctcctttgcaggaacatggatggagctggaggccattatccttagcaaactaacacaggagcagaaaaccaaatactaaatactgcatgttctcacttataagtgggagctaaattatgagaacacatggacacatagagggaacagcacatactggcgcatttcagaaggtggagggtaggaggagggagaggatcagcaaaaataactaatgggtacttggcttagtacctgaatgatgaaataatctgtaaaacaaaccctcatgacacaaatttacctacgtaaaaaacctacaattgttcccttgaacttaaaataaaagttaaaaaaaaaaagaaatggaatagcaaggaaaaaataacaacatacaatggaaggacaggaatagaatatatattcctattctaaaatggagaaataggcaggaagggttagttgtttcaaataattcccaaacccagcagggaaaacatcattaaatttaaagctggagaataatctcctttgactccatgtctcacttcttggatacactgaggttgggattgggcccccaaggtcccagaacgttctgcctctatggcttttctgggcccagtctacccagcagctctcacaatttggagtctcatgcctgtagctttcccagtatggagttgcccacttgtggccccatagttcttgattctctgaggttgcctttctcccatggctcctctagtcattgccctagtagtctctctgtggtggctccacccctgtgacaagtttctaattaagcccccaggcagtccacaacatcctttgaaatataagtggaggaagccatctctacacagctcctgccttccacacacctgaacaattagcgtcacatggatgctgctaacatgtatggcttgtacgttctggagcaacaggttgagctgcacctgagctcacttgggccacagctgggttggccaggggacactgtgctggaatgtggggagaatagacccaaggcatccttaggcagagagtccatggaagatgccctaagcccttcacccaaaaccattctgccccactggtgctcttggactttgatgagaggggcagcctcaaagatcttcgagatctttgaaatgccttcaggatatttctcccattgtcttgacaagtagcacctgctcccttcatttatgataatctctttagcaaatggttgcttggcaatacctttgatttgctctcctaaacacaccttttctcctactgtaggagatagcttaaaacacacacacacacacacacacacacacacacacacacacacaaacaccccttttcactctttacatggccaggttgcaaattttccaaacttttctgttctgcttctctattttaattataaattttatctttaagtaatttcttttctcttacatctcactgtatgtggttaaaagttgccaagcaatagcttgaatgctatactgcttagatatttcttcagccagattcaccactcttaaattatgcattctataaagttctaggacacgtgcacaatcctgccaagttttttaaaattatataacaaggatggtctttactccagtttccagtactttgtttctcatttctctctgagacatcctcagaagggtctttactttccctatttctgtcaacattctgatcataatcacttaagtaatctctaagaagatttgaacttctcctatagctctcctcttcttttgagccttcaccagaatcccccttaacattctattcacagccatctaggctttctctagcctgttcctccaaattgttccagcctctgcccattacccagttccaaagctacttccacagttttaggaatttgttataacaacattcccgtctttattacccattttctgtttttatttgttttctgttgttaaagtaaactactacagactgggtcatttataaagaatagaagtttaagccaggcgcgatggctcacgcctgtaatcccagcactttgggaggccaaggtgggtggatcacctgagatcaggagtttgagaccagcctggccaacatggtgaaaccctgtctctactaaaaatatacaaaaattagccaagcattgtggcacacacctgtaataccagctacttgggaggctgaggcaggagaatcacttgaacctgggaggcagaggttgcagtgagctgagatcatgctactgcactccagcctgggtgacagagcaataatctgtctaaaaaaaaaatagaatagaagcttatttggctcagggttctgcaatctgtgaagtcaaagattgagtggctgcatcttgtgaggaccttcttgctgagtcaaaaaatggcagaaagcatctgccttagtccattttgtgttgctatatggaatacctgaggctggttaatttgtaaagaaaagaggtttatttggctcagagttctgcctgaacaagaagcatggcactggtatctacatctggtgaaggtctcagagtgcttccactcatggaagaagcagcagaacaggcgtctgcagagatcacatggtgagagaggaaggaagagaaggggaagaggtgccaggctatttataacaaccagctctcttgggaaccagtagagtaataactcaccccccagggacagcattactctattcaagagggatctacttccataccccaaataccttctactaggccccatcttacaacaccaccatactggggatgaaattttaatatgagatttagtggggacaaacaaaccatacccaaactatagcagcatcacatgctgagaaaacgtgtgtgtgagacagagaaaggaaattgggccaaactcatccttttatcaggagcacacttctgccttaagtaacccattcctgttataacagcattagttcatttatggggccatagcacacatgacataatcacctcttaaagtttccacctcttaataccatcacaatggcaattaaatttcagtattggttttagaggggatattgaaactattgtactctccatttaagttcttatcacttcctgctaaaaattaaaggattttgtcttcccatagagggaatgtcctgtgtctttttcctggcacgtagtaggtgcccaatacatgtttctgaattgaagaccacaatgctactgttttataaagcagatggcgggggaggggtgcatacaaagtaaatggaaccttctgatacctctcaatgcaaaaaaaaaaaatacttctaataattggaaatattgactgttccacaccattgttaagggcatgttagccttactagtaagtggctttcacagaatgtgttgcacaataagatctgtctcttgagtgctgttttaccttaatggagatttttttttttttttttttgagacggagtctcgctctgtcgcccaggctggagtgcagtggcgcgatctcggctcactgcaagctccgcctcccgggttcacgccattctcccgcctcagcctctcgagtagctgggactacaggcgcccgccaccacgcccggctaattttttttgtatttttagtagagacggggtttcaccgtgttagccaggatggtctcgatctcctgacctcgtgatccgcccgcctcggcctcccaaagtgctgggattacaggcgtgaccaccgcgcccggcccttaatggagattttaaaatgcagagtgagcaatagattcattagttaatcgaggcaactagcctccacatagaatttttttgcaagttactttgggttaaagacatttgggttgctgattgtattttcctgtatttttaattctgagctgtgagagtccattcatatatatcgttttctcctagtgccttctgccgattgcaattacctataatgtaaaccactgtacatgatattctgaaggtccttgagaatttgtcgtcaccagtgtattcatgagggaacattccactagaattaaaacaaagaactcgtagctgaacaaacccgggttttaaccccacctctgccacttattagctgtgtgattggaggaaaacaagcataaaatagagacaatgataagattcaacttacagagttgtcttgaggattgattaagcatagtgcctataacatagcaagtaatcaataaagggaaattatttttattacctttgtttatgattatgatgatttagctctgagtgattcttttaacttatcttgccatccttaagcttatacagtcattgacatgtaaaaatgggccttcagagtcctcatctgtttttagccactcgcaaactgctcactgggacctatcttatactttgcttctagaatgattcctgagtttcacatattctgttcctaacacttaataaattctagctattctaactattgttaaaattgcctttacagcagcatttcctaatatgttacccaaatgaaatactcacctaggaaagttcccaagagtaaaaactatttgagaaacaggtactagccataaccctgccctggaaattttcactgtacattagaatattaaataatctaaacagtcctatatgatttattttatgtatataaaatcatttccacagttacaaagtactgcctccccccatgaaagctcttctgtgctgctgtcttaatttctatattcaggaccctcaacattctttcactctctttctacttcaggagtgtccctcaatacgcaagggcatgaagttgcaatcactgggatccagccacagcaccgcagaacaacctgatctgttcattagaagtttccagggagttgcttctcaatgcctttttctatcttggatacaaactcttctagcattagaacatgctctggtagctggcagacttttcctttgataccattgaatcttaaaatgtagccaatggaacaggaagtggaatctatatagaggcggctatgtgccataaatgctcccccatgttacaattcctgatgttacaagccttatggcttgtctttcagtttactgtgctttaatatacctgtgtaccagtgtagtgccataagatccttgttggaataaaagttacttaaggtatgtagctattgagctaggatctcttgggtcataagtaaatgccactttattactatttgagtatttggatttataaagaggtaaatgggagtgattattcaatttgctaatagatccactgaaagattgctttgtaatgctgttccaaagtatatttaaataagcattgattcatatgcacctttctaagatcaaaccattttattagataaaataagggattaccttatttgattccatcccttagcagcattcttaggatctgattttctgtttccgtttagtcggcagatcatgaagaggctttcataactggaatatatattgtgaaatattaccatgtagatctttcctttaccacttgagaaatgcatactttaaacatgtgtttctgtgttttatattctgtggaaagatatcataatttggtttcactttggatagattttgtttgaaaattataaatgacttttatggaaatgagttaggaatttaaggggtgtgccaaattttaggccacctgggtgccattagtatattgtagacatatgttgtctaatggaattcacttagcctaaaagaattaagaggtttccggaaatagcaataacctaatgcattgggcaaggcatcctaaaactagagttacagcaccatggcacatggttctgtggaaaatagcacatccaaatatttcagaaaggatagatgtaatgatcttctagaaaggatctttatgaatcagaaagctgagctgatggtgactgagagcatagatggctattcaatccagaaaagtttttctgtcagatgctatctctgaatgcccttgcccacattgtgagacccataattggaggtctagacgtcctcataggttgtcccagtgtagctgaactatttctttattgcctaaggagttagaaactccctatttaagaagccatgtaattaaccatcctagggtgagttttgctgccaccacagaaccaagtatagtgcagaattttgtacactattggtaggaagcctaaaattccatttttgtcatactgccactgaaaaaactatcagcttatcttcatgagctaagagtgaggctgcctattaatatcatttgcttacatatttaacatattatatgctagtcgctgcactttaaatacatgattccatttactgctcattttgcgaatgagaaaactgaggcttagaaaggtaacttgcctgaggtcacacagcttgtaagtagcagaacagagactcaaacccaggcaatcagagtccagaggtcaagttcttaactatagcagttcattttcagagggtctgtgtgcttatcatgggggcctggaaaagtaaagaatgaaagagttgctttttcctttgaagtaaaagcaagagaaagcactgagttatttttatgtagctgcacattatggacgactattatgtgccaggtaccaataataagtctttatacacattatttttgtaatcgccataagaatatcatgagtttgatcttaatgtttgtccttaatttcaggatgagaaatggagatgtggagtatgaatttgtgtttacttgcccaaggtcacctggctagtaaattggagctggaatttgaacccagatttgtctgactccaaagacaatgctctttaactattatgtatacatttccccagtaagcaactcctaaaacattgaaactgtcacaacctgtatggggatttctcacaactaagatgtcacagtgataggtaagaggaagagaagatcagtgtaataacagcccaaacatcccgtagccttattcagtgatcctagagtcatcctctttaaaggaacacttttctcatgtccttggtcctgtatgcataaaaaatgtattggaagctacctgtgtagtggaggaaatgcccagaggagaaaatggttgagcatgaatattgttcttacgcacgaattgaacagggcatataattcccttgaagcagaaagacattgttccttttccttaggggccatgaaactatagctaagtgaaggaaaaggaggtgagttagagactttgtaacatagaaaatcctagccgtgcccaatcacttttcttcaaagaccaaatgttaacatatcatgggctctttgaatatacttagaaggaatataggcaaaatttagtaaaatttggcctgtatttatggccaatatcatatatagctccacttaaaatgtactttttatctttaagactaacatattactgtcattatatatgttcagttatcccttaacttttgacctgcattaggtcagttttgaacaaaaagtatcgtagttggtcaggttctaattttttaggttatttaaaaagaataattctccctatttgctctttgccctgacaagtgagtaggtcaagtgcatttaggatacagctttgccactgaagtcaccacatcagtcattcagtcatgtatcttattgttttcttctttcatcttccacagcagatgtcctaaacctctgcaactgggctcaagcctttgccccatctgaagcctactcatcagatgaactgtcttgactttgcagatgaaagtccaggggaattcccttagcttccctcttctgcaccttcaaacttaccccatttgtagtcagcctccatcccattccccatcttagagaaaatgtctttcttcctgtgccaagttaatcctcctttcctttttggtatgtgctgtggatcacattcttcctgccccttcaattaccttgatctcaatcagtcttccctctcttacatttctagcttcttccttctcacttcattgactatgctgtctttcaaaatataaatatgctcagataaaggagctctagagactggatgactattggtgctaattggcagggataggacatgcaagaaaatgagttacaggttcactcacatgcttcacctattccctatataaaaataatccatcagtttaatgttctgatctcttaaatggatataataatatgggcatggtatggttcttttgaggatccgatgaaacagtgcatgtcacctcactgaacaatatgtatcaccaaacatagaaactagcacctagtaagtgctcagaaatgataacaattgcagtcatggtgttatttacagtacttatagtagtaatagcaggagtaattgtataggggaattgaactgaaatagattcaaggtgccccttgcttctaaaagtagaagcttgaatcccattgttgcaggacttttccttagctcagctacagatagggttcttgtcacatagccatgaaagattaggcttgcagacaatttgaagggtgagtaaggcagggttttattgggtaaaaaggaaaaaaaaggggaaacagaaactcttagtgaagtgagagagtgtgtttatcctgccagcgggcttcccaacttacagattgaattctgggttccacccagaaagaggagaggccaggctcctccctgctgcaaactgtgaacttctgtggccccaccctatcatgcactcctcctagtgcgcaggcgggctggagtctctctggggactccttcccacctagctatctcaccatagccccactgcccaatcctttttcacagtgtttaatatattacaactgtatctcaaccctctatcatctcctctcaaagcttctcttgttccagacacattggaccacttgacaatccccaaatcaggaggctgtgaactttcacgcctcctgactctgttcatgctgttccttcagtcttccccgcctttcccccttctccataacacctcgaatgatgttctctgatatgtgacactttcctcatctccacactactctgtgcagtgttggttatcccacagtctctatatgtactgtaccacactgtatgttcatagctgacttggttttccatttgctacacttggaactcccagaggacaaggatgagttcagcttggtatctccactgcctaggcattcagtaaaagcataatgattgtggtaatggacaacttctgtggcaccatgacactgcctgccaggtaaggaactgcatggccagtttaacaaaaattttgattacattattagagattctttatttttgaaattttagagcagttaaatagcaatgtcactttcctaaaatttcggattcctgtatctgttgcccttctttcaagcctgcagctctttgtaagtttcagtaataactctgtccacttgcccttccaagtttaagtgtgataacaactttatactcttgctcatccctgggagcttcaccacctcataagggttttgtgagtgctatctatacttctttaaatggtccctttattaaacactcttcagttattcccttgagtgtgctatctattttctgcaaggacactgcccatatgaaatgacccttctctttcagtgaacccaggtagcttttggtaatttgtttccatcaggttattgactgcccctgaggtgtctcgaaagatttctatcccattatctataactgtagtctgggaaagttgttgacaatccgtagcattactatgtgcaacaatgtaaaggtaagaaattgctttgactctcttactgtgaagaatatagtgctacaacctgtcctcatttctgcaggaggagataaacagaggccttctgtatgctttagaatgattgattctaaccaagcatagaaatcctgggcagaggaaaaaccacatttcttgacttgatcttgatcttttaggtcacttctaaacctgaggttgatcttgatttggtgtgtaatcatatcatgtcatcatcatcagatattttgtacctctcatatgtgaggacctataatgctagacacaaaaatgcagggtatgagccttggttctccttcccatattgaagaaactaggctatgggagaataatttgattatttttctttttaaaaggcttgaaattaactttctcttatactcttcctcctgtcattcaattttatcgccattgatccctccactctgttccatgtatttagtcacagaaccatagaaatctcttttaaagcaggattattcaatagaaacataatgtaagccacatgtgtaattttacattttctagtagtcacatttaaaaactaaaaagaaactggtgaacgtaattttgatcatgtatcttatttaacccaatatgtccaaaatattatttcaacatttaatcattataaaaatatttagtgaaatagtgtactttctaaatacgaagtcttcaaaatcttgtatagattttgtacttaaagtacatctcaatgcagatactaactactcatcagaaatattttgtatttcaatttcatcacatttatagctgaaaaagtagattgacattgcccaagtcgttccaggcatactcaaaagttttctgataactgaaccacgtacaggtttttgtatcgaaataaaagtttattaaaattttaaacaagttaaacattcagttgctcggtcacattagctacattttaggtgttcaagagccttatgttgctagtggacaccatcttggacaatgcagttataagctatctctagaatgtatctccttttttcacttcactaataaagcctaagatgaaggctttaccattggctgtttggcctattaccacattctcctatctagcctctttgtctttcattttctgccagcttacctcaggctgtcatgctccctgattcctgaggcattttggtaaatcacatatctggtcacataattttactgcttaagaattctttactgcccactgttgagtgaaatgcaatgcccaattttctgaatatgacttgctggaccctctctgagctggtccctgacaagcttcctagtgtcttagtctgccacccctcatgtatttccctgtactttaaatgcactggactattctccattatctaggagcaccatgcacaaacaaccttccacaaattcactctcactaatgtctcccaaattttgcactttcttcagaacccagatcaaatgccatttactataagaagctttccacaagcccttctatcagacagtggtaactttcccatgtatctctcaaataaaatactttttccactgcgttaccttcagatgtaagttgatttgtctcacgaactagtctgtgagctcagagcagaggttagcaaactatagcccgtgagccaaattgtgtgttttaattaatataggttttttttggagcacacctatgctcattcatttacatattatctattgctgctgtcatgctgcagtggcagaattgaatagttccaacagaaacttaatgaccccaaacccaaaatattgattatcttgccttttgcagaaaaagtttggctacctatgtcctagaggatgaggacactgtcttatgcatcctcagtgctaagcattgcactaggtacatgcaagttttcagtacatgtttgtggaatcgaacaatagataaattgaatcaaattgaattgatgagttttatgaaagttgatgtttctgtctgtaattggtaagttatttgaggacaggaatggttcttgctatttctttagaatgccttatgatatttaccttattgttagttactttataactgttcacttaaataaaagaatttttgtttttccaccttcattctttttgtttaatactatgtaccacctaccattttttctgtaatttctatttgattttacttgtttctcaaggatgcaaatggattaaatcctgagaagttgagtgcctccaatacacaattacataatggaagctgtgaactcaagtcttggcttgatctttggtctaattggctgcttcagataagccacttggcctaacttgttgtttttttctgaatcttcagtgcaaatcacaatattccaccttcaagttattgtttgaagtacatgtgaatgtgatatgcagttccataataagtattatgaacataatttttttaaataaagaaggtatttttctccactaaaaatggagaaataaacattatatgtgctgattttaaacattacttagagtcagcctccattattgaaagttttctgttttgggtaagaaactggtggccaccaatacttccatattaacaccaaaagaccatttggccatcccttttaatgtcatatttaaaaagcggaattctgaaagcaaacctgggaaatggcttccacacttgagccatacatttatgaatggagaacttgaagaacaagagcatacaaatctcagagaaggatctggaggctttatgatatgaaagcaaaaagtacaagagctgtcactggggagttccatttctataaggactttctatgtactagtagctagaagcattcattattcactccaacctccagccttatagtttatgtttctagcttgccttttctcagaattcttaggttaatgacagattctagttactgagcactactatataccatttatatattttgtttatataattgatatcttgtcctaaaaaaaccccactgaggtaggtattaatatttttaatttacagaaaaggatattgagcctcaaaaaggctacataagaagtaagtagcagatctgggttttctacctaagtctctagagcccatactcttaactaccatacaaactgtaagattttctgagattaaagcaatggggcttccgaaaaaaaagtttccatatggtgctttgaaatattctacctttttcctctgaagaatgaagtcctagagctgggagaggccagagaagtcacctgttaagaggctgaatgacttgcccaagttaacttagcaaaattagtggcccatacaattctctagcctcctgacacctggtctactgctctgtatactacatttcaatccacatttctggataaaaatagccaagtgcatacccattttatttttattttaaaattcatttaaagaaaagtatttctgctttgagaaaatgaaagaaaaaaaatgacagccctcccaaagtaaactaaggatgattcttttttaccaaatctttagggaatccagccagagatgccagcacataccgaattgcttgtttaagagttctgctgctgacagtctggggtgctgtgagcaaatctctaaatttctctgagccttaattctcatctgtaaaatgaagaacttgaactagatgaaatataaagtcctttctagcatatgagtgtgtgtgtgtgtgtgtgtgtgtgtgtgtgtgtgtgtgtgtgtgtctgtgcatatatatatccttatataactttaggagtatgattagataactttaggagtatgattaggaggtgccaggaccaattgaaggagatagatttgggctcaaataagaaattccttcgtatggacatagccttccttaagtagactgagataccgtaagtagtggtgaatttcctgtcattgaagttattcaagtagaaatggatagcaacttgttggaaatgtcatagtagtcattcagacattaaattgatgattgggttacaattatgattaatgttattccatacttcacactctgagaaatcaaatatgtagaaatctctaagcacaaccacaaattttaaccctgtgctcaactacacactcattcaacagtcgattattgagtacctttgaggattctaggtactgtgctagaactggagatgtcaagacttaggacattgcctctgtcttgagtgttacagaccaggagtgtgcaaactgtggcccaaaagcctgatctcacccactgtatgttttggtaataatagtttactggaacgcatccatacttattcactttcatattatctatggctacatttacgttacaacagaattgagcagttgcaacagagaccatatggcccacaaaacccaaagtatttactatgtgattctttataacaaaagtttgccaggccttgttgtagataaacatgtacatctgtaacttcaatccagtgacctaagtgggaaactggagaaaacataaaggcagcacatatgattacttcttcttgaacaaggatcagaaatttttcagaggaattaaaccatatcattgtgctgtctttgagtgggaagagacattacaggttataactgtcttcattttccatcagtatctctgcatattgcccctatagcattcatgacacaccactgacattttcttaaaaaggagagcatacatgcaccctacagataagtggcaaaattatataaagtttagcctgccaatttatgcaggagtgacagcaacatccataggttgcctttgcattctaaaataaattaagaaccagttatgttcatgttactgttttaatttaaaaccaaacaatttcagggtctttatctggttcatgctgaggacatcaatctataggaaactcttcaggaaataaaggactagggtccatcctccttcccatacagagggatggaagcccagtgtctgtggccattgttgttaccacaaggcggtatacctaagtcctattaagcaggactcacaagttctcaataatcagttttagggcagatatggaaaaataaccataataatcacatttgccctcctatcattgcagggcctcctgaagtgctatccacacagttgaaattctcaagataaatgttgttgactgattgactgtattcttccaaatttactaccaatctggagaggactacaacagtgtgattaatgatttgtaaaatattcttttcacttacatattcaaagccttaatcctctaattatttttaaaatgcaatgtgagatggatactatgacaataggggtcctgaatgctctcctaataagcagatgaaggtctccttagagcagggatgtcccatcttttggcttccctgggccatattggaagaagaagaattgtctttgagccacacttaaaataccctaacagtaacaatagctgatgaggtttaaaaaaattgcaaaaaaggtctcataatgttttaagaaagtttatgaatttgtgttgggccacattcgaagctgtcctgggcctcatgcggcccatgggccatgggttggacaagcttgccttagagaaaaacaaatcatttgttaaagttttaattttgacatgatttcagacttccagaaaagtcacaaaaacagtactctatagtacatcagtttcctattttttgcaattacaagaaatgctgcaataagtagccttgtgcttacatattttcatattgttggtgatacattttcaggataaattctgatgagtgcgattgctgggtcaaaatacatatatttttgttaaatattgccaaattcccttcagaaattttatatttctaccagcaataggaattgtgcctgtttcttcacagcctcacctacagagtaggttgcactatttaatttttgcctgataggtgagaactagttatcagtgtagttttaatttacatgtccttttttatgagtaagggtgaatattttttcataaacgtaaaagccattttaatatctcttgtgacttattttcatatttttgatcattgttctatctgagatttgtttttttatccccttgaattttaagaattctttgcatattagaggtattagccatttatctgttatatgtgtttcaattattcctcctcttttgccagttatcttttgatttctttatggtttctttatggtatcttttgatttctttatggtaattttgggcatgcattaggtttttggttgttgctatgtagtcagatttaacaatcatttgttttattgtacctggatttggagttctaattaggagaactctttctacacccagtttaagaagaattcacccatgttttctcctagtgtttgtttggttttattgaacaattagatccctgatccatttggaatttatttttatttttactttttttcttcttttttttttaaattatactttaagttttagggtacatgtgcacattgtgcaggttagttacatatgtatacatgtgccatgctggtaatcatggatgtaatgtatcttttcctaaatggtgtccattgttgcagtatcatttgaaaactccatcttctctaaagttatttgagatgtcacctttattatatactaaagttccatattttcttatgtctatttctgaactttctactctatttaactgggctctattgatgtgtcagtaccacacctgcattttttttcattttttcccgcagctttttttggatataattgaccaataaaaattttacgtatttacaatgtacggtgtgacattttgatatatgtatacattgtgaaatgattacgtcaagctaattaacatatgtattaccttatatacttattttttgtggtaagaacatgtaagttttactttcttagcactttttaagtatacaatgtagtattattaactataatcatcatgctatatgtaagattctttgaacttatttctcctatctaatccaaactctgtactctttaaccaaccccatcacccctccccagcccctggcaaccagcattctactctctgcttctatgagtttgacatttttagatttcatatataagtgatatcaagcagtattcatctttctgtgtctagcttatttaacttaacatgatgccctccaggttcacccatgttgctgcaaatgacaggaattcattttattttaacactgattattgtttcattgtgtatatagaccacattttatgtatccattcacccactgatggacacttaggttgattccatatcttgagtattgtaaataacgctgcaatgaacatgagagtgcaagtatctctttggcatactggttttatttttttaacgtgtatccagaaatggaattactggatcatatgatagttctatttttaattttttgagcaacctccatactgttttccatgatagctgtactaatttacattcccactgaatgagaacacaatgatattccctacatcctccccaacacttgttatcttgtgataatagtcattctaagaggtatcaagtagtatctcattatgattttaatttgcatttccctgataattaggatgtcgagcattttttcttatacctgttggccatttgtatgccttcttttgggaaatgtctacttaagtgctttgctcattttttcttttggttatttgttttcttgctattgagttgtttgagttccttatatattttgtatactaatcccttaaatgtatggtttgaaatttttttttccattccataggttatctcttcactctgttcattgtttcttttgctgtgcagaagctatttagtttgatgcaatcccaacaccctttaaattatagatgatttatagtatgttttactgtctagtagggctagtacctgctcatagtttatcattttttgtgtgtttcactggctattgttaatttttccatgtgaggttcagtgacaacttgtctaattctaaaaataacttattgttatttttattgggattatattaaatttatgaattaatttacatatttatactattgagtcatcctatcaaaaaacaagaaatgtctttctatttcttcaagtctactttcctttcctttatggatggagaaaatgtaaattaagaaaaatatagttttgggattttgaatttatacaggatgtgaaaagtatatttaacaagcagaacatgtgcatatgtaacaagcagagaagaacaaattttctccactgccattctaattatattccaagatagaaatgtcctagtccttcctttattcattcatatattctcattggtgactccactgaagccagaaaacatacttaccaaaaccaatgagaatactcataagagatgacagtcatgactgataatactcaaaattcaaaaccatcttaacagtctggaatgatcaacctaaactcaacaagtggagaaaattctgcactgagtcttaaaagtggaattgcataggtgaaagtcaggaaaaagttgcttcaactgcattacttttgacatctggaggaggtatctagattgactgcaaacttaacagagcacggtatttcactgtagcaactgttaaaatggtatgtttatccaagcttcattaaatgggtatcagtagcacatcattgccctagagggtggatcaagaagcagcagaaaagtaaaacaaggaggcaggtgttgtttcaacttggatttcctagtaaagtttatttgaccaaagaatttgagggagagaagaaagagagggagaattagaatgaaggaatggacaatcatagagcaacaacaaaagcagagagctcagttaggaagctgttggtgcagtaataagcagagtatgaggtgctctggctagactccgcaatgatagtggagattatgaaaagttatcagcattgtggaagacagtatggtgattcctcaaagacctagaaccagaaataccatttgacccagcaatcccattactgggtatatactcaaaggaatataaatcattctactataaagacacatgaacatgtatgtttattgcaacactatttaaatgcccatcagtgatagactggattaagaaaatgtggcacatatacaccatgaaatactatgcagccataaaagggaatgtgatcatgtcctttgcagggatgtggctgaagctggaagccatcattctcagcaaactaacacaggaacagaaaaccaaacactgcatgttctcactcataagtgggagatgaacactgagaacacatggacacagataggggaacaatacacgccagggcctgttacagggtggggttgaggggagggaacttagaagacgggtcaataggtacagcaaaacaccatggcacacgtatacctatgtaacaaacctggaaacccgcacgttctgcacatgtatcccattttttttagaagaaatttttttaaaatccaaaaaatttttaaaaagaaaatgttacaaatcttattcatgtaaaaacatgtgtaactatatttcccaacttttctacatatggaatgtattatcacattggtctaaaatcaaggtataaccaagatcatcaggaatggagaggtaggaagtggtataagagccataaattctcctttttccatagtgagacattaacagataccatcaaaagtggaaaaatttggaggtaaaccacttaaaaagtttaaatgataactagatgatgaaccaaaaaccaaagactattcaaaacaagtgcctcatatccaagagaaatgaaaacatgtccacacaaaatcttgtacatgaatgttcatagcaccattgttaataatagcttaaaagtggaaatgactcaaagttcatcacctgatgaatgggtaaagataatgtgggctgtctgtactactattatgataaaaactgaaatattatgcatgccgcaaatggataaactttgaaaacattatgctaagtgaaaggaaccaatcacaaaagaccacatgttgtatgattccacttatgtgaaatgttttagaataggcaaatctagagacagatggtaggttagtgcttgcaggggctgggaggaggagggatggagagtgattgctaatgggtatggggtttctttttggggtgttgaaaacattctaaaattgattgtggtgatggttgcaaaccttgtcaacacattaaaaaccactgaactgtaaaaaaaaaaaagaaagtggttggatttgtaatatattttataggtagaattaatgagatgtaatgatggattggattggggatgagggaacgacaaaaataaagggtaaagtttagtttttgtgattgaacaacctggtggatggtggtgtcatttactaacataggaaatactggagggaaagtaggatagggtacaggtgggactggaaatctagagtcctgttatagtcatgtccattttgagatgtagaagtttgacatagagctacacagttaattactatacagtgtctatcttaaaagagcccctagtcttgttacagaggcagaaaactatttttttattcttttttattattattatactttaaattctagggtacatgtgcacaatgtgcaggtttgttacatatggatacgtgcgccatgttggtgtgctgcacccattaactcgtcatttacattaggtatatctcctaatgctatccctccacactccccccaccccacaacaggccccggtttgtgatgttccccttcctgtgtccgagtgttctcattgttcagttcccacctacaagtgagaacatgtggtgtttggttttttgtccttgggatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgtaataaacatatgtgtgcatgtgtctttatagcagcatgatttataatcctttgagtatatacccagtaatgggatggctgcgtcaaatggtatttctagttctagatccttaaggaatcgccacactgtcttccacaatggttgaactagtttacagtcccaccaacagtgtaaaactgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataagtgtcttcttctgagcagtgtctgttcatatccttcatccacttgttgatggggttgtttgattttttcctgtaaacttgtttaagttctttgtagattctggatattagccctttgtcagatgggtagattgtaaacattttgtcccattctgtaggttgccagttcactctgatggtagtttctttagctgtgcagaagttctttagtttcattagatcccatttgtcaattttgtcttttgttgccattacttttggtgttttagtcatgaagtctttgcgcatccctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatgcttatagatgtgtggtattatttctgagggctctgttttgttccattggtctatatctctgttttggcaccagtaccatgctgttttggttattgtagccttgtagtatagtttgaagtcaggtagcatgatgcctccagctttgttcttttggcttaggattgtcttggcaatgcaggctcttttttgtctccatatgaactttaaagtagttttttctaattctgtgaagaaagtcattggtagcttgatggggatggcattgaatctataagttaccttgggcagtatggccattttcacaatattgattcttcctatccatgagcatgggatgttcttccgtttgtttgtgtcctcttttatttcgttgagcaggggtttgtagttctccttgaagaggtccttcacatcccttgtaagttggattcctaggtattttattctctttgaagcagttgtgaatgggagttcactcatgatttggctctctgtttgtctgttattggtgtataagaatacttgtgatttttgcactttgattttgtatcctgagactttcctgaagttgcttatcagcttaaggagattttgggctgagatggggttttctaaatacacaatcatgtcatctgcaaacggggacaatttgacttcctcttttcttaattgaacaccctttatttctttctcatgcttgattgccctggccagaacttcaaacactatgttgaataggagtggtgagagaaggcctccctgccttgtgccagttttcaaagggaatgcttccaggttttgcccattcagtatgatattggctgtgggtttgtcataagtagctcttattattttgagatatgttctatcaatacctaatttattgagagtttttagcatgaagggctgtagaattttgtcgaaggccttttctgcatctattgagataatcatgtggtttttgtctttggttctgtttatgtgatggattacatttattgatttgcatatgttgaaccaggcttgcatcccagggatgaagccaacttgatcgtgatggataagctttttgatatactgctggattcggtttgccagtattttattgaagatttttgcatcaatgttcatcagggatattggtctaaaattctctttttttgttgtgtctctgccagattttggtatcaggatgatgctggcctcataaaatgagttagggaggattccctctttttctattgattggaatagtgtcagaaggaatggtaccagctcctccttgtaactctggtagaattcggctgtgaatccatcaggtcctggactttttttgtttggtaggctattaattattgcctcaatttcagagactgttattgttctattcagggattcaacttcttcctggtttagtcttgggatggtgtatgtgtccaggaatttatccatttcttctggattttctagtttatttgcatagaggtgtttatagcattctctgatggtagtttgtatttctgtggcattggtggtgatatcccctttatcattttttattgcatctatttgattcttctctcttttcttctttattagtcttgctagtgatcttgttagtgattttgttgatcttgtcaaaacccagctcctggattcattgatttttttaagggttttttgtgtctctatctccttcagttctgctctgatcttagtaatttcttgccttctgctagctttcgaatatgtttgctcttgcttctctagttctttccattgtgatgttagggtgtcaattttagatctttcctcctttcttatgcgggcatttagtgctctaaatttccctctgcacactgctttaaatgtgtcccagagattctggtatgttgtgtctttgttctcatttgtttcaaagaacatctttatttctgccttcattttattatgtacccagtagtcattcaggagcaggttgttcactttccttgcagttgagcggttttgagtgagtttcttaatcctgaattctagtttgattgcactgtggtctgagagacagtttgttataatttctgttcttttacatttgctgaggagtgctttacttccaactatgtggtcaattttagaataagtgcgatgtggtgcggagaagaatgtatattctgttgatttggggtggagagttccgtagatgtctattaggtccgcttggtgcagagctgagttcaattcctggatatccttgttaactttctgtctcgttgatctgtctaatgttgacagtggggtgttaaagtctccctttgtcattgtgtgggagtctaagtctctttgtaggtctctaaggacttgctttatgaatctgggtgctcctgtattgggtgcatatatatttaggatagttagctcttcttgttgaattgattcctttaccattatgtaatggcctttgtctcttttgatctttgttggtttaaagtctgttttatcagagactaggattgcaacccctgcttttttttgttttctatttcattggtagatcttcctccatccttttattttgagcctatgtgtgtctctgcacatgagatgggtctcctgaatacagcacactgatgggtcttgactctttatccagttttccagtctgtgtcttttaattggagcatttagcccatttacagttaatgttaatattgttatgtgtgaatttaatcctgtcattatgatgttagctgattattttgcttgttagttgatgcagtttcttcctagcatcgatagtctttacaatttggcatgtttttgcagtggctggtaccagttgttcctttccatgtttagtgcttccttcaggagctcttgtagggcaggcctggtggtgacaaaatctcttagcatttgtttgtctgtaaaggattttatttctccttcacttatgaagcttagcttcctacctccccatacatccaagctctgcttttaattgttttgtcttgagtttcacatagtgtttcagttacataaactgaaatttgctgttgtaaaacgtaaaaataatagaaaataatcattcattttttttttgctagtaacatcagttttatatcactggggcatcgactataaagcctggctgaaggcagggccggccctcaacagattacatagttagagtagggtctggttcaaggtctggtgagtctccacattcttttccttgggactattcgtggtcttctctagcttattggtggccttctccaattttgctgtagacctttttgtaaattctgcttgagtctcaacccccttcagctttttctccaccaatttgatatcctctgcgtatttacacattttcatggaatattccctctctaaggccctcagtgccttgatggcctagtccatggcttgaagtttctcctccagctgtctggctcagatcttggtcacctgagctatctctcctgagtgatctagttttcctccccagatcttctcctcatacttcatgggctggtatttgatgaacttcatccttctgtccctctcattggctacctactgagtatcttccagcttttgcagggctacagccagatgcacctgtgccagtcaagctcctcttctatctgctcaatgaggcgttttatagagaccacatttgcctcagcaacagtatccttatcttcctgttccagtttctccaagatatcattcatgaatttaaatactcttctgtgtcatctcctgtccccttcagattcttctggaggccctgctgctcctcacccagctgtttgtagcagtcttcagtttgcttctcattggctttgacttcctcgacggggttggtggcattatccttctccacctttagcgtctgaattttcttattgatagtgtccatggttacagtggtggatgggccacctggcacgcagtgaggatggggcagattttgctggctccactgactgagattcacgctcctaatatgactaaagtctttcaataagttgggagattttttttcagaattgttggctgcttctgaaacataagaaagtttatttttatgattaggtaagttatatagcagaaaaaatatgaattttaaaaggagaataaaccttcaaagttaacaacaaaaatgactagagtaagatgccactgaactaaatgattaagagaatattttggaaaactatgttattatataaggatcttattttcattaacctagttattcattaacagccatttattaaacacccatactgagtcaagtgccatgcttcatcctagggtcacaaagacgaactagatgcaagggttgtagacttttttaatcaaataataagccataccaggttttgagtagtgacccagcattcccctttctctttaggattaaaagtgggagtgaaaaaagggggagttaatcaaggggcataaagtttcatttaagcaagatgaataagatctaaagatctgctgtacaaccttgtacccatagtcaacaataatatattgtatgtgtaaaaatttgttaagagggcagatttcatgttgtgttcttactacaataaaataaaattttttgaagaaaataaatgtttttgaattggttatatcctaaaatttacagaatttaactggcctttatgcttttttgaattatgcaatttttgtttctcattccaactacttagcagatgattgattagattgtagagcctaaaatattcccccactctcacccttgacttcagattgctggagcacaggtccaatcaaatgttgcatttaaaaaaaatacaatccatgcaggcaatttaatgaaagcatcagccatttttgtagttagattccttcctaaaagtatgggtgtgcttatgtttatcacaattttctcaattcagttaatttcaaggttaatctgccaactgtctgaacatatggcaaagtattttaaatgggtttaagggaaggaaatgatgagatttcctcagacatcaatcttagcatctgatattaccttgtatatttattttccccaagttaccatatatagatgatttttgttatccgtatctgagggtatttatataaagttgaatgtgtaggaagttatacatctccaaatttgtgtttacaaaacatggataaacccaggtcaattaatatttcacctgcttaaagcatctgccttttcaatttgattcgtgtcaagaaataatttttataagatagttttatcctgaatgaatcatgataccatttagtattaactgctattatccatcttcaccctatgatcaatctgatatttcaatatttatttaaaataagatgggatcttttagaccccacattctgaaatgaagttataagactgtaaagaatctgtttctaatattaaaattgttttaatgtatagtttagtggaaaagacagtctgaaaaatcaaataatcatatgtttccaagtttaccacaacatagtacaaagaaagattgaatgtgaactgttttttaatatacttatacagcacagacttgaatcgcaaggcggccttctaaaaataggacgtgtgtacttacacaaatataacctaagtcaaattgcatagtgacctatcatgttaatgattccccatttataaaccaggaagatctcaatattatatgtggtttcaagtgtatgtgtgtttgtgtgaatgtgtacacatcccacagaaacatacataatattggaataattcatgctgaagaattatggttaaaagtgcattcattgaacaattaatggctccaaataatgattgtggccacataccctgggaaactggtgcacagtgaattgcacagttcaggtgaaggtgacatatgacagataatgatggtggcaggaagagctgtgacaatgagatagagagcattttctgagaaaatataatgccacatttgaagaatttagctgtccatgagaataaagtgaatggttctgataaggtcaggaaaacgggtttgagaggataaatcagaagcagagtgcttgctgtttaacttcagtgccttttccttgttagggagctaaggatattttaagtgaatgaaaaagaaaatgtaaattctgtgggagcaaagtgtgtcaggtttttaaagcatattaagtctaaatgtggtaatgcattcctcactttggaggggtcacctggagagctgactcctttcagaaatgatggcacagactgcaccaaagtgagcattattggttagagtatgaatttatttttttttcatttgcttcttactttcaagccacacgctatgctgccactgcatttggcatcaaatcaaaagaccaactctgcttcacaggaagaaatgtcaccacaaagttgtgctttttgtgaaaactgtgctgttgctatttttctgaaatgctgtggaattgtgtggaacagaggaaggcctcatcagaactctgggccaaaacattatcagctagtcatgaaggacatagaaatggatagctgtagtagccaagagattccctacaatgacatcgtcagataactgaggtagtatcttaccagtttcatacactcttagctaaaacatcacactctggggctcagatgtcatgcataagcttggcctctaatatagattctgcgggtaatgctcctttgggcttcacccagtaggctgtgaggatggaaatcctaaaggtttagtctgaactgccaagaccctcacccaggaaaataaattgtgagagagactagcctaagcagaaatgaataccatggaatggacttcaataaacatgagatgatgcccactccaagcagtctagatgctcatcttgatctaatttctagagctgtacctcttacctgccctgttagctaatggaagggatcttacagatttctactcaaattctttatctaatggttggatcacctctgaatcatcctcacgtgctttcagcagtagcaattatgtagccaagataggtcataccttcacatccaaatagagagaacttcaaatcctagtgatttgaattggtagactagaaatggtggcagaaaggctaattaagagatagatacactataataagaaagaggtggtgagcctgaaccaaagtagttgccattagagttggagaaatgcaggaataattgggtaaaaagttccaggagaacttggtgttggcgtggatgtgtggctcagagagagtgaagaaaaaacaatgagtctgaggtttcaagtcttggttccttaataaacagaggtgcttttcctagaaagaaataagaaggaagagttagtggaagttgtttagccatgtttcaaatattaagagtctgaggtgctgaaaaaacatggcattctgcaattgatgctttggagggggcgaaaatttgaggagaatggagtgagtaatacataaaagtatgtgagaccaacaaggaagagcatgtagatagagaggaaagggagtcagggatagaatccctgtgaatacttgcttttagtgcagagaaaggaaaagacaaagagcaactaggaaaaggaggcagggaacagtggtcagaaaggtaagaagaaaactaggacagcacaatgtcatagaagccaagatacaagaggagttggccaataatatcagatacttaaaaaaattcaaggaagtgttccttttaggacatctggcaagttggccaaataggaacagctccagtctgcagctcccagtgagaccaatgcagaagatgggtgatttctgcatttccaactgaggtccccagttcatctcattgggactggttaggtagagggtacagcccagcaagggtgagcagaagcaggatggggagttgcctcacctgggaagtacaaggagctgggaccctacctcccccagccaagggaagccgtgagggactgtgctacccggctgacatactatgcttttcccatggtttttgcaatccacaggccaggagattccctcgtgtgcttacaccaccagggccgtgggtttcaagcacaaatctgggtggctgtttggccagacactgagctagctgcagtagtttgtttttgtttttgtttttgttttcataccccagtgatacctggaaacccagcaagagagaaaagagagaactgtttactcccctggaaagggggctgaagccagagagccaagtggtctcactcagtgggtgccactcccatggagcccagcaagctaagaaccactggcttgaaattcctgctgccagcgcagcagtctgaagtccacctgagacaatgaagcttggtagggggaggggcatccaccattactgaggcttgagtaggtggttttcccctgacagtgctaagaaggctgggaagttcggactgggtggaacgcaccacagtgcagcaaagcagctgtggacagactgcctctctagattcctcctcactaggcagggcatctctgaaagaaaggcagtagccccagtcaggggcttatagataaaactaccatctccctgggaaagagcacctgggggaaggggcggctttgggtgcaggttcagcaaacttaaacgttcctgcctgccagctctaagagagcagtagatctcccagtacagtgctcgagctctgctaagagacagactgcctcctcaagtgggtccctgaaccccgtgcctcctgactgggagacacctcccagcaggggtcaacagacaccacatacgagagaacagtggctagcatcaggcgggtgcccctctggggtgaaacttccagaggaaggagcaggcagcaatctttgctgttctgcagcctccactggtgatacccaggcaaacaggacctggcatggacttccccgaaactccagcagacctgcagaagaggggcctaactgtaagaagaaaaactaacaaacaaaagcaataacatcaacatcaacaaaaaggacgcccacacaaaaagtcccattcgaaggtcatcaacatcaaagatcaaaggtagataaatccacaaagatgaggaaaaaccagcacaaaaatgctgaaaatttcaaaaaccagaatgcctcttctcctccaaatgattgtaactcctcttcagcaagggcacaaaattggacagagaatgagtttgagaaattgacaaaagtaggcttcagaagatgggtaataacaaactcctctgagctaagggagcatgttctgccaatgcaaggaagctaagaaccttgataaaaggttacaggaactgctaactagaatagccagtttagagaagaacaaaaatgacctgatggagctgaaaaacagagcaagaactttgtgatgcatacacaagtatcagttgctgaattgatcaagtggaagaaaggatatcagagtttgaagatcagcttactgaaataaagcatgaggataagattagacaaaaaagaatgaaaaggagcaaacaaagcctccaagcaatatgggactaagtgaaaaagtgaaaagaccaaacgtacgattgattggtgtacctgaaagtgacggggagaatggaatcaagttggaaaacacacttcaggatattatccaggagaacttccccaacatagcaagacaggccatcattcaaattcaggaaatacagagaacaccacaaagatactcctcgagaagagcaaccccaagacacataatcgtccgtttctccaaggtcaaagcaaaggaaaacatgttaagggcagccagagagaaaggtcaggttacttacaaagaggagcccatcagactaacagcggatctctgtgcagaaaccctacaagccagaagagagtggggtccaatattcaacattgttaaagaaaagacttttcaacccagactttcatatccacccaatctaggcttcataagcgaagcagaaataaaatcctttacagacaagcaaatgctgagggattttgtcaccgccaggcttgccttacaggagctcctgaaggaagcactaaatatggaaaggaaaaactggtaccagccactgcaaaaacatatcaaaatataaagatcaatgacaatatgaagaaactgcatcaactaatgtgcaaaataaccagcaagcatcatgatgacaggatcaaattcacacataacaatattaatcttaaatgtaaatgggctaaatgccccaattaacagacacagactcgcaaattggataaagagtcaatacccatcagtgtgctgtattcaggagacccatctcatgtacaaagaaacaggctcaaaataaagggatggaggaataattaccaagcaaatggaaagcaaataaaagcaggggttgcaatcctagtctctgataaaacaaatttaaaccaacaaagataaaaaaagacaaagaaggccattacataatggtaaagggatcaatgcaacaagaagagctaactatcctaaatatatatgcacccaatataggtgcatatatatgcatatatacacacccactttcataaaacaagttcttagagacctacagagacttagactcccacacaatattagtgggagactttagcaccccattgtcaatattagacagatcaatgagacagaacattaaaaaggatattcaggacttgaactcagctctggaccaagctgacctaatagacatcaacagaactctccaccccagatcaacaaaatatacattcttctcagcaccacataacacttactctaaaattgaccacataattggaaataaaacacggttcagcaaatgcaaaagaatggaaatcataacaaacagtctctcagaccacagtgcaatcaaattagaactcaggattaagaaactcactcaaaactgcacaactacatggaaactgaacaacctgctcctgaatgactactgggtaaataacgaaatgaaggcagaaatgaataacttctttgaaaccaaagagaacaaagagacaatcttccagaatctctgggacacagctaaagcagtgttaagagggaaatttatagcaccaaatgcccacatcagaaagtgggaaagatctaaaatcgacaccctaagatcacaattaaaagaactagagaagcaagagcaaacaaatttaaaagctagcagaagacaagaaataactaagatcagagcagaactgaaggagatagagacacaaaaaacccttcaaaaatcaatgaatccaggaggtggttttttgaaaagaataacaaaatagatggaccgctagccagactaataaagaacagagagaagaatcaaataaacacaaaaaaattataaagaggatatcacaactgaccccacagaaatacaaactgccatcagagaatactataaacaactctacacaaataaactagaaaatctagaagaaatggataaattactggacacatacaccctcccaagactaaaccagggagaagtcgaatccctgaatagaccaataacaagttctgaaattgaggaagtaattattagcctagcaaccaaaaaaagcaaaggttaagacagattcagagacgaattttaccagaggtacaaagaggagctggtaccattccttctgaaactattccaatcaataaaaaaagagggactcctcccgaactcattttatgaggccagcatcctcctgataccaaaacctggcagagacacaacagaaaaagaaaaaaaaatcaggccaatatccctgatgaacatcgatgtgaaattcctcaatcaaatactggtaaaccgaatccagcaacacatcaaaaagcttatccaccacgatgaagtcaacttcatccctgggatgcgaggcaggttcaacatatgcaaatcaatcaatgtaatccatcacataaacagatccaatgacaaaaacctcatggtttatctcaatagatgcagaaaaggcctttgataaaatacagcaccccttcatgctaaaactctaaaaaaactgggtatttatggaacatatctcaaaataataagggctatttatgacaaacccctagccaatatcatactaaatggacaaaggctggaagcattcctttgaaaactggaacaacaaaaggatgccctctcccaccactcctattcaacatagtattggaagttctgttcagggcaatcaggcaagaaaaagaaataaagtgtactcaaattggaacacaggaagtcaaattgtctctatttgcagacgacgtgattgtatctttagaaaacctcatcatctcagcccaagaactccttaagctgataaacaacttcagcaaagtctcaggttacaaaatcaatgtgcaaaaatcacaagcattcctatacaccaataatagacaagtagagagccaaatcatgaatgaactcccattcacaattgttacaaagagaataaaatacctaggaataaaacttacaaggtacatgaaggacctcttcaaagagaataacaaaccactgctcaaggaaataagagaggacagaaacaaatggaaaaaaaaatccatgctcatggataggaagagtcaatatcgtgaaaatggccacactggccaaagtaatttatagattcagtgctattccattaagctaccattgactttcttcacagaagtagaaaaaaaaaactacctttagtttcatatggaaccaaaaaagaacccgtatagtcaagacaatcctaagcagaaagaacaaagctggagccatgatgctacatgacttcaaactatactacaaggctacagtaaccaaatcagcatggtactgataccaaaatagatatatagtccaatggaacagaacagaggcttgagaaataacagcacacatctacaatcatctggtcttcagtaaactttacccaaaaaaaagcaatagggaaaggattccctatttaataaatggcgttgggaaaactggctagccgtatccagaaaacagaaagtggattcctttcttacaccttatacaaaaattggctcaagatggattaaagacataaacataaaacgtaataccataaaaaccctagcagaaaacctaggcaataccattcaggacacaggcatgggcaaagacttcatgactaaaacatcaaaagcaattgcaacaaaagccaaaattgacagatgggacctaattcaacttaatagcttctgcacagcaaaataaactatcatcagagtgaacaggcaacctacagaatgggagaacatttttgaaatctatccatctggcaaaggtctaatatccagaatctacaaggaacttaaacaaatttacaagaaaaaaacaaccccatcataaagggggcaacgtaaatgaacagacaattctcaaaagaagacatttatgcggccaacaaacatatgaaaaaaactcatcatcactggtcattagagaaatgcaaaccaaaaccacaatgagataccatctcatgctagttagaatgacgatcattaaaaagtcaggaaacaacagatcctggcgaggatgcagagaaatacactgttggtgggagtgtaaattagttcagccattgtggaagacagtgtggccactcctcaaggatctagaaccagaaataccatttgacccagaaatcccattactgggtatatacccaaaggattacaaatcattctactataaagacacatgcacacgtatgtttatcacggaactatttacaatagcaaagacttggaaccaacccaaatgcccatcaatgatagactggataaagaaaatgtggcacatacacactatggaatactatgaagccataaaaaaagaatgagttcatgtgctttgcagggacatggatgaagctggaaaccatcattctcagcaaactaacacaggaatggaaaaccaaatacctcatgttctcactcataagtgggagttgaacaataagaacacatggacacatggaggggaagatcacacaccgggcctatcggcgggtgggggacaaggggagggagagccttgggacaaatacctaatgcatgtggggcttaaaacctagatgacggattgataggtgcagcaaaccaccatggcacatgtatacccatgtaacaaacctgcatgttcagcacatgtatcccagaacttaaagtaaaattaaaaaaaaaagaaagacacaaaacttactaaaaaaaattcaagaagaatgtgtcatctgaaacaaagtcattggatttgatggttagaacatcattctctccctttattataacatcaatactgccaccaccaagtctttaataatggttcacttcaccaacctcagtgatcagtgcttgaaggacactggagaagtaaagtgattcaactttaatttattcctttaataaacttttgttggactttactgtaagccaggcatcatgcaaggtattagctctctgttgccactgaggtataatattagcagtgcctgctccctgctttatagctgggtcttagtataatttttcatagttcttcattatatcttcaaaagtatcctgatttggacaataaattatatttatgtaattatatttattacttatgggccagtccagtcctacatttcttttagcatgaacttgactggaatgaaacatctatgttggccatgtggtctatgaaaagaaccattttcaacaccattgtctttccaacataggctgtgtgttcctgaactcacctgtcccagacctgctatctatgtgttatctgccaatcaaccatgacagccattcaatttggattgatcttgatgattcagagtaactctgtcacttacaggaataacttatagtacaaagtatcctaaaataattgtgtattttagcactgttttgtgtcattgtgtttattgtaggactttttgccaaattatatagtgtgaagaatgagtaaggctagtagaactgacctggttaaactaaaatttctcctctatagaagctagactcaggatatttttagctggtcaataaagagttaagagtgttagctagaggcacttgggaatccaggctgtgcttatttctcaggtttatgaataacttaaacctatgtaggagttaattaatttggctccattccacctacagtttagcttcttgagcgaataacttgacccctcctatactctgagttcgtagttataaagagaactcccaacagaatgaataaaacctcacttggattgtctgagtttaacttcttgcatactttcatggagaaactataagatgtcaggcacagcacaaaatgtcaaaatacctcttcagttaaggacaaacacaggcattgtactatttctggctagagttatttatgattctgtttttttctctcttaaatgactgacattctgaagagggagttaacctgtgacttggtaacagtgatagagactgttaaaagcacaccgaattttgctcactgcatcctgacctctcctttccctagagaatagttcaaaacaaattattacctttgggacgataggtcagtttccttacctttgatgttctccgcgactaaataagaagttacaggtattttctcacttgtcagaattttaaaaagaccacccattaggttggcagatcttccttgtaatacctctaaaaggacatgagagatcagactggaggtaaggcctgttaactgagtgaaacagatgagctgaatcatatgatgtcgcaatgtaaatgtcacaatgtaaatgaagtgtgacttcatagaaagtactcatgtcactaggatcatccaatcttcatagctactcaagtgcatgccttcactgaacatcatgacattctagagtatagcctattagctgtgatggcaacttgtatagttttgctgacttcattaaaaaaatttaatccttatgaatcattcatttcataaatgtgactacattttatcctgagttgcaaaaaatactggctggggacaatcgcattactcacccaaacaattttatcgtaagatctgagaaacaattaccagataaggtgagaagccatcacctattttcagagttataaaatatactggatttcaccatttcccccactttgagaatttgttccaggatggaggggaggctgttgttctgagccatcttccacttaaattagagcattgggcatgggagtacagtccctgccccttgctcccaaaccacctggaggagaggatggcaatgttagagctgcagcctgaggtctcattactgaatggagcagcaactaccatttagtgagcacttattttgtgtcaatgatattgcatgtaaaattgcaatattgaatttaatcctgacagcatctcaatgagttagttattgtcactatcccaattttacatacaaggaaactgagaagcttctagtcatgttagctcaaaataactgtgaccttggacaggaccagaattctaacccaggtttttaggccaaagcccatgtggacttcactacatcatgaatcttcagatgaagtttaaaggcagggcaaattgacctaattgaagcctagctgaagccctcacacgtataggttaatacatgttgtacggtattaattcctcctctgttagaatttttacattcagaattatcaagaatttactgacacacatattagaccaggagatgtttccaatcacagggcatttactaggtcctgactgccacccattgattccctatgccttgcagtccaagaagtttggcctgcaccctgaatgctgaccatcctggaatctgtagctggggatttgtaagaattaaagtactcagccctagaggtaaatggaactatcctcttgtgtatctagaaatgaaggtaccttaaaccatgctcagagcacgtagtagtttcctgtggttgccgtaacaaattaccacaaatctggtggcttaaattaatagagttttattctcttgagtttctggaggcaagaaatttaaaatcaagttttcaccagggcactctctctagaaggtctagaggagaattcgtttcaagcttcttgtagcttatagtggccccaggcattggtgttccttggcttgtggctgtagcacttcagtctctacctgtcttcgcatcacttcctcttcttatgtgtcttctcctcttctgtcttaagtattcctatgccttccttttataaagaaactgctgtttttgaatttagagcctatcagataatccaatataatcttatctcaaagttcttaattacatctacaaagaccccttttccaaacatggtaacattcacaggttacaggagttagggcagggacatgtattctgggggaatataactcaacccactacaggggacttgacatccccaactgtgctctgaaatacaggaaaccaggatgtacagggccaaattggaccactaggaatatgaagagagaattatggctgccttccattcctactttttaaaatatcactcctcactcatcatgccccatcagtctccagattctcttaacagcctgtgggatcagtctcaggccatcctaggtccatttgttcactgaaacaaagtagtataagagaaagagtataaatttaggaatatgacagaagttggttaaaagctactccaataattcttggtgatatggccttggataagttattttaacctctctaggactcagaatgctcacctgcaaaatagaaatgagatcactttggtcacatgctctagggagaaaaaaatatctaggctttggagacaaggagacatgggtttatttcctggctctgccacccactatctagccatgcaatttggggcaagacattgaaactctctaaaccttagtttcctaatctgaagaataggcgtaataacttgaagagatgtcaagatttaattttaaaaagtacagaaaatatagttggtgtcaattcatgtttattaaatttatcgttgttattgttgttgatgtcagctacaacttacagagtacctagtctatgctagacattctgccatgcatgatggagcaatgcagatatgtatctcagtcctcctatagagcagattgatcgtaagggagaaagatagtattattgtgagaagctagcaacactactcagctttttggccactaaaattattttctttgaatacagttaagtcatctttgctcttgggtaaaattgcataaattttaggaatttagaagggaatgaagaagctggaggtgaattaaatattaatgggcaaacattttaactatggttaaaattttgatatcaagaccacagatcaaagctaatgtcttttctgtcaaaattcgtagattttaaatatatcctgggggtaagttgagaaatgttgatgactaacaaatgaaccttttaaaattgcatttacttttctagctgaatgctcctggagtttttccaatgatgttcattagggtgacaaaaccagcttgaatgtacataaatatcttgctttgtacagaaattaaagtgttggtacagacattaagatactaccattcaggccactgagagagccttccaggacaacaatctaggagttattacttcttcctttgattgcagtttcatacaaagcagtagctaagtcttctgtgatcagttcaaatgcaacagcacaaccaatggtagaagaaagaactttccaaataaaacagccaattaacagtttgacataaaaaggtgggcctagctatcattctagagattaggtaaaggaagcacaactttttggtttcatgaataggcaaatccaggttttgaggatccattgttgtgttcgtttattcaacagacagtgactaactacagccatcagttggtacttatgaaggattggttctagaacccccctccacaatgtggataccaaaatctgaggatgccatagtgccctatataagatggtgtggtatttacatatgacctacacatatcctctggcatactttaagtcagctttagattacttaaaataccttatacaatgtaaatgctatggacatagttgttatgctgtattggttttcttaaagttttggttttctttttgttaaatttttatctgtacatagtagttgtatatatttatggggttcttgacatatttttatttgtattttttattgttacacagttttttattgttttttctgaatatgttttatgtgtggctggttgaatctgcagatatggaactcacagataaggaaggttgactgtacttgagtacaccagccttatgtcaggtgctggcaatatatagataacaatgacttagccttaacaggtaaatttgaaatattttggtacactatggtgcattttggaaagggtatggcaaatagctttgaaagtacagaggaagtaaagcatgcctatgtcttagagagtcaggtgaggcttccaagaggaggggacaattcagctgcatttgagaagatgaataagaagcaaacataggattagaggcagacattttactaaaggcagaggccaaaggcataaggatgagaaaacacaaagaaaccataaggtagatgaaggtgatgagagaaagagttggctctttaggtctgaacttatgtgggaatcatttctgaggtgggttcgccaggaccaggtgatggataggctattgaaaaggaaaaagactgtggaggcaggcaagccatgaggttttagggttggatattggatgggcagttcaggtttgctccagtgccatggatgaaatattgtgtcctcccaagattcatatgttgaaactctaatcccaatgtgatgatattaggaggtggtgcctttgggaggtaattttgggagggtagagtcctcgtgatgtgattaatgcctttatgagaagaggctagagagatagctagttctctttcccccatgtgaggatacaatgggaaattggctttctgcaacctggaagaaggcttcaccaggatccaaccacgctggcatcgtgatcttagacgtccagcctccaagactgtgaaaaatagtcctggaggctggaagtctaagatcatggtgccagcatgtgtgtgtgtgtttgtttttttttttttttttttttttttttgaatggagtctcgctctgtcacccaggttggagtcaagtggcgtgatctcggctcactgcaacctccggctcccaggttcacgccattcttctgcctcagcctcccgagtacctgagactacaggcgcctgccactacgcccggctaattttttgtatttttagtagagacagggtttcaccgtgttagccaggatggtctcgatctcctggcctcgtgatccacccgcctcggcctcccacagtgctgggattacaggcatgagccaccgggcctggccgtgtgtttgttttttaaggccactccatctatggtcctttgttacagcagcctgaactaagacagaaattggtactaagaggtgggttctgatacaataaatacctaaaatgtggaagtggctttggaactagataccagaaactggaggaattttgaagtgcattttggaagaagctggtggtgaagggacttttaaagatgattctggtgagagctcagaaaggaaagaagaacactgtagacaaaacttccatcttcttagagaacaaataaataatcctgggctgggcgcggtggctgacgcctgtaatcccagcattttgggagaccgaggcgggcagatcatgatgtcaggagatcgagaccatcctggccaacatggtgaaaccccatctctactaaaaaaaaaaaaaaaaaatacggaaattagctgagggtagtggcaggcacctgtaatcccagctacttgggaggctgaggcagcagaatcgcttgaacccgggaggcggaggttgcagtgagctgagatcacgccattgcactccagcctggcgacagagggagactctgtctaaaataaaataaaaataaacaaatgaataaataataatcctgtatagaatgcaggtagaaatatgaataaaggccattctgatgaaatttcagatggaaatgaggaacatgttactagacaatgaagaaaagatgatcctttttatgaagttgcaaagaacttagctgagtcatgttcatgttttggtgttttgtggaaggtggaacttgtgatgaaattggatatttatttagctgagcacatttctacacaaactgttgaatgagcagtttggttccttctcactgcttatagtaaaattcaagaggagagaaatgacttcaagatggaattatgcaaaaaggaactagaacttaaagatttggaaatttctcagtatgtccatattgcaaaaaaaaacaaaatgtgaaagtatgtttgaccaaggaatctttgacagggagattagcatggatgtcaaccacaaacataatcagctaccccaatagaaaaaactgacagtttgaactgaagggaatggagatgggaaggaatggaggaaggctgtcagacttcttagattgtattggacaggaccacagagttatttgcttgaaaatgtgctttattcctgaagacaaggcaagaaggatcctaaaggtgattcagagatcattagtgccactgcctgagtttcaaaaggtcaaacaatctccacccatagccatgacgtatgggatacccagagccttaggggcctgacccctgcccagcagagttgcaggggcaagatggccaccccagtgggtccagaagttgggacctctgccccagcatgttcaggagacgagacctccatctcaatgggtctagagggcagagcattaagccaaaaaggattattctcaagccttaagatctcatggaatttgccttgctaggtttcagacttgcttgcaactggtcaccccttctttctttcctatttcttcattttggaagggaatgtctatcatatggccatctcaccactgtattttggaaagacatgacttgcttggtttcacaagtttataaatagagaagaattttgcctaaggatgaattgtaccttgaatctcatccatatctgatttagatgacatttagatgagactttggagttgaaaattaagaatttgggggttggtttgaatggaatgaattattttgctattagaaaggacaagaattttgggaagccagattggaatgcaatgaactgaatgttttcatcctcccaaaatccatatgttgaaatccaatcccaatgtgatggtattaggaggtgtggtctttggcaggtaattaagttatgagggtggagccctaatgatgggattagtgaccttataagaagaagacagtgttctcactcataagtgggagttgaacaatgagaacacatggacacagggaggggaacaacacacaccagggcctgttggggggtggggggcaaagggagggagagcattaggacaaatacctaatgcatgcaggacttaaaacctagatgacaggttgataggtgcagcaaaccaccatggcacatgtatacccatgtaacaaacctgcacattctgtacatgtatctgggaacttagagcaaaataaacaaacaaacaaataaacaaaaagaagccagagaactaactggctgtctttctgccatgtgaagagacaaagggaagttggctctttgcaatgcagaagactactctcaccagaacccaactatgctggcatcctgatcttgaatttctagcctcaagaactatgagaaataaatgcttgtttttaagccatccagcctctggtaatttgttatagctgccccaaatgactaagacatccagtgtctgttatggggagcagcactctttctctgtgcagcaaaatctgggctgccaaagccaatacttccctgatgcttccacagccccatctggctgattaagggctaattcaaatatcaattaatcgttcctcatttaatttcttttaaaacattttcacagtgcagataatgaggaagaatattctgctttgaaaagtcaaacaaaaccctccactttaaagaaattagtctaaaactgttgcaaattgtaaactagtaagtgagcagatagtgacaatttggtccaggagcttaagatttctctgtttcacaagggaaagattaaagcgttgcttcactatgtaggatttcccaaaaagaagggaaaatgcccagttacagtttttccaaaatgacctattgcatttcctctccttgacttggtgctaatagaactggtgatatgttgtgacctgaaaagtagaaactaatgatggaattgtggtgttaatagggaccactttaacactatgaaggcacagaaaggttatgtgccttgcccagcatcacacactagttattagcagatctacatgggacctgaagtcgagaggccaaaaagtttctgttgcctttccttgggtcattgctgcctctggcttgctggtgaatgatcattggatttggctaagtgaggatacagtaggaggtgaagtaaagagatgggtgggggaattctgacaaactctgagaggcaacaagttgtctgactcactgtgacaccttgaagaaataagcatgcttgaagcaggggctttatattagagaaatttggaaagtagtcccccaaggaaggctctggaggtggcagactgagtcatccttacttggaaaagagctgccatggtcttttgatttcctgccagtaaagcagcttcctcctcttcaggtgcagatacagagtgggtatttatactttagttccatcccaccttggcccaattttttttttctggggagtgaagatggaaatccctctgtggcttttcctacaggactagttggaaaaataggcagaaaaaggagtttggattttattatgtctgttgggtagttcctagaagatcttaagaaaaggagtgaatgctttgatttatttttttaaatagattactctggttctgagtgaagaatggatgctacaaagttaacgaagctaagaaagaaaacatctgaagcaattgctttagaacaaatgggtatagtggatcagattaagatggtaatagtagcgactgacaaaagtagacagaattggtatgtatatttgaaagcaaagtcagaaggacttagaaagaattgaacatgatgtttgaaaatgagtggaatcaatcctagctttcttatgtgagcaactagaaattgctgggagagatgatttgtgggtaagaatcatgagtttgcatctggaatcctaggtttgaggtccctatgagacattcaagtagagatgtcaagtagtcagttggacatgagtagaaatataaacttgggagtcatcaacacatacatagtgtttaaatctgtaggactgaatgaggccgaggtcatttagagtgagaagaaaaggagctgtaaaaaatatttagaagcaaagaccagtggcatagaaatagaactatgagaataaaatgtcctggaagcccagagaagaacagatttttttaaaagattggctagttggctgtgtcaaatcctgctgggagctcaagtaaatgaagagcagagatcactgactttgattacctgaaggttgttgataactttgataacagtgatgtctatatagtggtggagaaggaaaagctacattagagtgagtcaaggggagaaaaagaatttagggttgaaaatagtgatggtagactacttatgaaagagatttggttgtgaaaggggacagagacatggagaggtagctggaatgcagaggtgagttaagatatttgataaatagggtatgcctatctgctgatgtgggcaatcctgtaaagagggaaaaacttaagatgcaagaaagagaggaaagcccttgagaaggctagatgggttgagatggatactgagcacagttggaggagttagccatggagcgaagtaaggacatttcactacagtgctcctcctggtcaattgagtaaaggtcatcatatgtgactgaaggtctggatgttggatgtacatgtaggtttgagaatagaaaaaacactgtaacatcattgtgttggagaatggaagtgtgaacattaaagggaagtgtagtagactgttcaggcaacacagagggctcatttgaaatgtccaaccatgattttaaagtgaaacttgttaacactgctgtgtgcttttctcaagcaacactcacctgctaaaatacagcagtgaagtaggaagagagtagagttaactagagttggggctttgcaaggcagatgtgtgtgatggagggaaagagaaattagggagttaatatttggaaaatggtgaatataatggattatcaaatataaggtctggatagagagacttgaatacatgaggtagatgacgaactgtgagaaggtggtgaggtcagtaccttgcaggtcttgctaaaattagagaattaatagaatgagattactctggcatatgaactggaaggaaaagaagtaggctaatagagaaataagggcccaaaaatgagattaagattggccaatgagataggaggtggaaagtatttccaaaaggaaagagcaggtaactagtcaagatatcaagtaaaatagggatagaaaggtaaacattagacataatgacaagaagatcattgttgaccttaacatgagccatttcaatggaatggtaggattcattgtagtggattaaagattgagtgggcaatgaggaaactgacacaagagaactcaggacaccttttctttttttttttttttaattttttttttattattatactttaagttttagggtacatgtgcacattgtgcaggttagttacatacgtatacatgtgccatgctggtgcgctgcacccactaactcgtcatctagcattaggtatatctcccagtgctatccctcccccctccccccaccccacaacagtccccagagtgtgatgttcctcttcctgtgtccatgtgatctcattgttcaattcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgtcgcaatagacatacatgtgcatgtgtctttatagcagcatgatttatagtcctttgggtatatacccagtaatgggatggctgcgtcaaatggtatttccagttctagatccctgaggaatcgccacactgacttccacaatggttgaactagttgacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttcttccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagtaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattgtgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttgttgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttccttcctcttttcctaattgaataccctttatttccttctcctgcctaattgccctggccagaacttccaacactttgttgaataggagtggtgagagaggccatccctgtcttgtgccagttttcaaagggaatgcttccagtttttgcccaggcagtatgatattggctgtgggtttgtcatagatagctcttattattttcaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgaacatggtggataagctttttgatgtgctgctggattcgttttgccagtattttattgagggtttttgcatcaatgttcatcaaggatattggtctaaaattctcttttttcgttgtgtctctgcccggctttggtatcagagtgatgctggcctcgtaaaatgagttagggaggattccctctttttctattgattggaatagtttcagaaggaatggtaccacttcctccttgtacctctggtagaattcagctgtgaatccatctggtcctggactctttttggttggtaagctattgattattgccacaatttcagatcctgttattggagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcttttcaaaaaaccagctcccggattcattaattttttgaagggttttttgtgtctctatttccttcagttctgctctgattttagttatttcttgccttctgctagcttttgaatgtgtttgctcttgcttttctagttcttttaattgtgatgttagggtgtcaatttttgatctttcctgctttctcttgtaggcatttagtgctataaatttccctctacacgctgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgcgattattaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgtagatgtctattcggtccgcttggtgcagaggtgagttcaattcctgggtatccttgttgactttccgtctcgtggatctgtctaatgttgacagtggggtgttaaagtctcccattactaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttagttgatgcagtttcttcctagtctcgatggtcgtttcattttggcatgattttgcggcggctggtaccagttgttcctttccatgtttagtgcttccttcaggagctcttttagggaaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggttgcccttaacattttttccttcatttcaactttggtgaatctgacaattatgtgtcttggagttgctcttctcggggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtcttttctcatagtcccatatttcttggaggctttgtttgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttcagcacttctctgtattggttattctagttatacattcttctaaatttttttcaaagttttcaacttctttgcctttggtttgaatatcctccgtagctcagagtagtttgatcatctgaagccttcttctctcagctcgtcaaagtcattctccgtccagctttgtttcgttgctggtgaggagctgggttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaacctcagctgcaggtctgttggagtaccctgcagtgtgaggtgtcagtgtgcccctgctgggggtgcctcccagttaggctgctctggggtcaggagtcagggacccacttgaggaggcagtctgcctgttctcagatctccagctcgtgctggaagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccgggctgctttgtttacctaatcaagcctgggcaatggcgggcgcccctcccccagcctggctgccgccttgctgtttgatctcagagtgttgtgctagcaatcagcgagactccgtgggcctagcaccctccgagccaggtgcgggatatattctcccggtgtgccgttttttaagcctgtcggaaaagcgcagtgttagcgtgggagagacccgattttccaggtgcggtctgtcacccctttctttgactaggaaagggaactccctgaccccttgagcttcctgagggaggcaatacctcgccctgcttcggctcgcgcacggtgtgctgcacccactgtcctgcacccactttctggcactccctagtgagatgaacccggtacctcagatggaagtgcagaaatcacctgtcttctgcctccctcatgctgggagctgtagaccggagctgttcctattcggccatcttgtctccactttggatgtaagccattttaactgggatgtggtaatatctcattatagtgttgattagcatttctctgataattatgttaagcaccttttcatatatctgtgccatttgtatgttttcttttgagaaataccactgtctggcactccctagtgagatgaacccggtacctcagatggaaatgcagaaatcacctgtcttctgcgtcgctcaggctgggagctgtagaccggagctgttcctattcggccatcttggctcctacccccaccttttcaataagttattgctgtttaaacatttttatgatagctgctttaaaatccttatcaatcaggtaatgctaacatctaagtcatctcaatgttattatgaactgagtatctttttttttttcatttatgttttgcgtttcctggatcttggtatgacaggtgatatttttgtttgtgtcctggacattttggctaatatattgggagactatggatcctatctaaatcttgtatttttagcaagaagtcactccattgagatttggcgtcaaggttctggcctactttgtgagttgaggctacaatggcagtttaatatttttagagctttcgcggtgctattttggtcggcatggtttatctggtgccttgggaactcccactggtccttgcttgtgctgcctgagggagcagacagggttttcccaggcccacagaaataaagaaccttccttggtaggccacttgtcgtggctgggcctttcccatcatttccacccacctgctccagcatcctctggcagaagaagggattcttgggtccttttttctcctttgttgggacaaaaatgcttcacgtacagggcaccctcttgtggtagaaatcccctggttgctgtttcctggatacctgatgtctctcaaaatgggagagagtgtcaggtccgtagaaacaaaaaacctttttggacaaggtctgcttgttggggcaggatacccattgccagtactgcctggctgcctggtgtttcacagtaagggaagagagtcctgggctgtcagggaaggagagtgcttcccctggctacttattattagtagggctcccaatcatgtccccttgctgccattcccaggttcacctgatattgtgagaggaattaccatttgatccagtaaagaagcaagcctacctgggctgccatctgctgttctgtcagggatcaggaaatgctgggtctgtgtcaccttgttctgttggatagggggaggatcataagacaccctgctactgtgctatttatccaatactgggatcctaaaccagttagccagccttttaccaccttacagagttttcctctagttgttgcttgcattattcccagggttcatatttgtattaatactttgggcagaggagcagggagaaatacatctacaccatcttgtctggaccagacatctgattgtagtttaaaggcctaaaatgggaagcaaagagagggagaggagagtcaacagagcgaggtcccaaaaagtgcttagagaaaagaactcagaacacagatgaggatataagtattagcaaaggacagagaggaaagaagatgcatattcagataggtttataggtttggtagcaggaatttgaggacattcttagccgatgaatctacttactttcctgtgaaacagagaggcaacataagagcccaaactcgatgttttacatttttggttatgaaccccagttgcacttcttaccagttgtgaggcctttggcatatcacttaaatccctgtgtgcctcagtttcccacaaaatggaaattaaaacagcatatatcctcataggaccgttatgatggttaattgaagtgagttaatatttgaaaatgcatttaatatggtataagtgtttgttatgtaggcaaaaatatctcgtaaggttcttacgagatattaaataagataagctctacaatgtgtgcagcaaactgcctggtatataacattcagtgttactatgattttcaaaagtattctttgcaggcttaggatattttcttgaagtaaaatcataggtcacaatttgccaatcccatgtttttgtcagagagggtctaggtgacagtgggcacaaatacataatatcagtcttggtagaaatagtagggatggggaagctgcatatgaggaactccaagatgcagttggagcatctatttccctgggaagctttaggcaagtgcccaaggcccactgagcttctccagccttagcatacattttgctatgttgtatgcagctttctgccctccttttcttgaagtctgagtgctcctccagggtagagaccggcaataggaaaaggtttcaactccctcacatcacaacatatctccatgctataatatacaccctctcccaaagtaacatttgaaagtccctgagaaagccaaatggactcaagtgtctggaatatgttaatatgggcagtcagctgcataaattgcaaaacagaagtcatgcttctatgtattctgtgacagcagaaaaatcgtaggatcttctatcacgatgggaaaggaatacaaagaagaattagtgccatcttgtggagtgatatatcattaccacttaagagtcgccagtgagaactgggttatatttttttagtatctcccgagtcctggtctgcaagaaatgcttgaaaattacttgcagaattaaatgaataaatgagagacgagataagaattggatggagactttgttaatttaaacatcaccttgataaaatgtttgacgcactgtccattgcgatttggagacctttaaaaatggtgttgtagacaccccaagtcattattatgtacctaccataaaggaaaatgaagaataaaatatttgcattaagaaatcaagaactatgaactttttcttgtcctggccttatcagtagtaggtgagtaaactttctaatggtatttttctcttcctgattatcaatgtgctgcaaattaataaatcattcaaagaacacgaagagctggggcacagtgactcatgcctgtaatcccagcactttgggaggagaaaaagggtggatcacttgaggtcagaagttcaagaccagcctggccaacatggcaaaactccatctctataaaaaatacaaaaataagccagcgtgatggcgcatgcctgaaatcccagctacttgggaggctgaggcacaagaatcacttgaaccttggaggtggaggttgcagtgagccaagattgcaccactgcaccccagcctgggtggcagagcaagaccctgtctcaaataaataaataaacattttaaaaataagaaaaacaaagagcatgaagaatatgggtagcttcggagcaggtgggtgttgtccatattctattaagtttaatgaaaataaattgctgacaatcaactattttgacctataacaatgtcagtttcttatggattggcctaatattttaaatcagttcacttaatttattctgggtatatgataggtcaggatattgtagtaggccctagatgatacagggacaaataatacatgggccttgcctttaggaatcttaccatttggtgtggaagtgggcacttagataccatgccttctattttaataatttctgttaagtgccaacagtgtggagttaagccaaattttgtggaggtgctatgagaggtctaggaaagcataatggtttggaatggtgggtaagagcaaggactctggcaccaaactctctcagtttgaatgttaatttcactacttactagatgggtgactttggccaaagtgctatgcttttctattcctcagtttcctcatatatcaagtgagatcacatactgcccacctcatatgattgaagcaagggttaagtgagttccaaagtacttggaataattcctcatgcatagcaagttgtgtataagttttagctgtcttcgtcaccatcatcagtcatcatcatcatcatcattaccatcatcacctctattcctgcagaagtattagagttgtgttttgtaagctgagttaaatttcattattcgttttttcttttgaaaacgttgccaataatttatttattgagttcctatttttcccagttcctgtgaagaatgggtaggaatacccttacctacttttttctactagatcatcatttttgtaaatctgggcctgaggcaagagctttacaggcaaaagcatgggacaatgaaaggacagaggacagtaagactgttgtcattggaatgaatggctcatgggggcttgtatcaagttatggagaagataagccaagacttagattatttgtatctattcacgtgtatatttgtgaaggcaaaacctgttctcggttggctttaacaaaatcagctgaaatagctggacagaagctacataaggtaagggcaaaggcatgctgcattgctggcatatagtaccttaggcctattctgtggatacttggttgatgctgaatgctctttgtccccaagttgtaaaatcacccctccttgaaaattattctctaataaattttttaatcataaattaattttgtgccatggcaaaggtattgacagctaagaagtaaaactgtaaaattaactgctatggactaagaacggctaaaatttcactttgtttttaatgccttaaccacctgacaacatattgtagcatgactttatgaaacatggataacattcatcatttgagtctggagatccaaattcagtatttcagagtgggatcatgatgggctgtagtcatgagtgtttactatgttgtaaaaacgtccaagtgggaataatgacatgtttgcactccctgtgacttgatcactgaaatctggaaagctcatcaacttcacccattgtcaagtccacctttgctcctttgtcctctgaggacccagtgagatcagcatttttctggaagggctgcaagtgaccccactggaaggagcagcactgtgcatcaggatggattcccaggcacactatacattgtggggtcacaggccatatgggtggactaactgatttcatggctgtatttgaattgacttccctcctggaatcctgatgcctcttttaattttatgtggcaactatcatttgcttttgctgatcattcattcaatcacctctatcatttctcaatgagggcatttttaaatatattatttatatatttttatttttttttttttactaaatatagaccagccatcaacttgaacttaaaaactgacacaccagttagttcggtcaatagtgcagaaatattcttctatgctactatgatttgagcccactatagatacttttatagctagttatgccagcaagactcaatgaatgatacttgtccagattgctatcaggagctaatcatatgaaaggtaacaccagctttatgtaggatctgtttatacttagggtacttcctggattttgacggttttcaaagctaatggcctattaaataggtcccagaggtaaaagaaaaagtggcttggcctaaaccatggtgaatcatcttatggtagagttcaggtttctaattcataatcttgttagcagaacgtgcctttgaatggaaagtaacgtacaacctctgccaatctttgcaactcactaacaaaactcagcaaagtttgcccaatgccaatgtttaaaaaaatggatgaaaacagcatggattgaagaactcacatacaaaatatataaggaatgaagacaaatggcatcaaaattgtatctgggtaaaacatttgctgttgagtgtgccataatttgagagcacaaacacagccttgagggtaaagttcaaggtacgggtgtccccttttctaaggggacataacacataagcacataacagtcctcctgttatgtgctaaaagaaaggaagctcatattagattgctccagatgtagaaatcataacaacaataaagatgataatattaacaagtctaatttctggaacatttagcctaatgtttaggcatgtttacatgcctaatatgcattatcacgtttaattcttgctttttttccagttgaaatcttattttattttttacattcagtatattaattttaaaataaattttgtgcatatttaaggtatacgacatggtgatggatatgttcatttgtcccactatagagatgattttactatatatatatatatatatatatatatatatatatatatacacatatgtatcttaatatttgcttttatgaaatccttgtatataaatatttttattctcctcaatgtaatattttaaaaacttcattttaaagaaaaaataaatttatatgctctcttaaagcagagagaacaaaacctaacaaatcaacagcaaaaatgaaggcactctttttcacttcaaatggatttgttatcacagtctgtacagaatttagcagtgacaccttggtgttctaaatccttctaaactgagtttcctccttttttttctgcaagaagagcttctttatcttccagaatcatgactgtattcttttccttgtatactctatcttgcagtcagggaatgaccggagagcgttctcatgtgtctctattaattactaccccaaatatacctttttctggaggggaagtaccaggaaaatcttccctgtttagctgttgcaggggtatcacatgttgggttttcagatgtagcaaacaaaaatagaggccagccagttaaatttgacttcagagaaacaacaacaaaacaattttagtataagttgatcccaaatattgcatgggacagacttgtactaaaaaatgtatcatttatctgaaattcaaatttaaattggcaccctatatttcatctggcaaacctatatactaattataatttccagattacataattgagttacagcagtaagaccaattttaacttgtttcatcatagtgggaatcctgccgaattgtcttcacttccttagaaacaaatgagtagcagatgtctgatttggtgaatgggttatcagctgagtacaaccaacttacataataatttaagcaggagcaaggatgcatgctaattatatgtaggcttgcatagaaatttttctttagtttactcattttagatgtatagtatttcagagtctgaaaaagctgtggaggtccatcggtgtaatgtcacctccaaaatcccccaccgtggcctgggaccccattctttacactgtagggttgctgacaaaatgttaccaggccagaggggtcagtcgtggccaaagaccaacccacattctgcttttcaaaccttgcacccacagaaggcacttcccaccttctccaccccacaccgacccagacatgtacatacgtgccttgcacttgccagatcatgcactcccagtttgtgcctcctccgagctggtgcctttttatataatttgcatgaaggcagtagactcttggccctgattcataaaaacatttaatgcccatttgcaaagtcactacccagagccaagcaccacattaagttctgggaatgcagagatggatggggcatggtctcttctttctaggaaattagagtctggcatgggacagacaagcaaagaaatcatttaaaaacgtgccacgatagtaggtgtgcataggacacgatgagagcacagaggacagaaagctatctcagcctagtagcatggaactaggagggattctcagaggggttggaacttaagcaggatgtaaatgaaagaatggggttagtgagtcaagagggggtggaagggagggagaaaaggcattctaggttgagggtgacgcagcaccagcaaattcacagagatctgaaattgagtgccctgcttgggaaacctcaagataactcattttagctggggtaaaagtggggggctgagggtgtggcaaattataaagggtctttacagagagaatgatttgggaaacactgaattaaacaatgccctgtggggtaacattgctcctgctatattccccccagtgccgaaaatattgactagctaatagtaagtactcaatatatgttttattaaatgaatgaatgaacaagtgattgaatacatggcaggacttgtcagagcctttgatagaacaatgtgtgttatagatctcaagagaggggcatagtatgcagaattctcaccttatttgaccacataaccgtttttgtcactgaataatacatttctaaaatctattatttttgaaacacacttggggaaatcatgttctaaaggagacatgaaaatgtaaaactacatgaataaatagaaagtgagagaaatctatgataaggtttcagggcttatgcttacatgaaatggtgctcaattttttctctatcgtcttcttggaactaggtgattcattgatagtgggcagcatgagaggccggacacaaggtgggctggcccaaattccagggggctttgcaagtcctcttcggcaacaataatttgtattcactttttattttcccttgtttacacgttcagattgttctatagctaatcagaaaaatattcactttccctgtgggcctaatggtcccacaccaacgctaatctcagaaactgtggtcttaaggtaaaaacatgtatcaagcgctaactttacaccagacactttccacattttaacttactgattttccatgatggtcatggttataatggtataataataattacatattgaatgtttactctctgccaggcagtgggctaagtacagtttacaattgttatctcatttgtccttcgtgacaacccaactcatttataacaatactgaagcacagagaggttaagtaacttgtaaaaagttacacagctggtaacttgcagattagggaagtggacctgggtctgcctgatgccaaagcttacatattacatgtttaaccaccccgccatgttactgttaagcttactataaatcctttgcagtgtataatcaaagagaagttcaatttcactcctatgtccatacaaatatatcttcaagaaaacaatcctaacctcaatgactaccattaaataggatccatttatacctacttgccaagtagtcatggatcagttatgtatcattgctatatatgtgaataggtcaagcgtgttacagtgttattagaacagtcaaccgaatcatgttaaaccctgattcataacttgtacttgatgcaggatattaactactcacagcataacacaattagacacccccagaacagaacaaaagcagtcaagagtatgctgtgctggaccccaaactagtgagttccccactcttccctcagaggctctagggatccatgaatctgcttcttctatcttctcacacatagaccaaaataaaacgaagtaggctggttgtgaggcttaatgaaatgtctcctcctaggctgttggcccagagactggccacttgtgaaattatatatatatatatatcatatatatataatatatacttatatatatatatataatatatacttatatataagtatgatatatatatatactacttttgactttacattttgcacttgcatttaaaagtattcattcagatcattgcatagtccttgtagttgcattaataggtaggaatgacatattttaattttgtcgtaaaatataacatacatacaaaagagtgcatgtacaattaatgatgaatatttacaaactgaactcacctaaataatgagcacccagatgaagaagtagaacattaccagcacccccaaaaagagccactgtggtcactaacccttaagggtaacctctatcctaaattggaacagcataaaagctagaagaactgaaaccgtggtctagctactaaatgacagacatacttggactatctgactccagagcttatacatcagacaatgcatgcttaaaactacaagcctttccacatttcatagagggaagaatatttttagttcaaaaaatgtttcacgatgtttgaagttaaaatgacgagtttctaaatagccaggcctgaaagagtgaccatggctgtggagaggggagcccatgatgatggctgactttcatgatgctgccccctggatgggttcatgacagtagtgatcaaaaagggctaagggccaagtcctaaacctctgtaactttgcagtcccttcggggctctcttttctgagaagatattcccacagtagaaaactgccactgacaaagtttcattggccaggtagtgtgagtcttaattgcaaccagattttatgtggcggaacagacaacactttgctctgatgatgtaattcctgccaaactctgtagtatatctctggtttctaattctccaaattcccccatggaattgttattcccttttcacagatgggaacactgatgttcagaaagtttaaatgccctgaccaaggtcacatggctagtaaattccttggccaggatgaaaagccatgtctgttttgactagaacttctgcctgtatccgttatatatcaagcttgaaacactccatagcttcaccaagagttgcttcattggagatagtttgactatggcctccagaatttcagatagatgtcctgaatttctactattttgagatgattcagaaggaatttgcagggcctcagaatgatcattaatcacatcagttactactgatgatatcagaaccagactaaagtattgcttgtttctcaaagtttgatccatggaccagcagaataaaatgaaggatctcaggccacatcctagacctcctgggtaagaatttgaattttaacaagatccccatgggacttgtgcacacattaaaatttcagatgcatcattgaatgcctggaaacaaagtttagtatattctgcaaaatgggctatgtggattttatatcttggataaaagacataaaaatatgagtgagattatttattttatttcaagaagaagaagccagcaccagtgccttgctgaggccaagaaactcaacttggcaatcccaattcctgaatcctgtttccataatcgctctccaagttctggtcccctctcacctcacatcatatagcagaaaacgtagattcccctgaagccgcttagactctgaaaacttggcccacagagcctcgtccttgagcacctgggcctgtgaatcatctgggcatggatgctctggtgagctttcccggccttggaacctcacctacaaccatttaatcgttgacaaggttgacaaagacaagcaatgggaaaaggacttcctagtcaataaatggtgctgagataattggctagctatatgtagaagattgaagctggaccactacccttcaccatatacaaaaattaactcaaaatggattaaagatgtaaatgtaagacctcaaactataacatgaggagtggtgagaagattctaacaggaaggatctctctccttcactttggtctctttgcaggcatgttctatcgttagcattaattaggtttacagtattcacacacctgctagggaaaaatagactccttaatttgctgcaaggtaaggaaacatcagccatctcagctatgcctttgtagacattataaatcatgtgcaacatcaaaaagatatttaagctccctaaatatgggttgcgttatttgacttctaatagcattctgactagcaatagcaaagagaaatgggtttgcactgaaatcatgtcagcagggaggttgtaactgctactctgaaaacattcttcctgcttcccaaggcattttgtcattagtggaacgaccactgtgcaattgatagccttccagaacttgttagctctgtaaagttgatgtcctctaaaatttcacattagcaagagcacatcacagagtcattcattcatttatacaacaagcatttattgaccacctactatgtagcaggtgcaaatctgtgtgctacagataaaatggtgaggaagtccaaactcaatggtgagctctctgggtgagacagacatttaacaaataatgctcaatttacactttaaaaaatgtaagtattggtgtcaaatgctagtacacaaaggtacaggctacagtggggatcggtgagaaagaattaagtcagttatgtagacatggaggatggagtcagagaagattttcttagagaaatgacttttaagctgaggtgaggtctgaaagatgaatgggtgtcaactaggtaagatgggcgagagagcagagtggaaataggggcttcactcccagcagaggaaatagcaagtacacagtccctttggtgggaaagagcatggaacattcgagaactgaaacaggcccagtaagacttgagagtaaagagagaggaagagttgcacacgacaagtgtgattgtgcagggccttgatagtcatgggaaggatggtgatgttttctctagtgcaatggggagacctcaaagggctcggagagattgagtataatttgttccaggcctcacagctgtaaaggacacagtggtgattcaaacccaaggccatctgactgctgagacagctctttcaatcacaatatagctcctgttcatttttatgcaactacactttttctgaaatctcctccaggccttaaacttcaggccatctctaattcaaattgtgccttgatttgttttgaaagatgtcttgggtgttttctactacataacaaatgggcactgggacagagtgcctgttatagtaccagtgagataagtgagtctagctttctatgtcaaataagctggtggaatttataatagagaacaggaccacagaaatctatctgaagaaaggcagtatgtgtcattagattctgtaaagagaagccgtgcctaatagatctggaattttctgaaggggtgactaagcaagtgaatgagggagagacagtacatgtaataataatcacagctgcatgcaaagcatttttgcattacaaaacactttattaataattacttctctcactggactgctgtgaacattacatggaatgatatattattgcctcatttcacagatgaagaaagaggctcagtgaggtcataagacttttcccaaatacatattaaggaaatgatagaactcatatccaaagcaagatccctccaactcctgagttcttaaccattttattgccattcagaggcttagcacatgtttattgtgttgaatagatgcttgccattattgtggaggaacttattgaaaagaagaaataacagccatttctctgatgaccccagatttctttcctgcctctgtgttgcctttcaaatccccaagaaggcatgtttatatgcatcacctaattggatccttacaaaagtctaaaaataaaggtaaagttaaccacattttataaaacaggctactggagcattaagaaaggggttggcaaatttttctgtgaagtgctagacagtaagtacttaatattttagggtttgcagcctctgttccaactactcaactttctggttagaaaacagccatagactataaaacaaatgagtatgattgtgtctgtaactaatggcaggttctataactatagttacagaccttgacattcgaatttcacataattttatgtatcatgaaacagtcttcatttttatttctttaaaccattttaaaatgtggaagccaccctaaacttgctgctgtgtaaacatagatggcattgggccagatttgaccttgcggccacagtttgcctttaagcagcctacactagagtgtatgcctaatagctgttatactatttgcaaaaagttgagtgtttacatcatcgggggttagaggattgctccatatccaaactttatttcgggcagaaaaatagaatgtgattttattcagctagagtatcacagggttaattacacatgctttcatctggaaaagcagcccctcgtgttgaggtttatgccaagagtctatggcccaggttcagagatggcatgcttcctcatcacagtttgttcctgagatgctggattcttctcatagttccctggatctgaagttctttaggaatggaaggggcttctcagctcagggtctaagctagaaacacagtcagcaaaggctactcatgcagggggaagtaaagccggtttggaatgattggatcagtggaactgccagtgcttacctttctactacgcctcaggcacagggtagttggcaaggtatctagttgacaacctcttgcttctttctaaggagcagccagctggtgtgtgagcacttattgtcctcatgctgccctggtccagccatttccctggctctgttttctcactatctgatatgtaaatgcaagagtgacagctgtcccattgctgaagatgtattattaacacgggatgtagcatataactgcaacataccatgtggagaaagagctaaaggccatgttttacagctggtgacttaaaggcgggcagggggtagtgcacaaagggaagaatgccaactctttagtatccactgaagcagtccctcatgttgaggttcatgatttagggtagaggataatactgtgcatgaagatgctaattaactgttaccagaacactcaatccaaaaacaaatgttgactttagggtcttagcatctaattatcttgcttgcagtgcaagagacacagtgtctttgcatatacaacaagccacgcttttgtgcacaggcaaatgtgttggatgtgacaatgcaaggactacaaacacttgtggagtgtgttctctatcggtccccaaaccagcaaggacatacatgatttcccagctggacttgtaggtagtaagtatccacccaaataggggaaacccctccatatatatagaacatgtatatatataaaatatatatagtttgtgatctgcataatatattatatatttacataagatgtgtgtagtgtaactgaaacaatggatccctttgcttaactcacagcatgctttgaaatatatatatgtatatataatataaactatgtattatcttggtgtatatgatataatacatacacataaacataaacattttttcccaagtttgctgtgagctaagcaggtgtctccattttctctacttatagtcaagtatggtaaaaacaaaactcagccattttggaaattatgtacaagactgtgtctactcagcagttctgctaacttagattctggagtttggggacctccttaagggtatttcatttggacctgagatccagcattcctgggcttcccaatggatcacatatccaagccaaatgtagtgaacacaggaagactgtgattcaggtaaatattagctattattatcatcattattatatgctggatattgctttaggtgcaattttatgcatgatctcatttacttcttgcaatatgcctatcaagtaagtactactattattcccattttacagataagaaaacttaggcacagagagggtaagtgacttgcctattgttgcatagcttgttagtggtacagccagggttcatacccagacaatttgactgtcaataccaagatcttaactctaacactatgcttcctcctcataagacagaattgaagcccataacgtcctaaatgtggtggagaaatataataaatttgaagaaagatgtaaattttatctttgaacaaccagccaattaatttcttctttgtctaaacagtcttcctctcagtccaaaaaatctagttctcacaaaaatggatgaaattaaaattacctatcctttgttcatcctttcattaaataagtatttattatatatgctagggcagtaagtagagatttcagtggagttaacggctatgaaattcttccacatacagtggttatcaggtcaaaggcaccattgggaagttggtatcaagccaaatgacattgaggagtcataaataaagttgctcctgaaaccataggatgagatgagattgccacatgcaaatgtctagagctacattagccaataagataggcacctgccacaggcagctagttaaatttaaacattaaaattaaatgaaattaaaatttcagttcttcagtcacactagatacacttaattatcaatggtcacatatagaaagtggccactatactggactgcagaggtatagaacctttctattatcacagaaagtgctattgcatagcacttacctagagaaaaaaggcaagaagagaaagaaaaaagaggtgttgacagacctctgtcaccacctgcaattaggagtcagaaagtggaaaacgacgcagtaaaggagacaaaggaggggatggatttcgtggaaagataaccaggataatgcagagtcaggaaagtcaaggtatgggaatatcaaagaataaagtgtggttctcaatgtccagtgctggcaagcagtcttttgaagttaaaggtcaaaaatatcctctggaggtggacatatggggcaaacatgatggacactgatgatggggcagctttgttaaaccggcactgtgctggacagtggaggtccctagtcacagtcgctgctttcaagtccaatggggcagacatcatgaggaagtgcagtattgatttgctttttgagcaactgacttgccactggcttactactggctttaaccctgtggatggcagcatggctccttacctatctgctgcctcagtggtcctttcaaagcctttgaccttaaacattcccaaagcagttccaggagtggtgaagcactcagagctccgggagagcagtactactcagttcaagggtgttgactgagtatagtaatgagagtaaaaaattgtgtctgtgacctttgtgaaattcatcagtaatcattaacaagatctgaatggcaagcaagagaaagagcaggcagcattgtagagaatattaaatctcaagaaccataaaaaagtatcgtcaaaggccttttaagttgacttgaattaaacccctgaagttctttcaggcacatttaacatggtgattctgctgagatcagggccggagaggaacataaatctacatgatatgacagtatctacatccagtatctacatccatgtaaatctacatccagtatgacagtattggattttgatccagtacctgatgtaatgcaatttgtgaccagacacatgttcttagaagctgggagaaagtttagctttcattttgacctgtccttacttgattgttccaggtttgtttttttgtttgttttcacttgtagctttctaggcacctcttatggtgagatgttagagaacctaggttaacagtttagatatggattctaatctggctctgtgttgacccagtgacctgtcaataaagtcctcatggtacattatggtacaagaggaaagaaagctggaggacttgacagtaagctcacattgaagtggaatcctggctatgcctcttactagccacatgaccttggacaaagtagttaaacttgctgagcttcacagggttttgtggataaggaggagtggtatggacaaaggcaagcctgctagccctcagtcttctaacttgcaactaattgtctgtaaatgttttcctttgttttggccagattccccacaacaccctcccctgcccaccttggtgggttccagaatctctcttctctaactttgtaaagtggggctaacaccgaggcaggcttgtgtcagctttgtggtcctttttccctaggaatgaacactggaactcaaacgaaggggaagagggttaatggaaagaaactgctttttaagcacttgcaaagggattttattccttgctttctctttggtccaagtatgcacacacaggtacatgcacacatagacattcaaaccacacagtggtgcctttccacttattctgtttaggatgactgcaaagaattgttgaaagatggtaaatatgtgttaggtgcacgacaatataaataacatcgatctgggttaacggtgcattgtttaggaactctggcacaaacatctttgagcttaataatggttgctaaaggtgacaggagttcagaaagcagaggactcctttcattgtaacaatcatctccccacttacccccactacatcctcatacaccccaacaaggcatgcatagcatccagcagagttccaggcatatagcaagggtttattaaaggctgttttcattcataaaatcactggtgctaatcgttaggtatagagaagaggtgaaatataggatcttgaccttcactattaacagtaacaattgccatttacagaaggcctatgatgtgtcagctgctttactgctctagcctcacaacaagcctacacagctccaagttacagatgaggagctaaagttaagagaggtgatgtaattgtcgaaagtcacatgacttctaagtggcagagtggatttaggtctcttggattccacagcccataccccttccacttttccaatgctgcacttgagaagtaggccagttgggacaatgcagtggccagacttcagctacagagtaaggcaggcgggactgcactgagaaggttaaagattactgcatctcccctggaaaccagggcctgagaacagcaagctgatcttttgtagctgctccacatattttctttctcctcagccagcattagaacttcattcttcccttgtttgcttgttcagagaaacaggtgatgagaaaagcacacttgaggtgtctggagagcaatgccctgctttgcttactataaatagctccctctcagccagttgccataaatggcattttacaggggaggcaaccagtttgaaataagccctaaggagatgtcggggcatcaatattcgcttggtgtatgcagtgttcccaatctattgcagaaggttaggagtgttgagttcttgaagcaaaagtggttttgtcagatacgtgatgccatcccaagcccttggtcagggaatctgcaattacccagaaatctgcttttttaatttatgaaccaaaagccagcaatgactcagaccaacctgcaatggaaaccaaatgtggactatgtgcagtaaatatttttacgctctcagcttccactcattactttttgctaccctgttggccttaaggagttgtcgttcaaggaaaggacctgcctgctgttccggcaaacctggaatgtgagcacttttgtattaaaatgtgtgcagaccatcctaaaatgattaaaaggaggagcatgaatttattcacatgagtcgctttcattattttccattagtaaatagccaaataattgattgtggagctgttatttaattagcataaatgaaatgactgttatatggaatagaatgtatatattgattttggctgtgtcctttaacaaggataaattttcttacttctgacagtttttgtaatcaaaactctttttttgctgaaaagcaaaaagagctgggggaccagaaagcttcagggtaggctgcaggagccaagcagtttaaggaggggacacatggtatgccaagggccttgcatttcctgtgtgagaggagccagattggactcatctcaaccactagctagtggtcactgagaagagagggtcgaagatccagagcagagatgagtggagagctgcaatgccaagcatgaggacctaggaacttgctgtgtttttcttgtcagtttcagtggtccggttgctgaggtcttggctgttgattgctctagctgggatgtgtctggaaaagaccatgcatagaaatgtacggtccttgctttgagaaggtaacattctgggactaaaacctgggtgcaagggaagtgcactgagcatcaggagacatgctgtgtgaacacatgacaggtccttttctcttccccagagtacattcccccggtatgtacattgagggaggaggagaggactaggttccctgagctcagatgggaggaagaagtgtagtagtagggacatttagggatcactctggcttcccctgcatttgtttctccccttccaacttgactttgaggagcagacacagcttccttattcccgcctagtaaaagttaacttgccacagatttagagctgaatttcagtactgcatgtgctagttcagcacagtgactaacagtacagtccctgaagtacaattgacctgagttcaattcctacccttactacttttttgatgtgcagctctgggcaactcaattatccttgattttcgttttgtcagacatggatgtaataatactaccaattcacagggttgctaaaggaactgaagtagatcatccatgtaaagcagctgtcacagaatctggtgtatagtaggttctcagtaaactttcctcattttctattcctttctgccttcctgatggtcccacatctccttgcctgtccctcattgtagcactcagtatattgtcttccttattcgtctaaacaattcaaggtcagagatcctgtgttgggcattttttggtgtcttccttcctgtgctccgttgccatgtctcatatactgccagctcactattggttcacacacatttctaggcacagaaaaaaaaattcacagagaaaaaaaattcacagagcagctagctcttccttcaggcctttgactgacattttaaggatggcagaaaacacagcaaaatagttgtttttagagtttcttggaaattcacagaggttccatgctggatttgaattcacctctaaatgtctattcagcaccaagttcagaaaattgcaagccacttgggagaatatgccaagtggcatgcagaaaattgcatgccacttggaattcagcgacatacactataggtgatgctcaaagggtggggaggtgggaaaggggtgaggttggcagggaaaaccctgaggcagtagtgatcaatgcacatgatatgtaatgtgaccaagagtcaaaccaggatgctaggtatgttcctcaggcagcatgggattaggtaccaagccagtaaatggcatactaggtgcacagacagggttgtttctcatcgcacccatcccctgcctctgtgtaccttttgctcaactccttcgatgtggctccagtataggtcccttgtcactatgcaccattacacttcaggaaaagaagccttactgcagcttgtggtgcccaaggaaggcttcacagataacagaggtataattcagcttggaagtaggtaaaggactggaattagatcaagagaaagaaggagggtgttccagatggagtatatagtggacatcacctggagccagaaatatggatggcatgttggggaaggaggattaggaggagggacagaactgtgagttcaacaggatgactggagtgggaaatttacaccccagactgacaatgtaatgtacaattgtcccccaggcagcctggtattcctgaaggctgcggtctgacaaagggctggggtaggggaattgcaattagctaagagcaaatggttatttctaaaagcatttctagggctccccatttcagttagaaacatatggcactggcaagggtccttgctttatttgggcccgttgcttagccttccctggccacaaattgctatggaaaaaagcagaaaggcagctgtcctgcctgaaggagcaatcattagctaatgctgccatctccaggagcctgcctgctaatagccagcacacagcagtcctgcttcaaactggctgcccaggcagactcctcccacccccaccgcagttcccagtgactagtttggcttctccagcctgaaatttgactggacagctggagagagggagaaactgcccagggcttctggaatccttgactgccagctgccttctcttttctctggtttgacaggaattgtagcaaaggttttcatctggaggatgagaaactccttttgttagtttgctagagctgccataacaaaatacggggtgacttaaacaacactaacttattttctcacagttctggaggctagaagtccaagttcaaggtttggtttcttctgaggcctctctccttggcttacagatggacaccttttccttgtgttctcagacagacgtttctttgtgcatgcatccctggtgtctctttgtatgtcctaatatcttcttcttataaggacaccaatcagattgaagtagagcccatcctaacagcctcattttaacttaatcacctctataaagaccttatctccaaatatagtcacattgtgaggtattgggggtatttcaacctatgaattttgtgaggacacaattcaatccataacacactgcatacagttatcagagagccctgattcttttcctctctgaacctttgtctccccatcattacaataatgggttagagcaagaagcttggagttcttgtcaaacaacaagttttgcagaaaagaaatgcaagtttgtgatgacttgctaatgaatggtgtttcacagttcagggtgatttcttattctgagaataaactaatgtaatttcattatagagtttgaacttgctatatattttcatgtatttgttatttaataaccatgtttattgccttatgcaggccacatactaggctaaatgtgagaaagaaaaagctgaatgcattagatcatatttttgaattagttcttattataagtttagacatgtattccacaagaaattgttggaccttgaagtgtaaaaatcaaaaccaatattgagtttataaccattcctctaactattaacaattggtttgtaagtatagactttgattaacttaattccctatagagaattctctggttggtttattgattgattgattcctgaattccaatagtatttttaatatccacaatgtgcaaggcatggagttaggtgctagggatatggtggtgagtgaaaccaggaagattactgccctcataaaacttactgtctagattgaatctgaggctacttgtttatttcatgaaatgtgatgagtgtatagtaaaagatatgttggaggcttctaagatcacccccaggtttgatgattcactctggaacttgttgggctcagcacatagtcatgctcctggctaagatttattacagcaataggacacacagcaaaattaacaaaggggaaaggtgcatggagagaagtctggaggaaactacacacagacttccaagagtccgctcccagtgcaatcacacaggacgtgcttattttccccagcaacaagtatgacagcacacatgaaatattgtctaccagagaagctcattagagaatcagtgcctacggtttttgctggggactgatcacataggcatcttctgcctgggatgtaccaaaattctagatgcccagaagggaaacaggtaggggtttggcataaaccacattgtttgtgcaaaactatttaaacatagtgaggcacttttaccatttagcaagttttgtatcagtgtaaagaacttttgccagccaagttcccagacaccagccaagggccaaatgttgaagcagtcctttctaaggacagaagtctcaggtcctgagactggtgaagtaatgtgagtggggctagtattctggaaattaagattcccaatggcagcagcaaaagatgcaaaagcctagtgggagagagagcctgacttactcatgaagctgaaagtagtttggtatgcccaagagaaggtgagggagtcaaggtaatcaaatggacactctttgtgatactcatatccatttattttttcaaaaaatgtgcattgggtgttatataaggaactgaggacataacagggaatcaaacaaatattcatgtccttatggagcctccattttagtgcactttatatgcatacactgaattatgtcacatccattttactggaaattctccagtctcgagcaaaacatcaacatttacatatatttcgcacactccttgataagaagaaacacaagaagatgccttctactcaaaattccagttaagactgtgtattagtaacctgtgtgtattaaatgctgataaagttgattctacttggaaactatttgttaccactatgatcagaggccttggcattttgtcagttgtgagtcccatgatcagaaacccatttatgtgctggtagtgtgatttttttgttgttgttgataaccataatgaagaacaacctgttagctatttagagagcagtaagacacaaccagttcagtaaagagatcaatcagctttattcaaacaaaagagcatcattagaagcctagcatcagatcaattttgattaagtcaacaagaatgctgccatttagtagactagaactattcttgttaactgtcaagtgtagtcagccaggacacatctcaatcctgtctccatattataccactgagagttcctcttggcttaacttgaggcatttcataaaagaaacatctactttcacagagttcagtcttacactcagaaatttaccagatttggccacaaaactgaagaggttgggaaggttacagcatttatacactcatctcatgaatcttatagattgacattgtttattttcaactgaattagtctctttcagaactccagtacactgataaggtagaaagttgattaatcagatctatcctgatgtctgtacgctaaaaatccaaagtgtagctcatagccatgaaaatgggaaaccacttttggaactgttactttgtttctaccagtacaataaatttctatatatttgctacgtttttatctgacaaagctgagtaactgacagtgcttccctgtctgctgtaggtagctaagaatcagcaaggagaaaaacacagcactccagataagtaaagcttttcctagcatttagctcttggaaatgacaaaaatttcgagacatgctgacgtacaacttgaatcactgcttgaattccttagtgcctagaacaacagaacagaggccagaaatcagcatgctctcaataaatatctggtgaattaattattgaaagaatggattaattaaatatataaacacaaaatagtaattagggagtgtgcaaaaattgaaactattctgtaatatggttagttatctgggtttctatttcaaattttaagattcatttcatgtttcaactataaaaaattcatcatcaataaaaatgagttatggaaggtgcagattcaaacatagatacctttgatttttttctgacaatgaggaatggcctcagagataaatgtctggaaaataaattgttcacaaaaatatattttagattaaacccatggtctgtgctttggtccaaacaatgtgaaggatttgtgtacttcaaggcagtataaaattgagagactcaggagcataggctcagaggacagacagtcctatgtctgaatgtgtgaactccaggaggtcaggggtaatgaggtcttgtttcccactatcactagactagccatctataaactttctgatcacacacctctgcctgagtgtgcatatttatgtatgtctaaattatacatacgtatatatctactaatatatttcatatttttatttgttgtattatagagtatacgcaaacatacacagtttaaaagttgagaaaaacacatattccaatatgctctttccatatctaatttttttttcttttttgagatggagtcttgctctgttgcacaggctggagtgcagtggcacaatcttggctcactgcaacctctgcccccggtttcaagcgattctcctgcctcagcctctcaagtagctgagattacaggcatgcaccaccatgctcagctaatttttgtatttttagtagagacgagatttccccatgttggtcagtctggtgtccaactcctgacctcaggtgatctgcccgcctccgcctcccaaagtgttgggattacaggtgtgagtcaccgcgcctggccgtccatatataattgtcttgcccattcctgaggctcatgcatcccgctttggagaacacttgtctagcatgtagtccatcataggtgctcaattaataacatttgttgaattattgaatgagtttaaatccaggtttttctacttactgtgtgaacctgagtaggttctgctatccatattctaggcctttgttttgtcatccataaaatggtataaataataatagctgtgttggggggttgttgtgaggcataaattaaataatatagcaaatgttaataataattgctgtgatattgatgatgatgataacaatggaaaaacatgtttaattctccacttcttagatgaaatgatttaggtcttgccctcatcacgtcattacttttgaccatggatacacctcatatattccagttgatacgatgcattccatacacaggattttgaagtaggatctgttcctgcaggacatctgttccagcctgtgaacataattttctggtaatgggcatagagaaaagcaaaaaaggaggaggtatttaccctctttaagcatatctccaaaagtagtgcctttcaatgatataagttgtgaaagaaagatgctagtggaaatgatataaaagcaagaccaagacacacttagaagagttgaagggtgacatcttatgtagtaactcccctatctaatcaactatgagacatagagttaccctccacctgcctccccaccctcatcagaacctgcctatgcctctgagcatggatcactttgaagtaaggcaggaatgaagccaggaaaagttctgcagggactcacatttctcatttctcttctgactccttagagcccagattctgctagtctggcgtatagtgcatgattatactgtgagttggcaatggggcaatagagggtgcagggaaagaaggaaggaaaaataacttcctcacctccttttctttcctcaccccactgtctccaccactttcaccaaggttgtcctaccaaggttgtcatcttctaatgacaaaagccagtggatatatacaatcctgaactaactcgacttctcaagagtgttttatttgaactctcaggaggcccttcttccttcctgaaactctctccttccttggtttgtgtgatatcactattttctactttgtcttttaccttttgtctggtcttccctagtctccttcactgcctcctcttcctctatcataaatgttagtgtttctcatggtttcatcctcagccttcttctaatcttgctctatgcattcttcctagagcagctcatccatctccacacccccgccatgactgtaaacaccatctctttgctcatcactacagaatctttatctctagaccaggtccctttcccatattccaggcttactacttttagattatcttcactgccttacccctacaggcatacctaacactgaatgtatgtgtatatgtgtgcgcattcacatgtatgcagcaaaacaattagttggcagagagtcaaaaaaaaaatggtatgtaggatgagctgtcactttttgagtgatgttgtgcacatttagtttcctcacctataaaaatgttaaaaaaatccatttcggtgatgggttcactagaagcccacccccccatttacaaatgtattacccatgtaacaaacaagcacatgtaccccctgaatctaaatttttaaagatgttaactaaagctgtcttttggaaagaaataaaattaaaatgtccctccattaatttgaattatttaaaactctgacagtttagcattgtaatatagctggaaataattattgctctaatagccaacaactgttttcacctaaccatagttatttaaatcacccatataattataaacctttatttatttaaaaaaatggggaaatgcgctccaggtttctaacaccgcaaccatcctgttgcccaatcagaagccctagaatactctttggaacctacctcctcttcccctccccattgcagtccataaccaacgtctgtagattgtatatccacagtggccctgtgttctgttgccttttctctagtcacagtgtcattgccttaattgaggctatcaacattgctcttgcacaattgacatgctctccgtagttctctctgcctctagtcttgtggctacaaccaccatactagtcttcatgctgcagccactgaaatctttctaaaatgccaatctgaccaagtctctcccttgcttaaaggcctagcatggttccccatggcataaaggattgtgtcaaatcctatcccgtgatccagggggtcacacataatctgactcctaacaccttccatcgttttatccctcatcctatctctggaaatctgtgctccagccattccaaactgcctgcatttctaaactgtgctagactgtcccaagcctgcatgtctttgtacttgtgaaatctgcctgcatttctaaactgtgctagactgtcccaagcctgtatgtctttgtacttgtgaactctgcctgcaattttctcagcccagcacattttcaccctcccaacaattgatttgactaatggccactggccttcaaaactcagctgcaaacacttgctctgagacaggctttcctgatcatccctgaggctagatttggtaggtaggcatgggtacccgcccccctgtgattttacaatgcctgtgccacatttctgtcattacacttatcaccttttaagataattatgtgtacgtgtgtgtgtgtgtgtgtgtgtgtgtgtgtgtgtgtgtgtgtgtgtgtattttggtctctcccccctgggactaaaagctcatttaggccagaggctttgtatgatttctctagagcagctactctcttcacctagttgcctcctgctcttccttcgtttctcagcttaatatcatcttctctgggatgctttccctgacttcaacctcccaacccccaaccaatggaaggttctgtgagatatccctcctctgtagcatagaacttctcctttgcattgaaagtgcctgtttattgtctgtctcttccagtaaacactgaactccttgaagaaagggactaggttttgttcacaattatgtttcccactgcaacctcctatagccaagcacagagagcagtacagattagacacttgttaaacatttgctgcttcacttttcttttggagattgtgattttgcctcttatttctttcattaaaattgctttcccatttttttaaaaaatatttttattgtggtaaggaagcatagcatgatatctactcttaaatttttaagtatacaatacaatattgttaactatgagcgcaatgttgtacagtggatttccgtttttaaaacactcctggttactttttggttacttttccaagcattatatagttttgtaagtttggactgctaccttgtcctctaggtggcgttgtttgaaaaagaaatggcaaagttgtatatgctttcaaataaatgagtactgtatttgtctgctagtactgacataacaaaataccacagattgagtggcttaaacaacacaaatggatttttctctcagttctggaggctagaagtccaaaatcaaggtactgttaggttggtttctggagaagcctctctttctggcttatagatggccacctcttgctatactcatatatagcctttcctctccatggaaagagattgagctctagtgtttcttcagcttatagggacaccagatctatcagattagagccctgccttatgggccctaatgtaaccttaattatctcccttaaggtcctgtcttcaaatacagtcacattgggggttagagctttagtatatgcatttgggggatgcaattcagttcataacaggtatgcatcccaagattatcaaaattttgtgcaattatatgaaacaatatatttaaatcaccttggagcaaaggagcagaattagttgtaaccaatgatcaaatgttctgagtgtcatttaccttatatctcaaaggagggggattatgctgctggagcagtgcagggactagtggaagtcccagagaacctttgggcttgagaaacggtatttgaattctctcccattccatcccttcaggttactattcctgaagcctagaatctcgttggcaggcagagaagctccattctctccaggtcaagcggacgtcttcaaggactttaattttaccatttccaaggtaccaggcctccaaaagctccctcaaagaacccttgcctagaagagaaccaaaaatactagaagcagtggagatggcctcatccttggaaactttatgacctcatcccgctctggccatctgatagatgggttgagaatacagtgccaactgagattaagacctttgagaggccatgaagaagggcctttctgagtgattctgtcagtcctggctaaagaggcctgtgcccaggagacatcagcctggcgtgcccttgaagtgtttttcactcaatgctattattaagggaccttagtagctactgtgggaaataaaggattctgaaggcaaattagtatgtttattccggagtttctcacataaaatagatttatttaccgtaggctttagttgaacctttagcaagccaaatacataatactaattaccaatagtttggtgtgctgtgcagtctttcacaaactcactgatcacaggaccttttcagtcagagaatcttgatcagattattattctccaagactctcttttaggaagggtaacaatgaagaaaatcatgaaaaaagcgattgctgtgagatgcactttgactcaaataattcctccaggcctaccctgctctctccctccctgagccacctacacattggcccccagtaatgccaaattcgtttggcctcctatcttggctgggctgccttctcctgttagcatgcctttttcttgactgacttagaatttccataggattctgttgtcagccttgtttccaggttccattctttctgatgagaattggtgggcacacagatcaggcccttgggagtgtcagaacctggtttgttcctaactctatcagggagcttagagtctgccctggttacgagggaaacagatgaaatcacttgatacctttcaaatagaggctttgcttacagcccagggtagagtgccctagggagatactaagggacttgcatactagccatcttacaaaaggctaatttgcctggccacactggccaaggaagaataataagaaggaaaccaccccactgcttactgtatgctgggcactgtgataagtgctttgcatacattattcgagttcttacaaccaacctatgagatagacagaatttttggatccactttacagagcaggaaactgagtttcaaaaatctgaggagacaagcccaatgaagcatagcttagcataagcagaagagcacaggactccagtctatgcccttgtggctctagggtccctgcttttcactacttttctctgttgcttccgggtgaatctagggaggtggtgaggtccatctgcattgtgttggtcaaatcaaagagtaccttagatagctatttgaaatagtctctttctgccccctcctgcaagagccaattacttttaggaaatagctctgtggtcaatagaactatttttttttttatagacaatgatctaggttctggtagggaacctacaactccagtcttcatcctcacaacgaggtgctaacttagatcctcatcactgtcacctgtgtctcttaagagagctccctatatcctatcttcctctttccccctcatattctccactctgcagcccaggtcacctttctgaatgtcatttgattcctttctggtgtaaaacctactcaccattgagataaatccaaactccttaaactggcttcctaaattattccctgcctatttcttcagtgtgtacctcccaaaccctctcctctgtgccaaatctcaccccttagtctgtggacatgccaaacaacttccagtttcagctgtgtcctgtttagtttcaggtaatttcacacttctaaatattctccctcaccaacctcatctgccttgggaacagctgttcaattttcaatgctcagttcaactatcacctgctgtgtgaagtttttctggttccctctcaccttctctgagtcttgccaggcctggtacagcctcagagccttatattctttaagatggcactgattgccttctgcaggtatctctcatctccagacaagctccttccccagcagggacttgggattatttattctcgtgtctcaaacacccagaacaggcctaatccataatgggaacccaggaaatgtttgctgaataaaagaatggaaaggaagttttcctgaaatagagtaagaatttgacattaattttgaaattggccaagagaatcttcaagataaatgaaatgaataaggattgtaatttgatttgttttgtccctattgtcgcgagatgctaacctggaaaaatctaaatatttaatttatctttccatgaaactcctgagaggaaaaagaaattgttgaagccggggttggtgccttgttgttgggaggattagcatgcaactgaaatacgttatttctccacaagggggtgctatgaacacatacgaggccattctcttattcttcctcagagagagagaggaactgcacaaaccaagtaacttttttattttccctgcattgtatacaattgtgcaagaatggaataactctccaccgttgccagaaaattatgtatgcctcggacaaggcttcctactaataagattcacactcacacacatacccctaactcctttaaaaggttcaggcatcaagtttaaagatgtatgatttgtggtatatctggaatttgttcattgacagatttagatgttatgtagtatgatgtcagaaacacaactgaacagaataaaagcatgcactatgctgcttttaactctcgtataggatagaccattttagaggaagactcatccaggtgtcagagatatcagtcagctcttgtcagtaataacacgtagatatagtagtaccagctgtgtacacttgtttagatttgtttcttatgaaaccatgatgggcagcacacataacacagtcaatatttgggaaagttgtactttgtgtaaccagtggcttaagcaaatcaaatcttgtcttcaacatctcatctccagtttctaccttcagcatattttgatggccttggattctgagtaatatttttgaactgtactcatgtatgtcttcccatttagactcgttcctttaacccctgggctctgtgtgtatgtgtgtgttttccatatttataactcctgcacatgacaaaggtcctgatacattgtaaggactcagttaatgtttgtggattgcttccttattgatctgttttcacaaaaatgctgccaaaaaatgtcaagcaggataatgatgaggttacaagagagacaagtgaatgggcaagaagagactaagggtaaagtaagaggactaacttccattgactgcttacgaaatgccacgcactgtgctgaggactttatataaatatctcatttaattcttataaaagcccaataaagaaataattatcaccccagtcccaccacctgtttttgcatgattgtggccatgatatcaaaataatcaaatagatggtatttggaggtatataatagtctttacctatgccttccatacatcagggcctcaatggtgcttgactaggatttgcactgtgggttagtatagttcatgggttgttatttgaagctgactcttgtgttcatgcaggagggcaggaatcttcctggctgttctgtctgcccctgttaccctcagtgaaaatgaaaggaagcacagtacatagtggttgacaggaatgaaggtttccaaccttctaactgtggttggagagcttcctgtgtggcatttcccctccttcctggaactctttagtattgtaggaaatgagtgacttgggcaattgcgatagacttcaagcaattggattcactgaagaacattttatggaggaggaggaggaggaacacaaaatcttgaaagctctgggttgagagaaaccatcaagggtatccacgttaaccactaagcaagcttttgaatcccctgatagtattccaaattgccatctctgtgaccttgaacaaaaaacttcacctctcttagtgagtttccacataggcaaaaacaaaaacaaaaatgaaaaaaactaaacaaaaccttctagggttgtcgtgaagatcagagagaacgtactcctggaatatattaggtacccagtacaagttttaaaaatagactttatttttagagcagttttaggttcatagcataactgatcataaggtacagagttgacatataccctgtgattccctggatggcctccccactagaaatatccacccactggagtggtacatttgttacaattgatgaacctatattgacatgcccttatcaccgaaagtccatagattacataagggcttgctcttggtgctgtacattgtctgggtttggacaaatgtataaaaggccattatagtatcatacagaggagtttcactgctgaaaaaatcctctgtgctcctctaattcatccctccttccccaccaacccctggcaaccactgatccttttactgcctccatagttttgccttttccagaatgtcatacagttggagtcacatggagtaaccttttcagattggcttctttcacttagtaatatgcacttaaagttctatgtattttcatggcttgatagctcatctcttttagccctcttttatgccattgtctcgatgtaccacagtttacttattcattcacctactgaaggacatcttggttgcttctaagttttggcaactatgaataaagctgctataaacattagcgtgcaggtttttgtgtggatattagatttcaactcatgggtactcagtattttttaaatgaaaaatatatctgtccttactcccataaattcctcctttccatcaattcttcccaaggtgagggatcagtgcatacaagaggcccaatttgcagcaaaatgctcattaattagccaagaggctgcggtggcacagcaagtaaacaacgtactacaaatctgtttacagcggcttctgcagacattttaaaacaattaaactgtcaagggggcctggagacaagagctttgcattttaataggaaatgattaaatctcaggcattattgccttcgatgtgtctaggctttaagaagagggcagagtattgattgaggcctccaggaaggcaggaagcttacttgtgctgcttgaccgcaatgcagtgaaagcttggagatctgtaactccttgggctggaattaaaggccagtagccaaaaatttaactggatttgtcaccttctgtttagttggactctgcctgtaggaacagatgatagatcatgacctccggggtattattcgtcaattggcagagagagagagagagagagagagagccccttgctgatggcatctattagaaaaggctgaatgacacagcgccatgtggtgacctcagtatttacactatctggattaaaaccattgtaaagcaagtgaaagccacccatgtagtcactgcctgagtcaactaatgcaaactgcactctaacctgtgaatatgtgtgtgccacagttatgacggacacgcagtctcaaacatctagtgtattcaccttctctattgatttcatctattcacaggtgctggtcagatcacatgtggttcttgccctctagctactcacagtccagtaaatgagggaacatgtaagcagctgggtacaatccaatacagtgatagatgttgttggctacagtgaggggaccaaggaggtcacattcaaattgagagatgtggaggggctggcagaaaattctttctagagaaggttctacttgaaagattagtaggcagacaaggggacaaggacacttcaaactgagggaagttcttgaacaaacctgtggaggtgtgaaaaagcctagtacattccaagaacccagtctggtagtgtggaacgtgagtcctctggtactttttaaaggatggggtgaccttagtcctcaggtttaaaaacttaatcaataaatgatgacgttattgaaatatatcaccacataatgctaaatagaacaggtgagcactaccattctctgtgcctttctattgcttaaaatccttccatttgtcatacttcttaaaagtatgccaattggagaacaagacacttgcttccaaaatgagaatacctttgtgaaaattgacaaatttgtgtgaattagcttaatcagattgctttcttccacaacacctgaccaagaccagccactctgatgacgaggagaatagggggatgtggaatgcaaaagaaggtaggagcatggggtactgagggtggagagggctcctcttgcagtggaattacaggcagctagggagcagcacaaaggccctgcatggctgagaattagtttaggggaaaggaaagagaggatagcagaaataaattttacctgacttgcaatttggctccatgtcggctctcattttgtttatttctgtgctgtctagacatcaacagattgagctgctcccatccctggggacccccttccccactacactgaccagtgcagccccctgcagggccattataagaagctatggcacagctgaaagactgagtctcttgattagacctgataagaccactcatattaagatgacttaattttgtcccttgagaaatgcctttttaagagctcccacattggccaagagagactgcctccatattaagcttttctatttttgtttgaaggaagttggcacctctcctgtgtaaagagtttgctgaagcctaaattcttccattagccattttggtttgcaaacagggatctgaatatatgcagctttttacctggtggcctgagcacttgctcagcttcccaaccagagaacaatggggaataccccatggccacattctgaatctgatcatctgtgcttctaagcatgattgactagttaaaataatggttttctgggaaacaggactggctacagaatttgcaggggttagtgcaaaacgaaaatgtagagatccttgttcaaaaaattgttagtttcaaaatggtgacagcaaatcattaaacccagtgcagggcccttctcagagcatggccctttgccgctgcataggtcatgtgtccaggaggtagccctaccaaagaacagctattttgcctttttgggttctaaaggctcctgttgttcaggtccctgggctgtggatggctattggggtataggggacggtgtttgatttcagggcagaacaaattttctccatcctctgcctactgctgaaatcccatcctcagagctaaagcaattttgttgaggctggatccctttgggaggggctaacatttgcagctgttgtctgttacacgcttagtgttggatggaaaagtggagggagagagcacaaggcaattttgattatgcagagaagcttatgaaaaaatatgtaagtttatggaatgcttttggatatacattatcttcctttccatatagcactgaatatgggtactggggcttaataaatatagctcctcgtgggtgttggtaattcttcaatattcattgatagtgacaatattcagaacttgagacagatttcctttctctctgactcgagggcagttttcccagagccacacagaaggagaatccagtctgttcaaaaggaaagactcatttgatcccagaataacttacatttccatttctatttgaatttttaacaaaaatagtgggtcttccataaagcaaaaataaaaagcatggcaattttgtttcagggtttgctttttcttaaaattttgattcctatattaacactattgagtgcttcagtaacgagtatggtgtaatgctaaaatagtctgtttcttgctctttgttataattagctaaaagccttttcataggctgctcatagattttctgaatttttaacaagggactttgatatgaaaatataattttgtggcacagaactaaaagttctggtagaatttcaacattttacgtgtaattgttacagaggattgagcaactataattcttacaaatgtctattttgcttgtagcgttttctattcatcaataattcaatttcaaaataaaagacacatttcaacatcccaaacactatcggggagactttcagattcctgactgtgggagaagtctaccaaataaggcagccagctccaaaaacttctctaatgtgctgagggatcctgttacagaccgtttttcataattctagaaggcaaaataaaattttatgcttggaaataataagtttaagcaaatagtataggcaaagcttatgtctgagtccaagcaatggtctgattactgccagaacaatactgctacatgatgaatcattaatgatctgggagagccataatggtctgtcactaatgcccattaatgatctctctatactgagagtatgggcttgatgtttctggccattaccttggagaatactttagatatgccttaaactttctctgatctcctctctctctgtgtctgctccaaatgtagacagcaattgtctgggtaggaccagcttataaagaagcatggctttgttaaggaagtcgtattcaggtaagatttatttctgcaatgtttttgatggacatagatttgaatgtttatcctggacattaatgcctttgtagaaattaacaaaattataccagggatctttctgctgagatatttttcgttctggatgggacaggggttcttgattccctttactccgggatgtttgacgttaagaatggattcttttggaaaaatgcatcatttttttttttctgggaggaatttaaaatattaattgttataggaaactgaatgtgtatttctgaccatttaaaactctatttacatttagaaaatggtggcactaactgattcaagagagatttcctacttctagatttgcatttattctatgcatacagcacaaaacattaattttaatttctaaagaaaaaagagaataagtaattataattggcttttaatgtatttttcttttagcttagtgaaagaaaggaaagaaagagaagatgacacttagctaagggaaggtggacacaatcacactttaattttgacaaacttattaggtgtatcttcagggaaatcacagaagataggcactctataatgtctcagcgaaactaggagagtatctgttcctccatggcggcaaggcagatgccgcagatagctgatggaaccaacgcccaagagcttccagctcacggagaaaaacaagctgagagaaggttgccggagcgaccagtttcaagtctctttgaaaagagcaggacagggattcttttggaggagtgaaatcactcctccagctacatttttaatgggaagtttttacatgtaactaataaaaaaatggttttgccaatcttcatattagctgaataaagcaacctcatgaagcaaacactttcattgaaaccctttgcacttgctttattgttgaacctgaaagaatcccagagaactcttaaccttgctaaatgttttattttgctagaacattttgtccagatgagtaattattcatggtgattttctgtttcctcaaaatccttctctctgtcctgaaactgctgagtagcatgtgtttattcatgtaattaactgggattaataggctttctcttctgagtacttcacaggatatcctcagctatttggagttctcctagagcatccccaaatggagatttggattgatctgtcatgttgcatgagcattgtttatctgattgtttttaattggtttccccataaaattgagagagaaaaaaagcttatttgaaagattagtacatcaagggcaatattagtgatgaaaatcgttacagaatttgtgagattagttcaacatttaattttctgattatttccacaattcatgtctctaagaaacccgttagagttttcaccttccaggtggtggacagcttataatcatcattaaaggcaggagctacagactatatgcctctttactcaggatacagtatatgtggctgaaacaagtacactcatcactctgcttgtaaagtatttgagtgaaacacacacactaattatttgctgagtaagatctgtgacacaggaaattctcaccaaacaattattttattgacatgtgagtctatgaattggagactgtcaaattgccatctaagctgtttggttagattcaagcacaaactaactttatgcttacaatagacttataggttgattgatgaaatgttataaatagacatgtccatttttaataaatgtatgtttgtgggaaactgagcccctttgcagaaatgaatgcaagctgtgggacagattggtagtgattgaaaatgctgcagttgctcctctgaaagaaatattaaaatatctgatatagcataggctctgagttcatggtagaacaatgcaatgcaaatgaaatcaggagaaaggatatgcagccaaagaatggcgagtcgcaagaaaggtcacatggtttatctcttagccttcatacgggaaaacacttcaacccttgtacacagatgagactgtcccagccaccgcatccacaagctctctaaagaactcatttcaaaagctctcaaggcaagaacatccatcctaagttctccatctccagttaagtctgctgcctctcatttgatcctcagggaagctaaagaatagacagcagctgtgctctgtgtaacccttcccagcccagaagctctcatgattatgcttatttaagttaaggaaccctagtttctttagtctaccctttcaatcttgtttttaacctaccttatttagctcacccatttacttctctaaatgtttttgtccttgttgtgttcccctctgcttgtccacaattacttcttcagctttttaaggtcctttcgtgttcttttctaagtaattatgagtttttctattcagtggctattcctacacctgcctagtactccatgtatcatattgacttagagtttctcaaacagcacatgaagacagattttcttctctcggggaagaaaacaatatatttacatatatatatttgtgtatatatataaaacagtatatttgttaatcatttccttagctgtagggacttaggaaacaatatgtttactaatttttttttatcaataatcccctgtccatttttcaggggttgcaaatgtgtactttcagctgttctatagatcactcattccaaacattgagtccattatcacctgggcagtgcctcaaagtgctttctcatgatatgcagttccaactgcctggccctgggcttgtgcttagtatatacttagtttttgttgagtaactgtatatgcccaaaatggctgtatagaccactagaaaatatttctttatattttctttgggaaaatgattaaacaatctagctgatcttataaaacaaagcataaatgaccatcttcaatttgggtttctagaatgtatagcggtagtctatatttgtcttttgccatttgccttagaaactggaagatttgaactgagaaaactattacaagtgaagacatccagggtggtagaaaaattcaccccagcagctaagctcttgagaaggaaggagagtattcaaaaggaagtgagtgcctcctgggtagaaggagttctgtaagtcccccttgggagtaccagtctcatgggagaaaaatgtgccataacttttattttcattccggcagggccactgggtatggcctaaaaatttaggcatatctcaattggcagtataagtgtctctcgttttataaaataaaattgtttccagaaaattatatgtaaatcaaatcccacgtgaaatccacatgggatatgcagtaaagaaaggagcctttttgtgagtgtttctataaagcgaagacttataatagacgtattaaaatgattactctttaatttatccatttgaaagtctgagttctaaaatgtcagaatgaaaacaagatatctgcattctattcagaagaaattatttgaccaaagcttgctaagcttatgtatgctttaatgtaataatgcctcatttgtgagtatgttaaaaatggttacatttaagtctgcttactttgctttggaagtttctgaagagcttattggtgtttcttactatttagcagctttatctgatatgacattatattattgccttctaaaatagaatttttaaaaacttcatccaaaggagccatgaataactggcatggccacttacttatgtaaatagggtatacacatatctcctggacccaaaactctaatctgttaccatgccaattccctatatttagttcaacatgccgctgaaatgtctaaatattggctgtttcccaatgtactccatcctttactctgttcttagagaatgaagagttatgatacaggaacttcgccttgtacaacagagtaggtgttatttaggcacattccaaggctccagagcagtcagccttggaggtgtttactaggactctttctgtggttggttagtgcatgcatctctgcgtaaatacaaaatataagtgttctttgtagtattcattgttccactaatgcttaactgcatagctgaatgagaagatatttttccagctctaatactagctaatatgataaaatctaaataaagtctctaaataccacattcattatgtcccttccttatatcaaaacttttactggcttcactttgaatgccaactagttggaggcagtgtttgatgttattctgtaagcaaagcctacagtagtctggctcaacatacctttctagtcttatctccttcctttcctacaagaactacttcagccaatccaattgcctcctagaggaatttgcccaattcattaatgtataatctatgcagtgctctctctgtgatgtgctagacaccaaggaaggtgccaagatgaaagaatcatggaccctgccttccaggaaggcacaggctggctgcccagctagcttctatcagacactctgtgatgaatgctataaccaaaataacacaaaagcagcagaggactagaactaggaaagatgctttctgctggctggatttgggatagcctcatcgaggaggtataaattaaccagggacttaaatgtatgtgaaaatttggtttgtgtcctctgagatacctttcctctcctgacaaccaaatgagatttcttcacctctagaactctcacagtacttactggctaaaccaatcatatgacactcatccaaaactttcttacattgtttttacctttgtgctcattttcccctctagattattatattcctaggaggcaaggcccatattcaacactttatttccctaactgatagcacagaactactaatgagagtaactacacatgtcatttatgtgaaaaaaaaacctgattgggttctgagaattccttgacttagttaaccactgctatacagtagaataccaagataataagacagatgacaaaatgactcaaatttactactactggctgggaacttcattccaaaccttaatatagtctcctgggaaactgcactggattgcatacaagctgtgaagattcctttgccttctttcattcactcaacaaatatgcagtgagaacctacaataatagtccaggcactgtgctagcttctaggtatgcagtactgaatagaacatggaatatatagtctagaagcagttcaaacagccttttggtccttttcccccaagtcacatcatgaccctgtcctatatagcttttctaaatttttttgtccccttgcgctgagcatctatcctatatatcttagtactccaaaggaaaacagtccaaagacaaaatgtcaggttttcattttttttttcctgtccatactatttcattctcagagtatgtgatctgcttgatccttgttaaacagtctcttggctcctcttcattaaataaagtagtcttaaataaccaccctactggttagactgtgtgatcaaaaaataaaaactaccgtttgttaagtgtcaactacagcccctttcccagcttgtacactgcacaggtgtaactcattcatacagtaactgcacaatgtagattattgttttcctcattttaatactgaggggaactgaggctcagagaggttacataacatgaccaagatttgtgattaatgaacactgaagccagtctttggttcatgtaatgccatcctatcccagatatagtagattttcagcaagttttggtttgttcattggttgattgttaccattctgattgaaagatctttatatattttagattacagtataagaggttgttagtctttggtagctattaatcccaggcatgtgtgtttatgttcctaatagcaattacatgaatgctttatgcttaatagaaacaaagctattattttgatgcttaaacattctttaaacatttttacatgaatacatattgataattcatgtataaataacacaaaaagatttagaatcccagttacagtttctgtaagatgcccagtttcaaagatccaactaaaaataagtgtcagctcattgcaataaaataaaataatctgattttatagacatatgaaagctgactcataacactcataactcatgaaaatatccaaaatcacattttgagcattagcttcaatgttgtctaactacattatttctatatgggaaaattctgtattctgggctgaaaattctgcagcccagctgttcccaaactttagtgtgtgccatcaatatcctctgtgaaactggctaaaattgaagatttcaagctgagttggttggaacccaaggatctacattttaataagcactccatgtgattctgatacaggaagaccatccacatctcacttctgtaagtattcttctgcaccagtgactcactagtcttcattgttgtcgtcccctcgcccatccatacacaagcagttgtgtattgcttttaaagtttttttttcaatttaagtgtaatttatataaaataaagtgctcagatgttaagtacttttatcagtttttcaaaatacacatactcgtgcaatttattcctctttcaagatctggaatattttcatcaccccaaaaaggttccacatgccttttcctagtcaacatttctctgccaccagaagaaaccacttaatttacttctatcaccataggttcgtttttcctattttagaacttcatagaaatggaagcattacattttgtgcttttttgtgtgtctggctactttcacccagaatactgtttgtgaaattcacctatttttctgtgtatatcagtaagtcactacatgttatggctgactagtatccattgcatgaatatgccagtttgtgtatctattctctcattcagagatatctggattgtttctagcttttagcttaaatgagtaaagctgctataaacattttttaccaatctttttgtggacaaatgtttttatttcttttggacaaaaacctagcagtgaaattattgggtcataaagttgatataagtttaactttttgagctactgcctaagaattttcccaaatggctgtaccattttatatccccacaagtgatgtatgagagttctggttgttctacataatcatcagcttttagggttgtcaattattttcattctattcattcttgcatgtatatggtagcattgcatcttggtaataatttgcatctgcctaatgactaatgatgttgagtgctttgtcatgtgtttattggtaatttgtacatattctttaaggaagtatttgttcaagtcttttgccaatctttattttcttatcttattgagttgttcacagtagctctttagtatctttttaatgtctgtagcatctctagtgatatctccacttctatttattatattaatgattcatttttttctctcttttcttggtctatcttgctagcggtttaaaattgtattaatcttttcaaagaaccaacttttggctttcgtgattatctccatttgttttctgtcactgatttcctttctcatttttattacttctttcttcctacttatttggggtttaattagtttttttcgtttcttaaggtggaaacataaatcatttattttataactttcttctgtttgagtgaaggcatttaaagctacaaattttcctataataacagctttacattaacttcattgttttgatatattgtactttatcattcaattcaacctattttctaaccttctttttgattttttttttttttactcatgacttatttagatatataatgtttgatttcttattgagggggtggtctatgtacattctggatgttaattccaagcttgatatttggcagtcagataacatactctgatttcttatgaatgtatttaaatttgggttatggctcagcttatggtttacttggtgaatatttcacgtgaattaatgtgttatttgctgttggtcagttctatacgtttatatcaggtcaaattgattgacagtgttgtacaattcttccatattctgactttgtatacaatttctgtcaatttttgaaagatgagtattgcaagttccaactatgattatggatttacctatgttttcttttagtgttatcaattttttgcttcaaatatgtagtgcctttgttagtaggtacacacacatataggaatttgtatattattgattaattgaccattttataattatgacatttcccccattatctctgataatatccttcaccatgaagtccaccttatctgatagttatacagccacaccatctttgttaggattagtgtttgcaatgtgtatgttttctatcttttgactgttattgtttatgtgcctttatgtttaatgtctgtttcttgtaagcaatatgtaattgagtctctcttcttctagctcccaaattctgacttttatttcgtttttcagtccattttattgtaattgttgatgtgtttggatataaatcttccattttagtatttgagttctatttgtcccatcttctctgtgtccctctgtttttcttttttaatgttttgggagtgaatcaaataacttttgtattacattatttttattatttttggcagtttctcaagattacaatatgcatctttaaattatctctgctactttcaaaacatattctattacttcacaaacaaggtaagacatttacaacattattcttccaattttcttacaaacttcatgattgttttctcatattttattctgtatgtgctataaacctctcattacaattttattatttttaatagcagtcaatactcattgatgtaatttctatatacatgcacacattattattatttttttattattatactttaagttctagggtacatgtgcacaacgtgcaggtttgttacataggtatacatgtgccatgttggtgtgctgcacccattagctcatgatttacattaggtatatctcctaatgctatcccttcccccctcctccaccccacgacaggcctggacatgcacacattgtttttaaaataaagatctttaatattttacaaatttatttactcttcgtgtttttcatttcttcctgcagaattggatttttatgtgatataattttccttcattataaagaacattttttgttcatttcttttagtgtttatctgctggagaaaaattctatgtttctttttttctgaaaacttatttattttaccttgatctttgaagaatatttttgctggatatgtaattcaagtttggcagattttatttttctttcagcactttaaagatgagatattccattgtcttctttccctcattgttttggtcagcagttatatatctctcttattgtagtcccactgtaggtagtgtttctgttttctctgccagcttccaagattttctcattatctttggtttttagcagtttgactatgatatgcttagatgttttttgtttgtttgtttgtttgtttgtttgttttattaggcttatttgatattctctgagattcttagatacataacatgttgtctttcattgattttgaacaattcttggccattatcccctcatatacttctgcttgattctctcttctcctgagactccaaattactcatgtgccagatggtttcctattgtcccacagatatcacacactgttccaattttttttgactgttttctttctttctgttgcatttggatactttgttttcaaatgtatccaagtcacaaattcctttctctactatattcagtcaactgattagctcttaaaaagaattcatctctgacattctacattttatttctagcttttcaattttttctctatttgtactttccatcgccatatgtaaataatacatttattcaagcatgtcatttgcttttctcactagaccttttaaaatatgtatcatagttattttatggtccctgtttgataatcccataatctgggccatctctgagactcagatctatcacttgagtatgtttcatatattcttcctttttttgtaagtcttttcttgttgtttatctaatttctacttgaaggcaagtcactatgtgtaaaagaacagaaactgaagtaaattatgtcaatgtccaaaaatgagaataccttttcttctattaggccattagtattttgtttgggatcaatctactcttatattgatctagatctgagctttagtgacattcagttcaccacagactttaccttatttaggagcaggatcaccatcttatctacagcaatgctttagctctgagtacctggatggtttgtctctgttctcttaacgccatacttctgcaagctctgtgttccataacacaggcaggagggtgttttctctcttatattttttacacttcacaacagtagagggtcaatgggtggtaatcagtgtactgaaggtactcaatgcccatggggtgtctctcagatgttattcctagccttcctgtactatgcacctaggactgggagaggaggtctctctcagccctccttcccctctcccaatagtagatggtcactatttcccactcattgtaaagcctagagtgtgggagggttttaactcatactttctgaaatttgtttactagcatatattagacttgtgcctgaggaccattatcgcagaagtatgtgaactcaatataatgtaaataaaatatccaccagccacctaatattccaaaactctgtgcatacttgagtaagcaataattacacacattgcctggttaaacccagtctccaatttggataccagagtttgttcttggtaaattttaaatgaaaatagtctttaaagtttcaaggggcaatggctcaagggatggagtatttgggaatgggagatactccccatttaaatgctagatgagagatggattccactctgaaactctggagaaccaggagttataacccacggagccaaaacaagaaagttgcaaaaattatatcacttagagtgaaatattatcaaataagccattccatgatggcttatggttcataaaaggctttgatctaatataaatgtgtttatattttactgcatgtaaggatcctcttcagagtattaattcacgcatttttctttagtttttgctaagtttgactttggaaaggataatataatatgaaaatattggatgaataaaagtcactgttaacatataagttttcccatctgtcttctttttcatatttattgttacaaccttttgaacttgggagacattttttgcacaaaattgaaatgagttacatgaaattaatgtccaaagatgaaagcatgaaattgcagaacatatatgtttttccatctctttattgttcatgttcactgtaatgctttggggagcattgtttatgggctatatattcaaacacctaatttaaagacaagaaaatattaatcattagcctagttccacgtttttcctaggtatattttcttagtagagtatgaagaatgtattagcttcacattgatatcctatgtatttctatggtaaatctagaactgttctcccatataattaaatagggtggatttgttccacagttattttctctatgcatctcattgtatttcatcgtgtagaaagtaatgtgattatgggctttagtcagaatgttattttgttcacttaagattcattctcaggaaggttgaacaaatttgaatttcatatgatagctttctttatgtgcttcagtaactctctccctttatataagagaaaatcttcttgttgaagagatctacagatctccccagtgcctggggggcctgaactagcagcagggggggcttcaatgaaggctactgcttcctgtgcctcattgataggggtgctatgcatatttcccagacagaatgttggtgttgcagttactaacccttctagatatttgatacagagtaaaatttgccttatttcctaaagcctctgagttaaaaaaaaaaaaatgaatcttattccttttcattatgtgatgtcgggcaagttagtctttctgagcatcactttccatatcagaaaaaaatgagatacacataatacctacttcgaaggattattgtaacgattacagatatggtttataatgagcttggtacttggtaggcacttaccaaatatgagctgtcattatggcagcagagcgaagtgttaaaagtagggactccagagccagactgtttgtgaccaaatcctgattctgatatgtactagctgccatttgggcaaattgtttaacctccctacctctcagttttatcatccaaaagttaggagtaataacagtacctacctcatcagtaggattaggttaattaatacatgtgtaagaccagtgtttggtgcatagaataagtgcaatataagtatttgctattattcttctccatttcacacagcccatagtagggcaagctgaggagatgggaggccattagaggtctcaactgagtatcagtcgtctcagttggtctacagtagataagagattatgactttttgtcaaaatgtatgtgcagataaagctgtctttaatagtgtatgtacatcaacaagaagaataacaaaaacagcaactacaatttattgagtctgtactacatgcgaagcacatgctaaactctttacaaatattaaccatttagttctcccaattaccctaggaggtagacactaaagttatttaaatttcacaatagaaaaaattgaagatcagagaggttaaatagcattctaaagtcacatatctaatgtgctactggatcaagattcgcaattaagtttcctagttataaagcccatgctcttaaccactctgccatatagtcctcttctgcactaagggggaagcttaccccagggcttcaggattcctgtgctgcatgatttttttttttcaatttgatgtagcaaatgaaaaccctcaaaactattgtctttttgattagtggtggactaactaaattcgaagaactttcatgtccataggccttggaggtcatgtaacttagatctgtcattttatcggtgtggaagtagatgcccagagtatagatggagctttcctgaagtttaagacgagttggcaggaaaactgatactcaaaccccaggatgttttttttccgacattccaccaagcctgtagtttgaaaaatggcaatgacaatgcaacttttatacaactcgatgctgtttctagttatgtgcaaacccataacaaatgttgccttattataatgcctagtccttacttttgcaaatgcaaagtcatgctttgttcattaccaataatataatatttttacaggagggttgtgggggggaggaacttcaagcttcctgagtacctataagtaaatatcagtagaaatacatgccaaataccgttaggaaaaaatccattatattatcaatactcattgccctaaatggcatttctctactgcaatcatgaacaccatctgcagccagcttccctgaagaagtacagacttgaaattcataatgtctggtgctggcactcttaatgctgaaaaatcttaccgtactgcttaggaagaacaagtgtgcagtttctgattgaatgagacataaaggaactgttcttgacccattttgacttctcgtgcactggctcttagatccagggagttttatcccctgggtaaataaccatatcatggccttcagtagtctttacttgttgcttttctattagcagtgacgaaggatgtgcatgcttctcctacagacctgttggtgcagtattattcgtgtactcaagatggtccccttaactccagaaattataaagttagagggaaaaaaagactgagtgaaaaataggccttattttacatacatcttttccagtcccataataccgcattacttatttccccatagttcgaattaagtagaaactctgttcagaccagatggttctctgaggtggtttccagatcaaggtaagaaatgaagtaaactgtaagttgtaaaacatattgaaccatagctcgcaaaatagataaattgaagccaactatgatgtgaaagacaaatgaaactccaaatatttttaataaacttataaaaatgttttgaataattttaagtttacagaaaagttgcaaatatagtacagagaattcatatatacccttcatctaggtttccctaaagttaacatactatggtacatctgtcaaaactaagaaatcaacactggtacattattatcaactaaaccccagactttatttggatttcaccaggttttccactaaggccctttttctgttccaggattcaatccaggatagcacagtgcatttagtcattatatctcctcaatctcctctggtttgtgagagtttctttgctttttattggtttttagctcagactgttttaatagtaattccacatggcttatgtgtcctaaagataagaccactgactattccagcaattcgcctagtttacaaattctaacctgcgttgttaagcactatacttaaaaacttctgtcctaaaatgaattacctttgactaaccccagccttgaaaaccctgtaagtactctttgctaactcctcctttttaacatagtactgagactctgtcaagggggactttctcttgcttagtgtgtttcacatacccagctttgtatgatcagcaggtttctctggtagtctttgtgtgagggctttgacaaaagggtctatgatgataccattcaatcatctactaaatgcaagaatcccttccacaacatctgattggtactggaataggtctgtgtgatcccatggcccttctatgaacattgccagtgacaagacattgattacctttcaagatagtccatgctacctatttttatacaatccctattgttggaaatgtcttcatcaaaatgagccctaatctatttccgtgcagcttctcttcctttgtcttatttctgtcttccagaaaatcaaaatattggatggaaagtaagctccgtgtacagttccactcaagtggtatgcaaggagtcggacacgattgggtggtcccagctttgttcacatagtgtcacttgctggttgtgtgaatttgggctaatgactcaacttctctgggccttaattttcttacctgataaaaacaaaacaaacataaaaacaccctacctcataggagtgttgtgaaaatgaaagaaataacatatgttgaagcacctagcacactgacaagctcagagaattctcttaacaaatgatagttaccttttggtcagatgatcaccccctgagtacccaagatgaaatgtaccatttatgttatattgcattattgtgttattagttctgcttcacagcagtgaattgtaacgttcccttcttgttaactaatttcttaaaaggtttaattttatttttctgttgacctttttttcccctcgagacttaattaagttgttactgaacagaattgaagtgttaaataacctaagatgatgggtttctagcattcatgaattccacgcatcgccaaccggtgagattagtcatggcagtggatgagagagcttggcagggattagcaaatactcctgttaatcagcagaatgcgcaaattaggccctggctcatggcattgatataaatctccatggcaacaccagggtgagctgtttacatgtgaagaagtgatttcaaagctgcaaaggatgatagaaattactgcaatgaccataaataggaaaaaactgaggaaaggagaagtattcccacttcttaaagaaattcatacaactttctataaatttagtggtagttttaccatctctgagcctctactactggaaagttaattgacagtgatataaacagaaagaaagtaagagggagtagaagagggtctgaaatcattcataaaatatacaatccatccctctgaccaaataactataaatcaggattatttgcatatctgtgtgtagcaggactgtctgagttagtatcctacttccaccatccattagctgtgtgaccttaggcaaaatttttaatctcgtcgtatcttttctcctcacctataacataaagctaataacagtacctacctcagaaggttgttatgagatttggataagttaacacatgtaaaacatttggaacaatggttggctcagagtaaatgcttgggaaaatgttagctgctattattattatcactgttattattattcctgttagttggccataattcttgaatatagactacctttctattttataccctgtaaagaaactacagagtgggaaaggttatatttttcattttctaattttgtttgtgctggaaaagagacttggaaatgtcagcactagagaggttttatagatattatcattttcaatttcagtacaacacttaagaaaatgatagctgtgatactagttgaagcataggatccaagtaaagccactttattatttaaactctcatcaaaacccgggagcaggtggatatctataaaatgtgatgtgatcaaaattgaattagattatctcagaaatagagctacctttttaaacatatatgtagctctgaaaattaaacccaggcccctgtcctctcatggaccaattttctctgtggtttcagctcatttcaccttacttgtgtctgttggttgattaggcttctaatccaagcaggataattgccgtaattcaagtttggattcaattttcagtgcttacatttgatgggagattattcaaatagatactgggctgtttgctttgtgaggtcaaaattgttgctacttttttattaatgccaacaaatctcttgccagtcaccacccagtggttcaaaagcttttggaggcagcctaatggagctgaaagggagtgagactaagagttagaaaccttggttggaaaccctgctggcctcctctaccatctgactcttggtcgttcactctcatgtttctttatttgtgtttcaattttattttcttgtgcacctttttgtaagccacttcaattcttctttggaatgaggtaggtcagcagtgacaataaccagagtaattcatattccagaaataaggcaatatgaaagaggctttaacataagtgcataagtgtgatcaaaatgttcagtaagataaaggaataaaactcttaagatatgatcagaacgttatgaaaaaatagacatattatcaaacaccaaacagaaattgtaaatatatatatgtatttaatatatgtgtgtatatatattttatatataacatttgtgtgtatagatatgattttgtatgccattcataaaatattattgtataatatatagtatttctaccaatgaaataaaaacaaaatcaacagataaatccagctaaagaggggatcagtgaagcacccagattttgcaaagaaagatacagagatggaactaggaaagagaagtaaggaatcatgagggagagactaaataaaatgaatattttatccgttatttctatgttttatggaagaataggtaggatgcacctaacagaagtttcagtagaacaacagagatttaaagagaggcaataagtaaagagttgatagctaaatttccagaattgaagcacagcaatagaaaaactgattaagcacaattgaagaggaatacagtgagcagggaaattttcaatatgttttcaatatattcaaataccaaccaaatcctagttgttcctctcctataggaatactgaaatctatatagatgaattactggcattacctggcttggacagtcttttcacacaatctttaatttgttaccttaaagttttatcatcataaaaattatttattgactgcccatgtgaaaaatctctggtctccaacctcacgccagttatatcaggagaatggctgacttaccatgacatacatgccaatgtaattttcatttttattggcatctttctaaagggattacttctactacaccctctgctgttgccagtcagaaatcagtaacaactgtatacttgaacatcaatgttgacaatatgtactgaatgcgatcagtaggaaaaagaagacgatctctttaaagcaaggaataaaaacttacaaatgttcatcagaatatccacatagcatagtcgatttctcccagtccccagtggttgatgttcaaagggtagtgatataaaaatctaaggttttgcaaattctttacctgagggaaagtaatatggcctagtaagaagaatatagtaccagtagtcagttgaaatccaggtttgaagtctggctttacctaatttcgttccccaacttctgagcttcttcccatcctcccacattcatcttcagtgacaggttttgttttctgaagctggattcaattcctgccctcctgccctcctgcccacggagttagctgcaccctctttgggctctgaaaacactggatatttagtatcattcttaaagtgcttaccacacttgtgttttagttaactatttacttctctttctcctccacttgaggccagggacagtcactggagaggcagtagagtcattttttaaaacatgaaatataaaggcagtatgcacaaatttaaattctgactccaccactccctacactaatgaatgcattagcctttcttcatctcagcttcttaatctgtaaaatggagataagttcataaggttattataagtattaaaagagtaaacaaagtacaataagtcctcgcttaaatgtcataaataagttcttggaaattgcaactttaagtgagatgacatacagcaggtcttcaaataatgtcatttctttcaatattgtttccttataatgttgatgagaaaaaaatttggtttcgttatgtcatttcgcttaaaattgcagttttcaagaacatatcaatgacataagtaatgatttattgtactttgaatagtgcccggagtagagttggtgctcaatacattagagctattagtatttttgcatccttcaggtcttagctcagtacttgtcaaacagttatcagtaaatgttgaatgaataaattaatgaatgaacaaatgaacaaatggcccaagccaaatgtattcaacttctcttgcctcagatctcttctctaaaatgaaatcattaggtaagcatcaaggcttctgttaggaaatcagtttctaaaattgcttgaggccttcagtggttgcacgaaaagttactaaataatttcagtctgttgactgtacttttaactgtttgtcagaagagaaaagttagagcaaattagctagaatagatattggagaagctcctaattgcaaaaggatagtcatgggcttccgagtatggaagtgaatacactgtgtataatatttttctctcttttggctgaactcaagcttcctgtagctaaaaacagatggcacaaaaaagcttacagtgtggaaagccagtttttcctgtacgaaaagaactgagtgtttggagtgctttaacttcttgtctctgctaagtagtgatggagagaaaggccgggaagtgtcctttgggtctcatagcattccaaagtcccagattacctgagtcaaaacaggttctagtgttaaactatttcttgggctaggaaacatagaataacattaagtagtgctttataatcctataattttcatgagaaagttagcaatgttttctttaaatattgctataagaagttattgagtgttatgaactgtgcttataactaggcatagatcatatgtattatttttatttcataattcacttttgttaaagaaaaaaaaactgattagaaaaatcatgctatatttcatctcgttcagtcccccaagccaaaacatagtcacatccaggcaccactgttgagcaacccaaattccagacccactgccaatgaggaaagaagtagtatttaaaggtctggccttgtatacataaatgtgctttttggctcaggatccttagcttaaatacttgcacttccacttatgtactagccaggaaaccagagtcatatcacttagtctttccaggcttcacttttctcacctttgcaatggcaataatgataatacctaccttacatgttgttgtaaggattaaagggattaaggttatagcacttaacaagttgcttgtccaactataaccatagtatttattgagtgttatcaccatttccaaccccagttttgggaaaaacaaatctaaagcagaagggagagcttaaaaatcatctagggcatctgcacagttctcaggtgggttatcaacctgtctttcatctcctccttagaatatggaggatagtattttctctgaatataccaggttcttctccccaaatcttggtcagtgtctgaaaagagatgtgttaagactcttaatcctgagggaacactaaagtattttcccattacctctctgttgctttaaaaaatataaattcttgataggaaattggagcaaacagtgccattggcaagtaggaaatccatccagtgttccttaatgctggttgtgaatcttgcctccatatgctaaataataacagacactagatcatttgcccacactgcattcctttcctcaaatactgagtttaggtcaccttccagtaactttatttcctgaattggcttaaatccagaaaaattaggttgtctgccattgcctcaaatcctccatcattttttcccctagcttttcatttaggttacctagttcactgggcaagaaatgaacccagtgttacagatattttgcctctgattcttgtacatttttagcctgccataaatgtctcaccatagaagcacctcacttaatgtttgttagccatcacttagttcataaaatagaaattgttccttcaagatcttcaaatattattgagtaaaacagaatcaaattcacttagagaacctgatgcttttcttggctctagacactctgtcaccactgaagcaacccatttgattaataatacatttattgtgtctacaaagtgttttctgcaagttggatgagagaaacttcaggaaatgaatgtgactgccttgatccacatgctccaagttcatccagtatgatcttccaaaggcaaaagcactaacaattagctttgtgttatggctcacacctgtaattcccagcacgttgggaggccaaggcgggaggatcacttgaagccaggagatagatagagacaagcctgggcaacaaagtgagaccttagccttagaaaaaaaaaatagttaaatgtggtggcacgtgcccgtagtcccagctacttggggactgagatgggacatggcttgagcccaggagttagaggttacagagagctgatcacgccactgcactcctgactgggtgacagagagaccagatctcaaaacaaaacaaaacaaaccaacaacaacaacaacaaaaacactagcaatccccatgccctatcagaggggacctttgccttctcataatggtgttactgcccctttccactctcctagtgattacttcttggtggcaggtcatggttatacaaatagtcgtgtagattttatgacagaatgatagtcttaatggaaaccaacccacatacctagctagatagaaaaggtttttgttgtattcataaaaggttttatagaagaaaaatcagcaatcaatcatagtatttaacaacgctcactgaaaagaatgttttccttgtacaaaacttaaatccccacatattaaagcttaagctcatttccttgtattctctcctcaagattaagggagaaacctccgccccagaaagctgctatttctctccaggttttcttgattaaatggccaagcaggtaatcagaggccttgaactctcgatgttgcagctgccatggctaattaaatggtgaagtgctgaattcacagacatgattaataccatcagggcgttttatggctttaatgttcataaattatgactgaacaatgaaatttgtatgtgggttataggatttttcttcttaaggatcagaattaatcagtgttttctcaattgattttaaatataaatcagaggtagcatcagtaaattctatagcttaagtatttagagaatgatctcagaaacaggacataatgaaaaccaagccaccatcctagtgtgatgcaagcctaaggtcttgtggattttcattctaaatgcaattcaggaaggccaatcagtttctaaaaggatggttctggagacctttgtttctgaagtataactcccctaaatgatctaatctttgccagctaatatatgtgtcagggtatgtaacagaatacagtagtcactctttctttacctggcattctagtgtgacactaacaagatttccttaaattgcatttttcttcctggagttaagtgtctatttcttttctttcttttttcttatttttcttttttttagaggcagggtcttactctgtcacccagggtggaatgcagtggcaggatcatagcttgctgcagcctggaactcctgggctcaagggatccttctgcctcagcttcccaaaatgctgggattacaggtgtgagccactgtgcctggctggctgaaaagagcctattctgttagcttttctctaaactcctcatttgtatttctatccagttgtttctctgagcctttgtacataattagaccacaaaaggtggtacttggctacctcatctcgtaaatactctctctgctgccttacttagtgaatggggagatcccagtgttactcgacgttggtgcatttgaatctgccaacatttcctttctttgagctcatcatcagtccttgaccaggtaacttcccactcagatattttggtgaactgttagtgtagaaggagaacaaactggcaagtgattctgagtgagcttatcttcacataggaagggtgtttgaaatttctcattttcagaatttcagaaagacagccaattcctttctgctcagaatggactgaggctgctcccgattaggctgtctgagttctctcatttttactcatcacagtcacatctgtttgggtttctgtctctctcctggagatgcctcttgagagcaggtcccctcagcttccttacagctcctctgaggcctgccaaaagagattggcagagaacgatcagcattctatgcccagataactcacataactctctctgaaaagaatgctaaaacctagttctcaagtgaacccacgaggagtggaatcaaagggacttttgcattttttccttggaatccaatttagaatttatgttctcatggggtgggaagagaacagagagatgggaagtatgaagaggggaagataaagaagtaggaacaggaacatatgggaaaaataatcataggctcccagagccaaaaggactttaaggaacatgtcatctggaggtttccaaacgttttgtttttagtaccagaatcttttcatttttattttttacgtaagaaatcatacaatgagctccactatataaaacagatgaaaagagaaagagaaataaacagttgaatgaaaacagttaaaatagatgaaatctactgttgaaacattggcgagggaacttttattacttttcattacttttagattgctgaagaatacaaagtgaaaactgccaatcttgtctaagtattactttaaagatgggaaaattgaggcctgtaatatggagaaatgacatactcaaggtcacacagccaattagtggcagagataggattaaaacatatgtttccagcctgccaggctagaactctttgggagttgagttagaaaaaaaagctaagaatgctttctttctgaacatggtcaaaaagagaggttggtggacaatgcaatgggagagcggacacgtgggagaaacaacggagaatagaccctaccttagaatagagcatagaagagtttgaaccaccagggataagcagagataactgaaatttacaaatatggaggagatccaggaagttccatagcaaggccacaatgtgaactgctaggaacaaatcaaaactggagaaaaagggatttggaaataggtgtcaaaagagaattctttattacttcccctacacaaatgtcgtactattggcccaggatggcagtgggacagcaaagacaagcaaaatatgcttctctaggattggctgcaattctttcattataccttctcaagatggatgtgactttggcatagtttcctgttggagatttgaaagtaatattcacattcgtctctgaaattttaagcacctgggaaatagacatgagagttaggaaaacgcgaacatatctgctttgtgtgtgtgtgtgtgcgcgcgcgtgtgtgcgtgtgtggagtttcgctcttatcgcccaggctggagtgtggtggcctgatcttggctcactgcaacctccgcctcccgggttcaagcgattctcatgcctcaggctcccaagaagctgggactacaggcaggcgccaccatgcctggctaattttgtatttttagtagagacagggtttcaccatgttggccaggctggtctcaaactcctgacctcaggtgatctgcttgcctcagcctcccaaaattctgggataacaggcgtgaggcactacgcctggccaatatctgcattattaatggttaagttcattgagcaatatgatttggacccaatttcaaaatggttttctttcactttctgccccagattgaatttaccctctggtcacaggcctttgtgagttctctttgtggaagagagaggagaatgaatgaggtccgtagacagacagatcacagagagatgcccccttctcaagtctcattaataatgtgccatgcattttcctgttcatgaaaacaaaagattcaagggggtcaggatataaaaagacagaaatatcttttgtgggttggcaggaacatgtgacagagggagagtctcgttccccctcccccatactcttcatttttcaatattatacaatttaatcagggagagaaggattagagcaagaaggacatctacaaacacgtgtagaatcacctggttatcagccttggcccagtggttccatgagcttatgtggatggtagacaggagttagaaacaaaaggatgtatttacagtttgtgtttgcaaatttgtaataaatgcccccgccattcttattatatattcctgaagtcttctctgagtctgtttacctctaatatgtaccacagagtgtccacaccaataattctacaggcgtcctgaaaataccttatgaatggtgtttgcagaagcaaacagtgagagctatctgagaggagaagtggaggaaaaacggtgtgggaaagcccttatgattttctcaataccatctcttcttctaaggtctatccccttcctgaatcagaacttcatccttctttagcttttgcatgcctgctctgggtcaggatcccaagagagaaatgagagtaggaacaaaaggcccttggggttggtgcttggcagaaggtaaaaacatgcagagaataagcagagaccttgtacctgttcatcacccaccccaaatatttgggcttgatcaaagcttctcctgacccctctttatgtaagatatttcccttcatggtatctggaatttaaacaacaatcacaaacattttgaactaggaaatagcctcctactcttcagaatcaatatcaatcagtcattcctcagggatttatttttccctatgaatcaaattttaaagaagtggatacttgaatagacttgaggtgttaaaactctcgtctaccttgtcctcccttttcatttgggaaagccaaaagcacaaaagagtaggtagaaaatgtcagaccctttggcatcattctcctgtaactatcagtctcaacccactgcaacctttaccccagtctgccttgcagacacacagtggtgcttctgatggagcaagagacatttcaagattgcagagaagtggaaggaggggtagcaacagcttcccctgtgaagcaatggaatctacagaagggtccggtgattcagctcttatgggctaagaagcctgaaagcatttcagtgttgctgagtccgagcttgtttgttgggtagtcaggcaaggaaaaaagggctagagtctgaagataagctgagcatctggttttgcatctacattagttctgaaaagaggtgatgggggtgccatgtaggagtccagtaaagacggtgtagggctgccaggtagtagagctgctctattttgcttcctagttggcctcagaaatcaagtaaaatagtcaaataattgtgtctgtttgaaggtagggatgtagacaggccatttctctttgctgcatttctggcctcaaaacctcttctttcttttcctccagaataaaatataacacagggagaggacagaacttgttaatagactgaggccagcaaaaagccagactggttcctgaattggagggaaggaggctgcctgactttggaggagcagaaaaaaataagttaggagattagagatgggccacagcttaaatagagaggttcgactctgcatttcccaaatacgtaatgcttacggtacacgacccaagctctctgcttgaatcccaaatctgagcggacagatgagggggcgcagaggaaaaacaggttttggaccctacaaattggcttgaaatgaaaagtcagcaaaaaccactgggtggcagcgtggtgtgcgggcgcagctctgcagtgtctgcttctgctgctaccgctggggctgaacccgtctggggactctggcctcctcccctgaatggctacaagtgtcgccaagcaaaatacctctgcgcgggtgggtgagggttctccgggttgttggtgcgtccaagcctgaggcagggatctggcgaacttctgaggggctccagcccgagcacaatctggtcagctcaaacactgaggaaacacccccaccactccatcccccaatgccgagcaaacccccgctccgtcagcccaactacctcatctcagttcctcctccatcactgtttcctcccgaagctcctttcgggaaaaggaggggagaaggatttggacgactggggcagtgcggaagcccctacaggtgttagccggaacgggcggccggggacttgggggggtgggggtgggggtgggggtgggaggggcggcctgcggctccgagcctacgggctcagccccgggagggaggggccgtcgcgggagggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcctgtgtgcgtgcgtgggaaggcgctggctttcttgcctccgtaacagtaacacgcttgctgcattgcaactgccctgggacaggcgcagagcctgggggcatactctgccctgggtggcttgccctcagcttcggacatgtcacatatgtgcatgcccggtgggctctgggcaggcgtgacccagacatggctgtgatatgtatggcgtggaaattgcaggcgcagagctgggcagacaccatcctcccgtccccaggagagcctggggaatccctctcttgcttttatctctgcctcagacccttcccctccagcttccacctccaagggatgtgggcttctgctgtctaggcattgcgtttctttgatgacttttaagctttttgggacagacttgacttgtggtgcagcttcgaaatgtttgctggggcggggggaggggggatttctagaaccttgttgcaaagagctgagagatttggttagacttagtgtaatcggttacatgctactaaaatgcggtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaaccattgatggcaccaaagatgaggacagcacttacagtaagtgactgcaaaataaatagtatatgccagcatgttgttaacattctgtttttatttattttaaaaataaatacgctttcctaaatcctgaattaaatgcaaaatatattcacactacataatcctgtttacacaggttaacctaaaggaagttgaatatgagtctgtctaagatagtaaactagggcaaataatgttgacaccatctgaagaataatccaaatgtcatctccatggaaatctagatagatttatggctatcctttggattttattacttttttcccacagaaaatttactcacccacacactgatccagaaatagcatgttatctctactcttaagaaccggtcttaacccaagagagaggagtggtttcataccatgaaaattcatcattacaagctttcacttctgctccctgctccacacacacactgataactctgagactagtggaattttaacattgagatacctccgcaggtgggtaaagggatttcttttagttctttctttttaaccatggtttcagaccaaattggagactataatggtgagcctaaaaaagaaacacataaaaaataattaggttttatttccaattactgaaagaaggtgattccaagatgttacgtaacctttaattacatgttttatttattaggagtaataaaaatataaactcacaaatagtgcaggcttctcctcaatgatgattgatgttttcttgcaatttacagatttctggagacttactaaatgttccacaaggctaaaacacttagttctcacaattttttttgttttctccaatttctactgaatttctctcaaaccctttgataatttcgcattaatattccaattgtcggctgagaaaataaccaaggaaactaggtctgaatgctaagcagtatactctgcagctttttaagagttgtatggctacagcaatgccattgacgagggtctcaataagtgtaaagagtttcccaccttttaggaatgcttcgtgggctgatggccgatctataacctcgagaggaagtcacttttaattaccattgaagaaagctttgttggtatggaggatgaaaaaacctcatactgaatggttcttcactgttttgcaaaagttctatgtcactgttgtgatattaaagttttatagtaaatcctagttgttcttttatgcatagtcttctatttgaaactattaggcaagtgtaactagagggctttactgtaatcaaataacagacattagtgtatagtgatcatctgcaataaaacattcccataagttattgtgcaaattgatatttggggaaggaattaggggatgtaagctgccctgctttccagagtgcctcaggaaaatgggtctgttgagcattattgaaggcaagttcatgattagctgccagtgagcctatccagtcacgtttctttcccctttttaacatctccgggtacaaatcagagaagaaatattttggatctggtgttcacatgtgtttcctgaaaagaaataaaaaaaaagtagataattcatgtgctgtgtcctatgaacagcaatataccaaattcatcgagatcacattctaagtaatcattttaagagatacacacacacacaccacacacgcatatatcaaggctccatttcttactgtggagctttaaatcatacagtaggttttactcttcagttcctacatatgcatagcttctgcctttggttgtcttataactgactgatacgcatggcatttctgtgtactactaatgatattgaaagaccattaaagaacatagcctgataacaggaatctgtatttaggcagattaaaatagagaggtaagtcaactaaaggtaagtattgtcataacctgatgcatacaaatggaaagtatctcaatagaaatagcaagtcagtagagcttggatctgctcctgatgttaagagtgaccagaagctagtgagctagctcagctttgccattgaggatattgtggggcataagccatcatgaaacaagaaggtttaatgattaaactggtatatcatgaaggccagctatccaaatgtattctttttttttccttaaaaccaagccgttttattggtattaattgtttaattgtgcataacgagaatacaagttgtttttttcaactatcactcatgtatataatatttccctaatatgtattcgtgatactatgtttatatttttcttactcttcttatttttattaaccttcattattttcagcatattttctcatttagtttaatttgattgaattgcgttatttttattcagacatagtaagcaatgtcctgataaatcagttcacatttatccagatatatccatttctgaaaacatatgtttgatattatgcatttcaccttaccttacgtagatttattacaatgataaatgtcagttcaataaaatctcatcatgaggaaatcagccattgtaaattatgtattttcccttgaaaaggaaaagatgatagacattccatggcagtaattttattatgtctgccctgggtgcaaggaaggacattttaaaagactagttttccctttctcttcaaactcacggtagcattatcagttcaacatgttgcctttccaacctacgttaatatatactttcattaattattctcttttgagaaattgaccttggccaactgatgaagaagcatggcttcagtgttgccttcagcaaacactgggtgccaactaggtacatggctctgattaagtggcccttcaaatagaaggtgtttgtttttatgcagacataacagagaacaaacaagaaacacaggcacatttatgttttaaaagcttcttcaaaactttcactgaaatggaagaagagattttaggtatttaatgaatgtgttttaaatccataaatgaagtcaactgttttcttctcatgtttatagtatttttatcctgatcaaaataatatattaaatccatgaggaaaggtaccagatatagagaaacaaaagcacataggaggatatttatttggtttaagctcacccctgatataatttctttgcatttttatctgggcagactgtccctttagacatattttaaacaaacccggtttatgatctatcttgaatgtttaaagaaatgaaaagatcgtagtagtatgatcagtcaatccctagattcgctactctcaacaagtttttattttggggtgatgttttttgttttttaatcaggcttcatggaaatttaaagtacatagtgaaaagtacatagttttgctatatagttaataccattattcaagattaaataatcacaggaatgtactgctgatgtttttttcttctattcctccttctgttttctgatgtttgaaatttagacatttcattgctcattaaaacctgagtcagagtgattggagaacacggtgaaaatcaaatcagttttttttagtctctctctgtttctttcttgtgcttgttataagctgcattaagagaactaagaaagttcataatattattttaaaaactgaagttctataaataattctgaatttcatttatcattctctgtcatttattactatgactaaactaggtgtcaagcatatactgatattatagttgtcaagtggtatgtagtgatatggcttttaaaccaaccccatgttggaagttttgctttagttttttagatctcagattttttgaagtatgagcttttatataaatgggattgtggtctcttacttttcaaaaacatagtatcatattttcaccatacagattgctatcaatccacaaatgggtgttgaacacctgctgtgaacaagacatcgtcaacagaaagggatatgacaaacatgacatgctcagagatgtcagacttcttgcctgtgtattgcattgtcaaatatagcatgagatcttggcttgcaatctgtgcaattacattcctttacctcacataacagaagggcacagcttttaatttgatgagtattgaatgaagtgccatcagtggcatgtggtaggaacacttgtcttttgaaccgtacaatatgtcctagctcctctttggtaacaccctggttttaaaggaacgatacgttgtaggctcaccaaggaatatttaggtcttcattagtatttctcatccatattaccccacctactgcagcagaatgtatatgcacagagataaacgatcccagaaaaactattcttacccacagggtgactcctttacattcttgttcacagaaaccataacagactgatttattatcctcaataaacttacaaaacaaggcaaaatcatcaacattggtctacgactcctgagagaaaggtgcacaggctattttcaaaagatgtgtgtggcaagcactacgttttaaaaatgtactgttttatttttattcacagtgtgggagggagtagacagctggtagtgggaggacacccactagttgtctccagtgagtggtgtgtggttgtgaggaaagcctgggtgtaagtttcacgcagtcagatcttcaaatggagaaatgaagtcctcactggcaccaactggctgcccacttgcaactattttgctaaaataataataataaaataataaaataaacctctttcaagttcattatttttattcctatgtcctttgttcttggagactaaaagctaggagccctctcaactctaatcttggaaaatgttggtcctttaagaaatactactctgaagccgggcatggtggctcacgcctgtaatcccagcactttgggaggccgaggcaggcagatcacctgaggtcaggagttcgagaccagcctgaccaacatggagaaaccccgtctctactaaaaatacaaaattagccgggcgtggtggcacatgcttgtaatcccagccactagggaggctaagacaggagaatcacttgaacccaggaggtggaggttgtggtgagccgagatcgggccattgcactccagcctgggaaacaagagcgaaactctgtctcaaaaaatgaaaaaaggaaatactactctggaaacataggactacaaaatgactttttctttttacaagacctgaatttattttggagttcttgtatttggaataacacagataatttagatgagggcattggactcttctaaaagtctaggactctctacccaacaggtagattttaaatatgactgtgagaatttcagcagttatcttggggagcagtttaaaaccttaatttgttgagaatgacactatttaatgtacagaacaattcttgggactgtatctttccagaagcatcaagattccccacctccaacactgtaaaaaccatgaaattgtgaccaaaagccttccattttctccaggctgttaaataatatgtagttacagctccagttacctggctgcaaccatgaaattaaatacactaaaaggtagaatgagacctatctgtctgcctcggggtatgtgtgggtgtgtttgtgggggtctgtatgtgtatgcatgtctacataaacagacatatatgcataccctcaccaactacacactacttttggaggaccaggcagtcctgctggaaacattgaaaagttctgaaattcagaattgtaacactgttttcattttcttttttaatttcagctctgtttaacctcatccctgtgggtctgcgagtggtggctatccaaggagttcaaaccaagctgtacttggcaatgaacagtgagggatacttgtacacctcggtaagcttttgactgtgtgcatgttttgactattctagttttcatccaatatgaaagaaaatgtgctttatatgtgttatcattacagatttctgtgatgaggagaagaatgttgatggaaatatttcattgaaaggacagattaactttctgtgaaaaatatatctattactaatcagttatttgaagcaagcattttagtatataatcaaagattcactgaacattttttaatacagtgtcatttgggtcatcttatgtagcatataatggtctgtcttgctgccttgctttgcagctgtgggaaacaaagtcatttctataactcagttgaacatatatttatccaggtttactcctaaaaaaacatgagatctctccctcagatcagctcgaggacatgaaaaccagttcttgaagggtttctagagttctatttcttatcttcagtttaattgaacaggattcctgattgcttctgctttaaatataagcactatttaacctttccttacctataaattcctgcttgtctttttcttgtaactttggagtgaacagaatgaaaaatggaactttttctcagatgaatgtataaacaatgtagattacaattcaatatggaacatggggccaaattaaactttaaaaaaagttaacatttagatataagcaaaatgatacagtattagggttaagattttattcttattggcagatctagtttcagattataagagactatttgatatatgaatttttattttaacttaattaattaattaatttatttatttatttatttgagatagaatcttgctctgtggcccaggctggagtgccgtggtgacactccatatttttagcagagatgggtttcaccacgttggccaggctagtctcgaactcctggtctcgaatgatccgcctgccatggcctcccaagttgctgggattacaggcgtgagccaccgtgcccagcgtaatatatgagtattttttaaatctttgttttgaattcatgtattttaataaaggaaaagaatgtttaaaatggagaaaattgcttgtcgaacttcttactagcaagtcttgaagcaggttgttagtataacaataaaaatctgttcctcaaacttcaggtgaaacactacctttaaccactcttgcttgcttgtttcctgaatttctttcaaagccaggtgtgcaggaagactcttggcagatatggtggaaaccatatgataaccctgttttgcagaggccaagatgggaaagaggtgggaatagagtaaggccccagagggcctgtttatttggtaaatcaggtagtttgtttcatatgatgagaaaagattatgaaaaaaagagaattatcagcatatacctcaaaccctggtcactatcagttttcctatcaggcaatttcagtggtctggttgcttaataaatatgggggtttgctctttttactaaatgaaaaatgtgattttatggcaaagttcatgaaatacgtcattttattactagagtgctactataaaagataggaaaggggattttattttagatttgtgtactaaggtaagataatttaataatgaaggattttaagtaatttcctttagatcaacagactgcctcagcaggaccagatacaaaggtaggttttttaataaaatagacgctttctgaaaatattgtgaaggcatgataaggaaacggaatatactgggcatacttttgagaaagcacatgccagatatcatatgaaataattactgataaatcatccagaatttcaatgggttgcagtcaccgttatggtgccctgatgagaaaagctaactaaatataaattttgcaacatcacaattgaagaacgtactttggaaataatatttaagtaagaatgtggaaaattatttaacttgggttatatgtcaggtgcccccactcaagaaaattagggcactcagcattacacttaaggaaccagcgttgaaaatgcatagcctaccattcaaattaatcattattccagcaaactggtaaatgtcaatgtgagctcatttctagaaaggcttcccagggaaatgaggactgtagattggtgaacttcctttccgtgatgggtgggccaatatacatccaaatgtggcacatcttgtatgtatttcctattaagaaaaaagaagccttaagtaagtgtttctattagagaaaaggaactatgtttttgttaaggaggaaatatgcctgcttgatgatcctggagttcatatatggaaagaatatccaaattagtctgctccaggaaataaatcagaatcctctttagaattaattttccaattcttccaattactccttattaattgtggctgggaatccattcaccaagttgatcaccatcctcagtgggcacttcattttgttgtcatcttatttaaagtgtggtgcccagattacttaggatggagttctatcctaataacttcagcaacttatattgctgagatcaaaagcttaatgaaatatcatgtttcatcaagaagagacagcaaccaaagaggaaggatcactcttcccttgcgtaaaaccatggcacttctactacaaaatgctatatgcaattttgcaaagtgcctcttagcaaagagaagacagaacaggacaatgacctaaagagaaagcaaaagtaagcaaaggaggtaaggggctactgatgtgggcaagttaaaaaaaattggtgagggatgactacagtctgcttaaaaagcagttgcagtgggaatggctaaaaggagatggattgctgagatattttagaggtagaatcatcaggatttggtggctgattggatttggaaggaaagcaggaccaccatacatggttaaacatgtatggttgccattcactgcacagatgagaatgaggtgtcttcaggtaagaattaaaaaaaaaaccttcacagaagtcagaagtgctcagtggattatcaggcgtcatgagggagagggggaattttgcctctggcatttaggctgaataaagcgggaaaaagcagatttgaggaagttacctgagtatagctttcaagggatatttgaaaatatgaacctagcacttgagaaagggacatgaactagaaataaaactcgggagttatcacatgtaggtagcagtccatgccatggaaatagttatgaaaatatgtagcataagaagaggagagagcttgtcaaataatgttagaaaataacagcatgaaagtgaccagcagaggaagaataactaattatggcagatatagtggtattgcaaaagctaaatggggaaggagttttaagaagagtcagcaatgtgaaatgtttcatatgttgtgggtgatcttaacaaaaacagttttggtggaatattgggaacagaagccagattctagtggcttgaggagtaaatgggatgagaggaagtagaggcaacaggtatagaatttctaagggaagggaagggaagggtgggtgtgtatttagggcagaacacagggttgaggaagactgaggattctttggttaaggatgtcacttgaacatatttgttaagtaaaagaaatgaacaaatagaaagggagtgattacagacataagaaatggtattctttatggagtcgagctgcagaagagatggaagggtgatggaattaagtataagtgaaagaattacattcatcttgaaaagaagggacactgaatctctaataggagacaaagagatgaggacagatgcagacataggtttactgagtctgcaagtaatagacaaggaagtagaagaattttctaccagatgatctgcatttttccattaaagtagaataagaggtcacctactgaaagtcaaaggtatgggggtaaccacaggtaaacaggggtgggaacaactgttttgggcaaggggaatggaaacagtttaataaacaggagtaggtaagctaaggccgtgggtcaaatccagcccactacctgtttatgaaaataaagttttattggaacgcagccacacccattcatttacttattgtctacggctgcttttgcactgcaacagcagagttgaatagttgcaacagagcccttatggcccacaaagcctaaattatttactaaataacttgtcccctttacctcccagaaagtttgctgacccctagattgtaatcagataatgattctcagccttaggtacccatcagaattacctgaggaactttaagaaattccattctttgtgttacatttggaccaattatatcaatatccaagggtgggatctacgcatgaatattttcgaaagctccccagctaatgcttatgaaaaccactgatctgagcttaagaaaaatggttgttgaatagcactgaggcactgaggacacgccactgaagtcagaaaccatgagtttatatgcacttaatcatttgttccaaattcctgataccaatgtttttctgttcttgcaagcaaattgcctttacatttttgaaggaatatttcttgagatgatggaaaatgctgatccctggaagagcgttcttattttatctctttttctttattctaccttcttttgcatttctacttctatatccctcaattttgggggggttgaattcaactttatagtttttgccatttattttctcccttttgtccattaaataaagaaacgacacctccacattgttattgttacagagatagcaatttactttccatgattaatctcagaattcttgcactgcaccctcccttccccgccctttttttttcttgttgccatgggggacagacttgatgtaggcacatctgtggcacagagaatcataattagccattatttcataacatatttacttttgtccatgatatatgctgagtctttctgggactgcaagaaagttgttatttgttgtgcagagataattttgttcttacctttggttttctttagcaataataaggagttgtacacaagcttttgagagttcctcaaaacttcacagtatgaatatttaataacataaagctatttgtaataaatgttttaaaactgcttgaaataaataatcattgactatagaaagtcaagtgtcttaaatataaaaaaaattcccgttctatgtctactttaataagaaataacagatattagaaacaggatagcaaaaactcaaagttaaaccaaaagcattactattattttttttattttggaatgttctagaactcattagcagcagttctacccatataattacttacctttcaaaaaattctagttttcctttttcacaatacacagtattgcttgggttgaagttggggcagacaaaacgtatagacaagtagaaatcctttgacaagcctttttcattcatggatttccagggaaaacttgtaggagtgattttactgtcacgttttgtagtcctgggactaccatagcaaactagatgcaagaccagaaagcagtcctctttctgagagtcagcttgatgccatgggaatgagacagcttgtgttactgatcccaacggctcagtcagattgcaatctgaactaaggggacatatttttcttctctactggattattttcacataccttaaatttaccgtttcttctctcattacatagagttgttcttacctatcactcagaacatctcataatacaatctcctttgaaggagtcactatcagaaatagtgacaaatgaaacaataccagccccttagcagttgtgacaccttagcttcacttgttttattctttgacaacttagatttgctttcctttaagaatgttacatgcctaagttaatatttaggttatatttaatgcatttagcttggtttttaaaattttataatttttcaacacatattgcaaatttttggccattgtaaaatcagttaagaattactgttttaaacaaactaaatatgagaaatataaatattaaatggaaaaattcttcatttgaccatgcctctaaacacgttacatttagagagatgcatttgattactgaggtgtgtgatatatgaatacatgcataaatattcttagaatgcttttgctgatgaatagggaaaagcccgagatggcagcccaagatgcagcatttgctacagataattcaattagtaagtgttttgtcattttccttgttctcaaagacactgacattgagtttgtcagtcatatgttaacattcttggtaacttcagaatccctgagatgacccgtccaacaaaactggtctcaagttctgtgaccttttttagctgtaaggatatttttctattcctcagccttatcaatctcatggccatactcttggaccttttcatattccagactattgaccgcttttccattatctattacctccttctttttttaaacagcttgaatgagatatagttcacagatcttaaatttatccatttaaagtgtgtacaattcagttgtttttagtatatttcacaaggctgtccaaccatcaccactgtgtaattctagaatacttttatcacgctaaatgaagaaattataccaattagtagacacaccttatcccgttccccagtctcaggcaagcactaatttactttgtctctctatggatttgcctatttggaacatttcatacaaaaggaatacaatatatggccttttatgactgtctcctttcacttagcataaagtttagaagactcttacatgttgtagcatgaatcagtacttcattccatctgatggctgagtaatattccattgtatgttcctacattggtttattcattgtcagttgatggacatttggattgtttcccccaaatacctgcatagctgcttccttctttgttcacgtctcaactggaatgacattctttagaaaggccatctctgaccaccttaactaaagcagtacattcactatctgtattatccacatttatcttcttcaaggcattatcactatttaaaattattattttgtgtgtttttcatcttccccaactagaatttaacatgttgacagcatatattccatttttcttatacactactatatccccagtgccttgattaatgcatgctgttgttttctcaatacatatttactgactttgttgtcttcaaaagggaaagcaaatatgtacttatagtccgattttagttgcgttgcttaaaattttttatttggaaacaacttcaaacttatagaaagtttgcaagaataacactagtacaaatgactccatatatcctatcctccgattcattttgctccatttgctttatcatttgttctttctttcccacacacacacagttttctgagccatttgagagtatgtaccctggcactttacacctatttcctaagaatagggatattttcttatatactgacagtaatgaactgcagtaaatgtaacattaatacaatactttagctaatctactgtccatattccaattttttaagtaaaaaatatgttcattttttccttccgtagagaatccagtctagggtcagttacagcattggcatgtcttcttagtctcttttaatctagaacatttccagagactttctttgtgttttatgacattagaatttttgaagacaagagtccactttctaattttaaaataagcattcacaattttgggtttgcttgatggtttttcttaattcaattgagattaagcattttagccagagtactgcttaggtgatagtatgtccttcttagggtatcacatctggaggtatgcagtatccatttgcccctcattggacgttaattttgatgataaaatcaaggtgttttctcattttcccctgtataactcttggttttctgggtttgtgtgtgtgtgtgtgtgtgtgtgtgtgtgtgtgtgtgtgtgtgtgtttcaactagtaaataatccactgggagacactttgagaccatgtaaatatcctactcctaagatcccagtttttaatgttatgttttcagcaatcccaaacctctttagaaaagtaaaataattagtccataaattgagaaataaccagtgattcccagatatgtcatataagtttactgatagctaaactgaggtagaaaaaattaacatggccgggcacgtgggctcacgcctgtaatcccagcactatgggaggccaaggtgggtggatcaccaggtcaggagatcgagaccatcctggctaacacggtgaaaccttgtctctactgataaaaaatttaaaaaaataaaaataaataaaaaaaaaattagccgggcttggtggcaggcgcctgtagtcccagctactggggaggctgaggcaggagaatggcatgaacccaggaggcggagcttgcagtgagccaagattgcgccactgcactccagcctgggtgacagagcgagactccatctcaaaaaaaaaaaaaaaaagaaaagaaaagaaaaaagaaaaaattaacatgtatttccaaaaaataaaaaatgtcataaaaaatatgatctggcagcaatttctggattccgcattctagtcactgggcttaaatacaattaatggaaaggttgtttgcattgtttaggtgcaataaaatcgattctgatatatgttttaatttcataccatgagtagggggttggttcatgttaagatgcctcagatgttcagtatgtttacctgtcaaatgcagggttacacttttgctgatttgtttacttcctgtgattttaatgtgtgacaatcgaagacctaattttcaatggtatggctttgcatctttagctcttattctaatacagaaaggatgtcaaactttagatgaactcattgatcaatttacagtgatgaatgtacttctagcaaatatttgtagcatgtaaaatgtttgaattatattagatggtatatcagcaagtacatctaatttaaattctagggttactttttagaggcttaaaaatctaatagaattaaatggagagctttgtttaataatgaaaactctttaggaaagtgatatggactcaattattgaaggaaattgatctaaaataaacacaagcagcatcacatccaatattgaagaaaatgatcattatcaaataaaatcaaaaagcataggcacaaaggtattttaacttcagattaaaacttttgcttattgatatatatcagttaattaacaaattgttgaatttggtttatttaaaattggaaaagtgtttactatcaaaacttaggttcctaattttggtgtgtagtatacatttgataaacttttttgatgaatcatttagttttatgggattaaacatttctgatgaatgttttcagttcacactaatggtttgtatgggtaattatacaaacacatatatttctgaatgctatcactagaaatggaaaatatagaaagttaaatttttacaggaaaaaagcagagaaaataagcaaattttatttattaccaaatggatctgctagctcaaagagctagattttatgttttaaagaggtgtccagctattgagttggtgttattaagatgaaagtctttaaaattattgcagtgaaaaatatacagaagtagcagtattcatcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaagtatgtttttaacacatatttattgaaataattaatagagatgtatataataaagcataaagactgatgatattgtttctgtcaggcctattgaatattttaaataagttacagagaccaattatgaacttttgtgggtcctctgaagtgttaacatttcaaaattacataagaaagtgaattactgagacacaagaaaaaaaattggaagctacagcactggtttcagtgactacaccacttaaagggaattgtgacttctgaacagggaagttttgaatgaaagcattttctgatcattataatagctgtaaccaaggttaataacgggcaagcccctgaataatacagttaatatgttttgtccagctgaatgtgtgagtagataacacatctatgctatcattctgattaagttattcatcagataatctgatgctaactacttttgacagttctggaaatagaactactgtgaaaacctcaattgatttcttggatatataacacctccttttaaaagggcctcagatgtgtataggaattctggcatatcatataacaaaagtaattaaaattaggtgtgatgttcatttttacccaagaaaaaatgtcctataaagatttggaagagtcaaatgtaaataacaaccccaaagtattataacttagactgtaataatacgaagagtgaaaaatgtctgatagaaagagatgtgagtcattccataatactttcataattgtcaatgagataccaggaaatgaaagtcatagctttcagaaatgaaattcgaaaaggtaaaaacttcattgtgtatagtaaatactataacaaaaaagcctgtgtgtaacaaatctactgctatatcctggccacaaaatcagcaaggctacaacaacaaaagtcctctttagagtgcttggtggttgatctgattaaagacttcttaaaaatatttaaagtattcccgggctccttcccatgtcataacagtgattcactgtaattaacgtgttaatgaaagagcctctttgcagtgttattttcactgaggaagatagagcctatgggagacctgaagctgagagcttttatattgtatcataacctttgaagcagaaatttcctgaaaactcccttcattgctcttcaagtctcagagagcccagtcacacatctaatctcccagggaagtcgaagcataaaatggtccacaagctttgccaaccaattgattagcatatacctgttgaatatccataagatactaggcaccccaaaccatgatcatgttgatccattcatactgtcaatgtctggaatttatagtatacataaggagattcatcccaaattcagatctgtaattgttaatagttgatctactacaggatcagcataaactgtttcatcctgacttctgcagcttggcaatgctatttttagcccagaactcactgtaagaagattccatatagggaaacaatttgaatgccttgggatgggggtgggtgagagtgcatcattatggaaatttaccagttatatcaaacaatatatattggttgcttggcaccacagactttagcagatcacactaagatcatgcttctatgccatgaggaggtaaaattgaatacactggacaatggttttcaattatatcaagaaatgatgtaggataaaatgctttaaaatttttatatatgtgtgactcagaaaaaaaaaaggctcccacttgcccagcacaagtggattacagtagattcaaccaaccaaagcttttagatgtatcaaagtccacctcacatgtttggccaatgacacagggatatatttccctccatttttctataatttcaagttccaatagtaggcataacaaagagaaacaatgctgacccatagagatataatttcctgaagctataacatgcaatatatattaacacctgatattttgaggaacagaaagtgcttatttctctaaaaaaaagagttatcattttctactattgactttcatgagtgatgaggaaagagcaaagttttgaccctcctatctcctccttctttgagatccccattactcatttaccccttctctgtgattagatgggtggttaacactagaagcaataagtggatacaaaacacatgtattaaagctcttcattacatttatgttcctcatatctttaccagtaagggaagcgacctggccaactcattatgtttctctgtactcctctagtcccaaaaataattatttgcttgaacaaaaaagttctgctttcagtagggctgtcaaaaaatcaaagctcatgtacattacaagggtatttcagtcaaacgattattaaatttcacataagaaaatacactcaacagacactttaactgctatctctgatcaaggcatgaaactgttcaaacaaataattaaacttgaaaatagggtgtcaacagaaccatgatgggtggttttgctgagttattttctttgctgtggaactcggccttaaatgtccacatggagagcaaatagagcagcattttattttatgttctcttttccaataccctacttacttgaggtatgctttctcttcagattttgaggttagacttttcttctctataactcatctttttgcctcctctgctcagcggcagctatcttgaacctcagaagccttggtgagactaggagtttcagcatcaagagaggtgtttggtttggtttggttcatttgtttttcagtatctgtaacacattctagtgatgcctgtcagtttgctggaaccactcatggtccttgctgtcagaggcaaggctctgccacttggggcgtgagtgtaggtgtagacccatggagaaagttgttttgcaacaaactgcctggatagtagtgttgctttgtaattatgtaaaatcaaaacattcaaaagatgctggcagataaatgagagataataatagtaaagaaatgagaattccagaaatgtaaaacaattctgaattagatttatttcagacttagctacctttctttttggcagacagagcaccattcttgggagtttcagggaatcaaaatgaaaatgaaaggcagtttcttccacaaggtttttagtattctctgaaattctgactagcctctgcccctcagggttcaacagtgtgagagctcttggtccagatgcccagtaatctctgtatcacctctgtagtaagaaatacagtataaaaaggagtaaattcagttatttagtagtggaaattacatgatgacagatattttcaaagatgcttatcattgattttctctccatctgtgctaatattcacatgcatacctatgcaaataggctttaaatgatttgatttcatacccaaaagtcagattctcctgttgttcatttagcatttttctattaggatatttgaaaaaagtattttttatggtaaatatagaagcatttgagcagtcttctttttatatggtcagttttccattttgaaggggaaacacttgtccttgtcagaattattgtgaactgccttagtttaaaaattggaaccaaaatgagatttgattgttactggggtaggtttttttttaagttttttactgatatgtaataattgtacatatttagggggtacacgtggtattttaatacatgtattcaatgtgtaattatcaaatcagggtaactgggacatctgtcacttcagacatttctctattctttgtgttgggaatgtttcaaatcttttcttctagctattttgaaagatacaataaatttttgtaaactataatctccctactgtactgtcaaatactagaatgtattccttctatctaactgtatttttgtacccatgaaccaactttgctgcattccccctcccacctacttttcccagactctggtaaccatcattctactctctacctccataagatccaatttttggggccgggcgaggtggctcatgcctgtaatcccagcactttgagaggcccaggtgggcagatcacaaggtcaggagatcgagaccatcctggctaacatggtgaaatcccgtctctactaaaaaaaaaaaaatacaaaaaattagccgggcatggtggcacgcacctgtagtcccagctacttgggaggctgaggcaggagaattacttgaacccgggaggtggaggttacagtgagctgacatcgtgccactcactgcactccagtctgggcaacagagcaagactccgtctcaaaaaaaaaaaaaaaatccaattttttagttcccatatgcgagtgagaacatgcagtatttgtctccctgtgtctggcttatttcacttagcataatgacctccagttccatccaggttgctgcaaatgacatgattttattcttttttgtggctgaataatattgcattgtgtatatgtaccacattttctttattcgttcatttgttgatggacacttaggttgattccatatcacggctattgtgaatagtgctgcagtaaacatgagaatgcagatatctctttgatatgctgatttcctttcttttggatatatacccagtagtgggattgctggatcatatggtagttttatttttagtattttgaggaacctccatactgtcttccataatagctgtactaatttacattcccaacagtgtacaaggattctccttccttcacatccgtacccagcaactgttattttttgtttgttttatattagccattttaacagagttgagatgctatctcattattttgatttgcattttcctgatgattagttatgttgagcatatttttcatgtgtctgttgaagagttgtatgtcttcctttgagaaatgtctattcaagtcctttgcccaatttttaattggatttatttatttatttatttatttttgctattgagttgtgttcattatatatgctgcttattaatcccttgttaggtggacagtatgcaaatattttctcccattctgtaggttgtctcttccctctgttgattgtttccctgctgtgcaggaactttttagcttcatgtattgtctattttttaaattttgttttctgtgcttttaaggttttacccaaaaaatctttgccaagaccaatgtcctgtagcattttctggatgttttcttctatttcacagtttcaggacttacatttagatctttaatacattttgagttgatttttgtatatgttgaatgtggtaggttattgtactagtgaaatgctgacaaaagcatgctgaaggaagatagatcattattttgttttggattcttacattgctttaaccacccgtgcttaattgttttattattatttcctgaaatattattatgcatcattgaatactaagtcagcctttaagaggctttatatatacacattctaggctttttctaagtataactaatcatcaagtataggtgtcatttacacagtttgtttgagtcactcctttaatatgatataattttcttagctgacattgtatagattttatcaaacctaaaattgagtaatacaagaaattctaccaagacatcagtgtcatttgcatagaggcgtaagtatattaagatctctgtatgaaatgtgttgtaagagtatgaaatattatcctactgatttattgaataaataacatgtattaatagttaaatcttgctttttatatgtctcagagccctgaaccttacagatctcaaacttcatatagtatttgcaagtcaagaaaaatgaaaattgggcacattgtgaaaaatcctggaatgtattaccaacaaattgttcatttctggcacattaattatttcacaaattgttcgtcatgttcccatttcacttttataagcacagtaacactctcttttacagaatgttgccaacatttaatttcttaatgaatcaatgactctttcatacattataaataagaatataggttcaccttaccaagtggctaaacagcattctctaatatttgttggagcattagggaaaagctgatggcaaccagtatcagttttgcataaatagtatttttttcccttagaacgtaagattaaccttttttcttaaaagttagcagcaagatgttaaaacgtaatattattcataggaagtttaagtacagccatagtaaagaatttttcttttttattagattttattgaacgtttatttgctgttactgtggtcacgcaacctgttaccgtctcatcacaaacagcatttcatttagtatattgagaaaagtgctgtttcaggaagccacatgcagtgctactagatcagaatacattgagggtcaaaagtttatagggacccttgataaaaaaaataataaatgttctcactctatatagggggatctcatctgagggaatttagtttgtaacatgccaaataaactttgctataaaaatagtttccatttaaattgcttctaggattctaagagtaggattatagagacagctcagtgtaataatattaaaatacatacttttaagtatggcaattcatacttttaaagccctattgcctgcattatcttacatcatactgtgtgcacttgtcaagtgatcgagaaaagctgctgtatttgggttgctattttgaactgttgaattaaatataaagtccaagtaaatatatttgtaacagtaagtaaatcgtgataatgtgcaattcatcattttgtccatttttttttcatttatgacagtttttttatggtgtagggtcacactgaaagggttatttcattctagaagttgtagatgaagtacctttatttgttaggggtgctggccaagaaaccattaattggctttcttgcaagatacaataacttttctttagttgtttgatgagtctcaatctcgtgtagaattctcaaatcactgcccctggtatgatcttgtggcagatttgtatagattccggaagtcttagaaagtttctcttgctgttacgacattgctggtggtccccaaggcaattatgctcctttagtggtcatcccacttaattaaagggagaagtgttgctctagatagttttattatatctccttgtggttgctaaacgaagcataccagctcaacagtacttcctgcttttaattgaagtttcgttttctaagaatatttagtagttcattttcctttcaggtgtaacattctaaattcaaatgagttaggatcttcttttggtttgtttttgctttattgtttgttgttctctgcaattattccctttcttgaattgtttatggaaggactcactgccttcatatttttatttagcaaaaaatctcttgagtagaagaagttggattgcatgcccatgagaccacataccctgtttgggcttcattaagtccgttgtaaatacagatattagagataagtaatattggctaatatcaggctattttcttgtgatgttacaacctcataaaaagcctgcagaggcatcactgtgcctcattttgtgttcttgacgcacaatgtgtgtaatattttctcatatctcctttatttccaaatgtttgttgcatgtaaatctgatatttcccaaaccatattttaacctatttgaatataagaatggtgccttccccatcttttatatttcccaccataccaaattcattactaaataccaagtaaatattttaccaatatttagtaaataaatgatagaagataattttactatgtacgaagccaaagacagaaaaaaaatgagtgatttttctctttcacataataagagatgactggatcaaaatgatacactttagtaaggaagaatttggaggttcaaattatgtgtgtttcacaatatgggcacaccgaattagaaatacaggagtgcagtttctaacccctgttcaaatgaatgtatgaacttgagcagctcccttcctttgtcaggttatcaattaccttaaatatcaaatgatagtgtataatatatttctttgacctcttaagtctattttgcaagtaataaatcccttaactttgcatgcattattaaatttttaataaaatctacagcaatgaggttatgtagaatatagatctaatgagtgctctttagtactgagtagccaggggatcatatttgaaatagatgggatatacctagggaaatgaacagttatttcctgctcgtgattacaacagtggacataggtttctaatgagtctttcatgacagcattcttttattttcctctgcctttcattatttggtttatttatataaaagtaacagaattccactggggcataactggacttgaccaataaaggatgactctttgtgccttctatttgcctccacttaattgtcctgctcgtcatcccgctgaattatggaaaatgtcacatttccttggcctatgactcatataacaaatgaatgtgtgaatagtgtcaaaatacagcaatttgctctatgtaaagggaggtagacagcttttgaaaatggtaaggtatataactagatatttctaaactgaagaaaattctcatttgggcttagacgtgtgcatctatggtgcaattagttgttaaatcatttaattgagggctcacttgcctagtctgtatacttgcctcactgatagtgactcaggaagcaaatcaagtggacttaaaactaaaatatcaataccctatacaacaagagaagagacatgatttctttattaacattggagctgtgtgtgtgtgtgtgtgtgtgtgagagagagagagagagtgtgtttgtgtgtgtgtgttagtttgtttagcttccatccaagcactgatggtcctgcaaattaagtggattcagaatcttcatagttcctgaccgataatccccatcttcaaacatttttttgcaggaggaacttggaatcattgatcttactgtgtttctctaaaatataataatttgtgcataaataggaattttatgacatactctatgtcctctaatagttttgtgtaatttcattgccatttagtgatcaacaaaaggagtttgtaaactataaactagctttttcctggctcgcttatgagggaataggacagaactccttgggtttaattttcagaaatcctaaatatcaacattttttatacttgatagagttaaatataaaggaataaataagcaaaactaaggccaaccttgtgcattagcccttccactcacttcagatcaccagagcttggatgtttcatctgctaacaattcctctgaagcattctcaagcatgttttcttgccagcaaaagtaatataagtcctaggcaataatagcttgataaattcatagaagatagaagattcctatgaatataagcttgctgacattttacagtaatacaaataaaacctgttaacatagtaaataacaggtactttcgggggggtaaaattattttaatttgacctatgattacatgtcttgtctattctgctatgcccagagatcctttctgatgaagatcaacttttctaatactattttactgagtttggaatggaactatagattggataattaccatccgagggagtaaagcctctaactaccacaattactcacatttattcacatgacatgaaaataaaaataacaaatggtttggaagactgcactgtagggggcaaattaaacaaaggtgcgcacacgcacgcacacacacacacacacccctctgatattaacagaggaaaggaacttattcaatgatgtagctttccactattggcactttttgttttctgttttagagacatagctcacctgaatggcacaacttgtgtgggtactgtaaatatttcctagacatggcaatgcattatattttccatttcaaaatatacttatagacagctatgggaaagaattacagtggtagctacacacagccttgttttccttgtatacagagttagaaaatagagatataggggaatccactcctgataccaaatatagccaccataagcatgtacaggcataccttgtcttattatgctttgcagatattgcagtttttacaaatcaaagtttgtggcaaccctgcatcaagaaaatctatcagcgccattttttccaacagcatgtgctcactttatgtctccaggtaacatttggtaattcttgaagtatttcacattttttcattattgttgtatctgttatgggtgatcttgtgtaatcagtgatctttgatgttactcttataattgttttggggcaccacagatcatggccatataagatggcaaacttaattgataaatattgtgtgtgtgctgactgctctactgacaggccattcccccatctctctgtttctacttaggcctccccattccctgaaacacaatattgaaattaggccaactagtgactatacagtggcctctaagtgttcaagtgaaagtaagagttgcacttctcttactttaaatcaaaaactagaaatggttacacttagcaggaagggcatgtcaaaagctgaaataagccaaaaactaggcctcttgcaccagctaaccaagttgtaaatgcaaaggaaaagttattgaaggaaagtaaaagtgctacaccagtgaacacataaatgataagaaagaaatagccttacggctgatatggagaaaggtttaattgtctggatagaagatagaaccagccataccattcccttaagccaaaggctaatctagggcaaggctctaactctcttcaattctgtgaaggctgagagagatgaggaagctgcagaagaaaagttgcaagctagaggtggcttcatgatgcttaaggaaagccatctctgtaacataaaagtgcaaggtgaagcagcaagtgctgataacagaagctacagcaagttatccagaagatttagctaagatcattgatgaaggtggctacacaaaacaacagattttctttttttctgattttttttttttttttttttggtctcactctgttgcccaggctggagtgcagtggcataatattggctcgctgcaacctctgcctcccgggttcaagagattctcctgcctcagcctctgaagtagctgggattacaggtgcctgccaccacgccaggctaatttttttgtatttttagtagagacagggtttcaccatgttggccaggctggtctcaaactcctgactttaagtgatctgcctgcttcagcctcccaaactgctgggattacaggggtgagccaccacgctcggccatacagattttcaatgtagatgaagtagccttctattggaaggagatgccacccaggggtttcgtggctagagacaagtcaatatctggcttcaaagcttcaaaggagaggctgactctcatgttaggagctagtgtagctgcagccaatgctcatttaccattccaaaaatcctagggcacttaagaattatgactctacttctaatctataaatggaaaaacaaagcctggatgacagcaaatctgttttcagcatagtttattgcatattttaagcctacttttgagacttactgctggggggaaaaaaagattcttttcaaaatattactgcttgatgacaatgcacctagtcacctaagagttctaatggagatgtacaaagagattaaagttgttttcatggccactagcacaacatccattttgcagcccatggatcaaggagtaattttgattttcaagtcttcctatttaagaaatacttttcataaggccatagctgccatagatagtgattcttctgatggatccaggcaaagcaaattgaaaacctgaaaaggattcatcattctagatgttattaaggcattcatgattcataggtggaggtcaaaatattaacaggactttgaaagaagttgattccaatcctcctgatgactttgatgggtttagggcttcattagaaaaagtaactgcagatgtcatggaagcagctagagaactagaattaaaagtagggcctgaaaatgtgacagaattgctgcaatctcatgataaaactcatgacaaaatggatgaagagttgtttcttgtggatgagcaaagaatttcttaggatggatctattcttgaatggtgacgatgctatgaaaatttttgaaattacaacaaatgatgtagaatattccaaaaacttagttgataaatcatatacagggtttgagaggatataatccgattttgaaataagtttttccgtgggtaaagtcatatcatacagtatcacctgctacagagaaatctttcatgaaaggaagagtccattgatgcagcaaacttcattattgtcacagaaattgccagaatcatcctgaccttaaatagccaccatcctgatcaatcagcagcaattaacatccaggcaaaaccctcaagtaggactaaagatatgacttgccaaaggctcagatgatcattggcatattttaacaatgaaatatttttaaactaaggtatatgcactgaatgtttagacataatgctgttgcacactttatagaccataatatagtgtaagcctactttttaaatgcactgggaaagcaaaattcatgtgacacactttattgcaatattcactttattgagatactcactttattgcagtagtctggaactgaacctgtaatatctccaaggtatgcctgtatattctatcactcccaagctgtgtgctcttgggaaagttacctaatagaatccttaataaaaaatggagtatggggctgggtgtggtggctcgtgcctgtagccccagcagtttgggtggctgaggtggaaggatcacttgatcccatgagttcaagaccagcctcggcaacatagcgagaccctgtctctacaaaaagaaaaaaaaaattagcggggtgtggtggcatgtgcttgtagtcccaactactcaggaaactgaggtgggaggattgcttgagcccaggagattgaggctgcattgatctgtgatcatgtcacagcactgtagcctgggtgattgatagagtgagaccctgcctctaaaaataaaatggagcattatctattcatggggttatgtgagattatttgtgtgaattgttagtcatatatatttgccaaataaatgtttgcatcccatcaccgtggctgaatgagcatcggactaaggctaccttcttctatgcgccaaaagttttggatacatttcttgaggctcatgtagttgtagaatctaaaatctaattttagcttagaagtgcaacttgaggaaaagcaatcaggatttttgaacttttaatgaaacattttataaagaaaaacatctcttgtgagtgctttgttccctgtttaatttggttgagggtactttgttcagtagaggccaaaagcctataagttaaataagctgagactatcagtggaaaaagaaacactacattcattcaagttcatgttatataagtttgccatcatttcaaagcaaagattttacatggctcacctgtgtaacaataaaaaaatctacggttcagttgtaaatgtgcacaaatagggcatgatgataggctcacagttgtagcttcctctaacttggtcatggactcaagatcaatgtgaatgccatatatcagaaaggagcaaagagtgctttaaaactacaataagaaagattggcatgcgtgaatctaacggtttagttatccattttgagggataatttatttggaatgctactttatttctttattttattttattattattatactttaagttttagggaacatgtgcacaatgtgcaggttagttacatatgtatacatgtgccatgctggtatggtgcacccattaacttgtcatttagcattaggtatatctcccagtgctatccctccccactctccccaccccacaacagtccccagagtgtgatggggactccccacaccacaacagtccccagagtgtgatgttccccttcctgtgtccatgtgttctcattgttcaattcccacctatgagtgagaacatgcggtgtttggttttttgtccttgcgatagtttactgagaatgatgatttctaatttcatccatgtccctacaaaggacatgaactcatcatttcttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctggatcaaatggtatttctagttctagatccctgaggaatcaccacactgacttccacaatggttgaactagtttacagtcccaccaatagtgtaaaagtgttcctatttctccacatcgtctccagcacctgttgtttcctgactttttaatgattgccattctaactggtgtgggatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttttcttgtacatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatacctaggttttcttctagggttttcatggttttaggtctaacgtttatttcttaagctaccatcccacaattcatcactattcctgatggtctgttttacagaaattttctgtcagcacataactataatagatagtacataatatagtgaaatatgaaaatctctgtgaaaggatcaacgaaatttgaagagagagctagtttgaaatacgaatcatattctcaaccttttaaatttctgattgaatgatttatgggaaacattctgtagcaatgtgaattccttataaggaaatagtgactgtgtccataaggatgatgtactctataattcagataatataaccatttatgctttgtagcaggagttccccaacctctgtaccaattcatggcctgtcaggaacctggctgcacagcaggacctgagcgatgggggagcaaacattaccacctgagctccgcctcctgtcagatcagcagcagcattagattctcatagaagcctgaaccttattgtgagctgcacatgtggaggatctaggttgtgtattccttatgagaatcgaatgcctgatgatatgaggtgggatagtttcatcacgaaaccctcaccgcttccaccacccccatccgtggaaaaattttctcccatgaaatcagtccctggtgccaaatagcttggggaccactgttttatagggtccgtatttcatagattgaaagactgaggacacagttaaggcattatgaagtcaatgagacatagtggtgaagaaaagataaattcttaaagataaatctttactggacatttaagtgggttttccaagtccattaatcccattcatgttttaacatgtctttgaaccctgaatggcccctaaacttagcctgtaccttagttccaactcacccagttttcttagtgtgcctacaaggctaacagaccttgtaggcttggtggggccaggcatgaggtagctgtggattcactgtgctattacaagtctaaaatatggaagtgtttttcagctttttttccttatgtctttttctgctgactctaatctttagttgcttttccccctttggttttactgcagattgaaaatgtttccattcattcaaaacaactatttcttgtttaaagtaaaactgttagttaataataatgatgctttagcaactatcatttttctcgatgatttagcagaacactgaattactgcgaaatgcaaacagtgagagggtataacagcaacaaaaatatatcttggaagactcaggtctcatctcttaggtctccttccctaccaaagatgaacattccccaaaaagattcaaaatggctgtcaccacatggtggaatcatatgtgattcttacgtttatgcccgtatgcaagtttctaaattagttttattacctttgttaaagaaaaaaaaagcagaagaatggaccctttagacagtgtctaacttatctcaattttccactcccctttgtgtaggcattgatttaatttgtggcatcgtttttaagatgcatattagattatcagaattgcatcaatgtgaaaaaaggagtaaaattaagaataataaatcaaaatagaataaatatgaaaataatagtaaatagaatttgtaatattttatagatgttattcatacttattttataacatttatataataaatacaaaaattagcaaaagaatttttctttcacagaattattattgcatgtaatatacaatgtagagttaaaaatgtggcagatgaatattatgatttctcaagattttcataataaaattatgaatgtttcaaatgtcaaagatctagattccatttatcctttgccttgcagttgagtaaatcctatttcttcggctaggttaccaggactttaaagaaaaatatttttctaacaaatatttctgtttggagctttttacaacaaatgagctctgcgtttgcatcgtacaaagtctagcttgcttcattgggaagaaaatggcatgagaaacagtatccatagatttaacaagctcatgacaacataagttatcaagtagcaaactgatagaaacgtaaactgattacttgggaaagcggcaagagtttggggtgctcatcagagccataaccatgagaactgccaaatgtttgtccttaactattagtttaccttatactgtacacgactctttagttctcccttgattgcacctcctgtaaaggggagataaaactctttgggagcctttcctgtgtttgattatcattctctccaacaccactatcaattgcccttgacaattttgtcacaccctccagcattactcttgctataaatcttgataattttagtatccatatagatgattcttaagtgctctgccatctcagttccttgaacttttgtcctccaatgatcttgtccaccctatctcagccatccactctaatggaaaaccttagactgtcatcatcagtaacctctgccctctgccccatctccatttcaagcatcccactgtttgactgttaccttctacatttacagattattccttcttgttctcagacttcaaatttcttgaccccacagagagatagtatatttaccctaacaccttttctcagttcctcaacctccactccctctttcagcttgcttccatgtcttcacttctctctttcctcatcttaggtgatgcagacctcataataatcacactttcagatattgattcaattttctgtttctcccaccgtaattaatcaactggcaatactccagcccttgttcaatccacatctgtgctaattcagcatctatactagttctgctggaggaaaatacaaccatgctgattggttttgcttaaacttaatgaccatcagtgcagaccaataagtcttctactcaaatgagttactgactttactttgttctctcatctataatatggggataataatagaaaactatagtcatagagttgagggatttaagtgtattcccatatacaaagaacctgacaatagtgcctggtacctagtaagggctcaatttattctacttctccccctcctctctccctccttctccctctcctcttccaccttctcctttttagtagtactacattagaattcccctagttaaattacctttataccaacctaattaattattttgaactttatttctcctgaaatcctgaatgcctccctctccccctcctaaggctaaggcttttaattcgcagagaaaacagaaagtcagaacaaaatggcctcatacctccaccaccatatctactcacccacttctagctgtgacccatattctgtctttttctttgttactatggatccttttccttgttcttatataaggccagctcttacagtcatgcagtatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaagaaaaactgggtccacccaacatggcaattcccaccgttgtccccttgcccttgcccccacatgtgcttggcagcatggctactcccacatatccccatgtgtgtaaaacatcatggctccctgcatttccatattaaaagactagggtggaagagtcagtttttccgcgggctacgtaaataacatgcctggtcaaaccaatcccctgagccctatgcaaatcaaacaccacctcctccagccatcgcatgtaactggctggtatcccctaaacacaaggtctcctctttcagcttcatttaaatgagaaaaaatattcctttattgcatatcccttaccagctaccattccatttaccagtttccctttacagcaaaatccctgaaagtattgtatatcattgtgtccacttcatctcttcccattctgtctatttaaacctattccaatcaggtttttacccctccccgcattattctacccaattactcttcctaaagtcaccagttacctccaccttcccaaatatggtgtcttgtcctcaatatctgcttccttgacctaaacagtggtggttgatgcagttcatcattccttcctcctgaaaacattttcttcacttggcttcaggacaccacactcgcttagcttttcttctacctcactgactgatccttctaagtctcctttattggttctttttcatcttcctaacctgtaaactttggtgggctccaggactcatccttgaacttggtcttttctctgtgcacactcaccctctttgtgtattactctcatgacttcaaacactgtctacatactggtgattccccaaattctccagcctggcattcttatttaaagttcaggcatatttccaactgcttccttgacttctccatgtagatgcctgattatcgtatttcggttaacaagtcccaaatagaaatattcatgtcacttccctaaatattatatgttcacagtcttctccatctcaataagcggcaaccccatccttccatttgcttaggtcaacatccttggagttttccttgccttctctctgtctctgacatgacacatcaatgcaccacaaatctttggctttctttcagaatatatgcactccagaactaaaccaactctcatcacttccacttctaccttctacatctaccctctcacacctgagttattgttatagtctcctcattagcatccctgcttccatccttatgcctccccactttgtgctccacagttatcctgttcatagtaagtcagataatgtgacaactcctctgttcagatttctccaatggattcttcaacgtccaaaatccttagtatggaatttaatgccctctgtgacatggcctaggggactatctttctgacctcatctccctaacccttactagctccttacttaccactcactgtgctccagtcatatcagttttcctgccgtttcttcacatcatgacaaacccacccctgctttagagcctttgcactggctgtttcttctgcttggactgctctttcccagattccccattgctcactccctcactaccttcaggtctctattcatatatgactttttcacagaggcttccctgactacttaatttaaaatagcattttgtcaccataatttcctatctcccattatctattatttatatatccattttatgcatccataatttatacagcacatttaaataaatcaagtcatgttaaatatgttaaatgtacatttattgaataaaatgcctatttgtatattgtttgtgtatgcacagtagagtataaattttttggcggtcaggatttttgttttgctcactgttttttgttgaatgaatcaatacgtacttgcttatttgtttattgtcttcctctactagaatgtcagctccttgagggcagggtctttattttgcttagtgatctttcccgagtacctggaacagagtctggaatatactaggtactcaataaatgttgcctacaatatttaattaattgattagttagttcagacattgaaagagcttccaagagtaatgtttaaactcaatcaatgtaatggataaatatccaagtactgtatgaggaaaagatattgataaacgttgcctgtatttataagattcataattttactcaactctttgatgaggaaatgttgacttgtccaaaagcaggtaaatataaatagaaaaaccggaggtttttcttgataagagtatccctctatatgaagcagagacgtaattcagcctaatttatattgaactcctatagtccaactattgattccttatcacttgctgacatttgttgctagggagcattgtgagtatttgaaatatacatttatttccactaagagttatgtaatcaattttaatatattttaaatatactttatgatgatgtagattaataatggaaatgatgatggcggtggtggtggtggcgatggtgatggtcatgtgtgtttgtcatagctaaagaacagcattgaaacttttccagtgcacacaacacacacaaaatccacttataactaaaaattaattatgaagtaggtcagtcttataaaggatttttaaggaaacataattacatgaattttctagattaactcaaactatgctaactcttgtcctcagatgacttgaattaatgaaatgatatataattagtgtttcagttgtttacatgtaaatataagttgagtattccagaaaagtttgttcgtaggcactttttcatctctagtttttattttatactgaaacaaaaagaaataaaacatcaccccaaactcactacacagatatttcagtgtctatcacctgtatgcctccctgtgtatatatacacatatatctacttgattgtatgtaaatgagataactttatatgacctgttctgtaacttgcttttttacgcacatcttgtgcatgtatttctatgtcaataaatgtacatccacattattgttttaaaagatgaataacattctgttgtatgtatgtaccataatctgctcatccagtcctctgctgatgcatttttttctttgttgctgttacaaaataatgttatggtaaacattcttatgcatgcatcatctttataatttgacttgcaagtatttttaaagtttctttctcagtgtcattattttgttctatacgtataaagggatctctaaacaaaatcaagtttcttccctattctgtttttaaattattgtaaatttcaaagtagcgaaattggaataaatgagattttactgtgtactttgcctggagccctctcttgaagtgtattcaaagggaattaaagggcttattaacggataggactatttgtgttaaagatgaagtctgttgaacattttcacctaaatataccaatctgatattcttgacgtttttttgttaaatttgatgctgacaataaaaactttggaataagctataatttctgcatccatgcatattcaggtctgaaaatgaaagaagagtgtgacaggtttgcatgtagaacttcccacccactcatttctttcctttctgcttctgacacttcagcctttgaaacagtttcccatgagcaatactgagattcagactatttagatctaaaggaaaaaatgcaagctcttctacagcttgtatctagcacctggaaacgtcttagaagaagtgctaaaatgtaaataatgctgttatttgttatgcacataggagaaatcctaaaggtattttagggaagagatggaatccagagatattaagaacaaggtgtgggggccaggggagaaggggagaggcagaaggatcctatccacattattaaagtgaaatatttccagtatactcttatcaactgacatgtagactgcatgccgctttcatgcaaaggtatcacatttcaaacttagcatttaaaagaagccagacaagaaaggaaaagagacagttatttgttgaaaaaagtctgggtttagcatcaggcacaggggttattggtagttgtctgaagtacactggagccttgtaacattgttttgtgccatgtattgccagcctgataccactggagtacatcctctgtctagttttccagaactcactacaataactgtaggatttttccatcctttatgaaattgcatcagtattgtgaagggccttaaaagccattcagttcaacaaccatctcccaaaagaaaagttcctcttctttttccatttattttatctcttcccaaagccatggggacctagatacatcaattatcctttgtcctgtaccttcactacctcctggactactaccttttttccactggcatacagatcatttcaagacttctcatcctaaaaagtccctcctaagtttctctttcagactgtctctttcctttgataggcaagagctttcttcattttctcgcctatttttaaattattcagcttcacctttgcttttattttctcatctaattcttaattattcagccctccgcattctatcttctgcccacattgccatccatgaactcctcctgctaatgtcgctagtgactgccaactaaaatccatttctcccttcagtccttaccttatttctcctttctacagcacttgaccaggttggtcaactttttcattgaaaccatctcttctgtgggctttcacaacactgctttttctctgttctacaccatcactatttttcttttaatttttacacttccctcgtcttttctgaaatgtttgatgtcctccccacccccagtttccagcctcagtagttgtcttgtattctgcttgtgttctctagattattaaatgtattcttgtggtttcagttaccatccatatgcagacacctttcatcttgagagccaggcttatatatacaaatggctgctgcacattaacctatcactaatggctctttaaactcaaaataaccaacaatggagtcattgtctctatctctgaaatagaacacactaccctcccccacttcttcccctttttaccctgtggcaacaaccttttgctatcctgattttaagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagattcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaaccaatattaatgttctgttatagatccttgtagtggctagctggaattcgtgtatatctctctctctctgtctttgtctttctttctctctctctctctatatatatacatatattccaaatatacatttttatgtaatatatatgtatattatatatgtatacatatattccaaatatacatatatatcttcatgtaatatatacgtattttatatatatgtataaatacataatatacatatataacctaatatatgatatagcataatatatgtatacacatatatgtgtacatatataaaatacatatatattacataaagatatatatgtacatttggaataactatgcataccatgtttcaaacctgctgtttactcgttattatgactattcctctatatattaaaatattattcttaatctacattttagtggttgaatagtaataatctatttagtttgttctctgtttatttgtttttgtttttgggaacaaggaactgttcacacctaaatgtgtacaacctttatgtctagatcaggcacttgaattcttaaaaaagtgttaggaaatggaataatgatcttttatttataagttgtatatgtttctgtattctgttcatatatgataattgaaatagacctatatctaacactttaaaatttatagtattttcatctttatttcctcatttgatccctgctacaccttgtgagatagagaagggcttattattctgtccttatagataaggaaacttatgtccagaaagatgaagtggttttccaaaagacacgtagctaataaataattgacaacattggaatttggaattagaaagcaagtcttgtgactcctaaccaatactctttccagtacactttgccatgtcccaacttcactttctttaagtgcttctttctagcacctcttattcaattattgtcatacgtactttttggatcataccttaggagaatgtagctttctcatgaatttcctcattagctgacaactgaatatggctagattttaacaataaaaacacatttttttcttttcaggaatgcaaatacacagtgtattatatgtagaaaaaactctcagatattggatccttattgatgaggcttatgagataatatagcaactcagacttttctcaggaagaagaaaatccatgtcttttgttggacagtttagagagtctagactaccatcattcagcatttgaacattttgatttcaaaatgtagacaattgaagaaatacaatgtaaatgccagggaattaaatcataggacaaaaactccctatgaaaacatcttagtgatagcatacatgttaaaatttttgaaaacactgggaatggtttcacttctcatctgagtatctgagaaacagatgattatgtacctcccagccctgtgtcagccctaatttagttgatggcattattgctccctgctttcttttttttctctttatagcagattgctattcttttttactttaaaatagcaccttttgctgccctgtcttatccttgtgctcttttaaaaagtggtcaggcacacacttttgtcactagttttacatgagggtaggggctttctcttttcttttcaaaaattaagtgccactacatctcagttaaactgccttcatctgacaagcacttacagaatactgaaatataatctactgcaaaaaatctacatgtttttcataaatacgaatgaaatgcttttaatattatccctgtgttcagagttaatgcttaggcattaactaaagtacgctagacgcttttgatatatttccaaaggcccagccagaaagatatattgcagatacacatattctaagtgtttacaaaatcttccaaaattattttgcctgtgtctgcttaaaaggcacaggaaacagctcccctactatctcctctatccagtcaggaacacttgcagtaaggacactggttgttcagtgcacaaggattaaagtaacttaattacacagtcaaatcaataataaattgagatcattagagccttggctcgagctgaaccccaggtagccgtggaatccctatgatacttgaagaagaattgacacagattctaaggcctcacaggttcaaggagaagcagacagcctcactttgttccttcaaattagttttgagtggaggaatcttaggtttaagtgagacctggatcttgttttggggtgatctctggaaactgggatataatctactctccagggtagaagactatgaagggactaaaggagcaaactctaggtcactgagaacccctttcctacaaacaaagatcttggttgtgttccctcacttccagagagctcattggaccgagcatacccttgagtattaaggtcagtgcatactgagtttaaaaacaacataggtataaaattgaatggagcagtggtgaggaaggtggaaaaggatgagaagggaacttcctttggacttctttgagccaaaataagtagtatgtttcctaaattcttgtaatcagaccattgttggctattggtagagggaggttcagattttccatctctatcttttttcttctgtttcttggtccttctgccactgcttcttttaaaaagaaataaactcatttttttctcagccttatgtgggaaaccctcttggcattttctaactgccaagtgttctataactagccatctgtggaatatttttttgttaagttaattttttaaattaattcatttcccttttctctctctctctctctctctcacacatgcaaactagtgtttgaagatcaatgagcaaatgatctttcttgtaacaacttccctttttcagctgatcgcttttctgaattttatctcctaaaatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaactatctgtgtatataaataatcaaggtgatgttaactgctttatggattttcttgagcaatttaacacaagattgattagtgatttctgtctgtagaaaatgtttgattccaggctggcttagcctcaccacacttctgactgcctcctccctatctgaggaggctcagaaaatacacaatcatttcaatattcacctaagcaaaataaaataggaagataaatttctgccctgaatactgtgatgcgtaatattaatacaaaactccaagagaaatacatttgaggtaattttttttttaacttggataacttaactgtgagtagaggcctgtgattccacaacttcactaatgtggaattttttctttctttccattagtccagactctagactttgagggtggagggggaactagtcttgttcaagctggagttccttattaatgagagatagtttagaaatcctgaataaggctttggaccagacaataaaaaaggaaatgtgaaagctcagagccttctagaacaaagaaacaccccaaatcttatgcctgtcagctggatggtgacagtacccagtagctctgcagtaggcaccagagcatctgaagtacaactggtggacctcgagagaatgggagctagctgaaaaccattctctccttcttaatgattatccattagcacaccatgtttttattgcagaatagattagaaacaattagcaaatggaaaattgaagaggcccttgctgcttttagtgtttagatgtaacttttgaacagaatcaaaatgctctttttggagtcagatttgccattttacctgaattccattttatgcgtctgccatgggttacatgcttcattccatttaaaaacggaaattttctggatgtagattcagtatgtcttgctgattgctgcatttatttcagatgctctttagaaagcattgtttagtaagctaactttttcatgctgagcattaaagtgatggttgaagcatattccaaagtcatcttttaactcacaagaatatggaaccatattgacttctaccaagacagtttaatcattcattgttaacaaagaacattatcatttttattgtacttgtcattacctattactgtactcttgtctgaaaaggcactatggtataagaaaaaataatgaaattaaacgaacaatggatctgattttgtcaatgctcaggaagtgaatcactcaatgccagtcctatagaattcagggaaacatcattagggcttcaggaatttcgactttactaatgtggattttgttatatttctcacatagacttggatgaagctttatgtgaatgcaaattttctcatttcttatattgatgcattgtttatttgcatttttattgtaactcctccaaagagaagaaaatcttggttaatatgcagattagaatttttattgaggattgtgttttattgttcttaaagactaaggtggtaaagaaggttagaaccccctgatgaaatctgcatcacattcaaagaaatagtacttagtgagattttgtcatgaacactttcacagcttgattctatttctcattatatcccaattatcaaacgaaataaaacaaagccattcctatagaatgaaacacatgaaaatggcaaactgcctgtaaaaatgaacaaggaaatactgatcttcaactattcctatacccttatttctaacctaatgtaccaactctccttctctcattttcttttaccaaagtactctgaggcagagaaattaaatttctatctaatactattggtgaaaacagaagactatatgagaaacagagaaaatctccaaacaatcatggtgtctcctggacttcctaatatggaagtcatctaatatgattaagtaatgcagcactagtaacatcaccagagttcacagtgaaatgttttcattcatccccactggaactccaaagcaccaagtggacttagcatcagaacttaagaaactgaagccttcgttagccgtaagtctttgcaaagaaatggaatcacagttttgatttatgtaagaggcacaaagcaaaccattactctgtatccacaaatgtcaattgtagaggagcaccaggtatctgagaggaagatctttgagggatatgctgcttcttatacccttttccaagctcttatttgtttagagtacaacaaaaggaaaggctgagtaagagaactgtgatagggtttgggagaaggaaggaaaattccatggacatatactagccaagtaacttacgtagtttgggtcacttgttatctgttaactacccctaactcctctagtgaatgaggagtagtggtagtagatttctgaaaagacaacacagtgtttattacctaaaggagcagacttcctcaaatgtgtttctgttggacctttggattgtataacatactgtttggggacagaaatgaaacttcctagttatatttttcttagatgtatactatagtgggtgtgtattatctgtgtaattcccccaactgtaatatatttcaaatcactttattctaaaaatgaagtacatcttacatagagcaacattcaaataaaatatttgccatagaaaatagagggtacaacgatggttactagaggttggaaagggtgaggcagggagtggggatggttaatgggtacaaaaatatagttagataggataagatctagtgtttcatattcacagggtgactactgtcaccaataatttattgtacattttaaaataactaaaagagtataactggattgtaacacaaagaaagggtaagtgcttgaggtgatggataccccatttactctgatgtgattattacacacagtatacctgtatcaaaatatctcatgtactccataaatatatacacctgctatgtacccacaaacaaatttttaaattcaaatttaaaaaattaaatgtgtgtcatgagaatttctaagaagggcactccaaatcattggtttgccttgctagacaaagtgtaaattattttaacacaatatacagctgggtaaaaggaaaaaaagactgtgacttgtttgccacccacagggctgtcaggaaaggctacaacatttcacttctcaaggagtaagttccttttacagattaaattggaaatacagttacattttatttcatctcaccaatgttgaattaataacctatgtgaaacctttatttagaaatgaacacttcaagcatgcgttaaattagcaactaagtacatagcttataagaccatgaagaatggttatgtttataatgttcatttttaaaaaaaaatattatactttaagttctgggatacatgtgcagaagtgcaggcttgttacatagttatacatgtgccatggtggtttgttgcacccatcaactcatcatctaggttttaagccccacatgcattagctatttgtcctaaagctctccctccccttgccccccacctgccaacaggccccagtgtgtgatgttcccctgcctgtgtccatgtgttctcattgttcaactcccacttatgaatgaaaacttgtggtgtttggttttctgttcctgtgttagtttgctgcgaatgatggttttcagcttcatctgtgtccctgcaaaggacatgaacgcattcttttttatggctgcatagtattccatggtgtgtatgtgccacattttcttcatccagtctatcattgatgggcatttgggttggttccaagtctttgctattgtgaatagtgccacagtaaacatacatgtgcatgtgtctttatagtagaatgatttataatcctttggttatatacccagtaatgggattggtgggtcaaatggtatttctggttctagatcctcgaggaatggccacactgtcttccacaatggttgaactaatttacacacccaccaacagtgtgaaagcattcctatttctccacatcctctccagcacctgttgtttcctgaatttttaatgatcgccattctaactggcgtgagatggtatctcattgtggttttgatttgcacctaatgttcatttttatacttaattattttagaggcaggttgttgctatgttgtccagactggactccagctcctgggctcaactgatcgccctgcttcagcctcttgagtagctgggactataggcatgcaccactgcacctagccttacttaattaaaaaatatctttctagaacatttttagctcattgcttcagaaggtattaatgtgatggttcagatctgtcattcattttttcaagtcattactcgtgtccttcacatttcagaaggattagagagataagaagatcaactttcaagattatgtaagattgatagaaaaagcaagccagtatttccaccatcagcttgagataagattccatattttgacttatacaggtgatagaggcgaatgtttttcaatttgaggtatttgtcagaataggcaagagatgaggacttacactttaaaaaattcttctttaaagacaagtttgagaataaaatcaagctatgattatgtagcctagtagaaataatatttatcatcccttaacttgtaaatgagaaaggtcagtatcattctttctgttgtataaattttgaagctcaaggctcagagcatttgccagactttagtaagggtcatctttaaaccagtgaccgatccagagattcctctccattagaattcctggatgtaaaagaatgtaactggtcttgaccttaagctactcccgacactcgaatgttcaaatgtctttcagacaaactgaaaagttattttccgtactattatataagaatgattattcttttgcattcatagattgaatttaaatttgtcataattgtaacttttgacttatatacctagcctaaataaataaaaatgtttactttaaaaagtccaattagaatcattggcttaactagttgctttcatttaagtattcatacaaaagaaaagaggttttaaggattagtttctttcatgtgctaggcagtctagctgatagctgttgtagtgaaggcaatttctgttagtaattgctggttgtatttgcttacacctttatttaaaggaaacttgtctgttttgacagtctcacattttttgctcattctgaaaattacttgggaaaattacttgagtgcagaaaagttattttctttgtattgtagaaaaacatccttccctcctgaacacaaatattgtagtcctggtgaaagctaactgctcaacttcacttgttggctttgtttcagtaaggttctgccattacaatggaagcttatttcatagtttccactttcacgactgatcctcaataaaagaaaacaaccagttaagcataataaatatttgatttagtaacttgaacatagtcactttaaaaatcagaagcgactctataaggcaagacctttattagaattctctgctgtcctatgcagtaatggaggaagaaacataattatcaaagatctacatcaatgacatatttcagattgtgatttctgacatcagtgtagtaatcatactgggaattggttgtttttatttctagcaggcagaatctgaattttggttttggattaccagaataattgcttctcggccttttggctaagatcaagtgtggattaccagaataatccttcatagagcccagtagtcagtaaaagatttggtttccttaagtatatagtcaaagccattaagtggaaaattgagataataaaagtaggcaatgtagttccgtcatcacatgcaatatgattgtataatattgtgtcaaaatttcaaaatagtttcaaatagtttatgcatacccatgtggcttgaggcaaaagctcctaatattggctctttagggctaacggcaaatgcccatatttaaatgcttgtgtctataggaagtcagtaattgctaaaggtaattctgtttgcagttctaataagataagtgaataacatggtgattaatgttattttaataatagatggagtcatataaacacctaattcttaagttagtgggttgtgtttgttcatgacaaatgggaccccggaggatcaaaattaaagattcaactaaatattttcattcatttccaagaacctagtacattaccctgcccataggcaatcaataaatatatgccaattaattggctttttttttctaaaattgatttccaataattcctaaagaacaaggtcaaggagaataatatgtaggagtcattttaccaataattgataattgagctcagagtgcacaggggtgatctatgaaacgccatcatgatttctgaaaagctttagcaagggttattaaatataacagattatttcattcagtactatcagtctgattgaaaagttaggccttaatgatgtccatagctggtattttgttcctttctatgtgtagcatttccctggttaagatgcctcacaatgttctcaaattagtatctttcagccttctttgttttttggacattgtgtctgttttttgaggaggagtctgcctgccatttgtttcacactttagtagtacctacctataagattgaaaaggaggttgtgccccctacttttctgacactttaacccaccagcattaagctaataacctactggcgtctgccagaagatttgttagtgttaaacccatatgcttctagtgtttggcaatgtgaaatattataccaagtcttatcattcaccggttatcatgaacccctcaaggtgctatggtctcctcctccaataagctcagttgaactccttgccaaccaagagatactgtgacaggattgttcttatttgctgttgctatcagctttgaggagccactgcagcctggagaaagccttagaaaatttcccaaggcaactctgctattcccccctaacacctacgggatttacatacgctatgccattgtattccctatgataatatatgtaaagtcctgtacacattactgacatgctatacgtgttgaataaatgtcagctatttctattattaaatatccattattatgactgagcctctctagtggcccttaggctaaaatgactgttatacctcagtctaggatgctcttactaaacagcagctccttctctgattaaagcaccatgtgttctcaaagttcctatagtgcactatgattactcctactttggtactcatcttgccaaacaatacttgcaacatttatccttcctgtttctctaaccagactgtaaattctgaaaaagcaggaaatagctgtgacttgttcactgtagtatccctagggctttagcatagtgtctacacttttcatgcatgtagtaggtgttcagtaagtgtttattgaattaatgaatgaatgaaaagtatcctagtatcacaggttctgaattattcctacagagaagtccccaaagaagctatgtattctccagttaccctctgaaaccatagggtaagcataatcaacatattttctatgaatagatgcaaagcgttaatattagcaattatgctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatgtatgtatgtatgtatgtatttttgagccggagtttcactctgtcacccaggctggagtgcagtggtgcaatcccagctcattgcaacctccgcctcccgggttcaagcgattttcctgcctcagcctcccaagtagctgggattacaggtgagtgccaccacgcccagatgatttctgtatttttagtagagacggggttttactatgttaaccaggctggtcttgaactcctgacctcaagcgatccgcccacctcagcctcccaaagtgttgggattactggcatgagccaccatgcccagcccatcaccccattttgaaaaccaaaagcctaaatcactcaccttgaagcagatttgatgctgactatagacactaattgattgttagtcctgttttggtttatacataggggcagccattactatgctattttattcaggcacgaagtaattgttttatatgaatgcaaacattctaaaatactgccattcattcctcaatttataaacttcttctttaggaaattgtattccttattataggctgggtgaccctttacaaatcttaacttattttatcctcctaacaactttatggagaatgtactatattttccccattttaaagatgaggaaactgaggcatggaggtaacattacttgcccaaagttactaagttagacccgactgggttctaattattgttctgcaacttactgacttaaaaactcaaccagtatgcaaattcaaagcttccttaatacagaatgtaaagtgaagaacaagagtgtacagcacaccaatctgggacgctatttgccattagttcagatttttttaaaggcatgtaatcaccccttatacatttttccttttcccagtgtgccaaaatcagcaagccaagacagttgattgcagtgggcatgtcttaaaaaccagtttccatgaaaggagcgactaaagggcctattgtgcttgttgccttacttttattttgagtccagtatctagtctgttagtttatatacagaagagactatcttgcagggaattcagctaaccctctgcactgctcttaggtcagggccctgaacctttgctcctggctaagccatcccaggtatttgattagatacgttacttctgagttcacttattagcaaggcacactatgatggagtcctgatgtacctacttgccagtgagtagaataaagatacattttgtgtttattgctgttgataaaacacttgtgtaaagtgtaatttataatttaatcacttttaattcaatttttaattaaaaatttaactttttaattttaataattaattactaataattaacttaatcattctttttttctttctccttcactatgcttcctttgaaatcatttccttctctaaacaacattggaagcgtggcactgaagtgatagatttttgtatcccattgtacttaattagcaagttgtggcatgtatttggttaatatttctctttctaaaaagattattatctttgttttggtaaattgaagagaaattgtggtccatggcaaaaagaatgaaccatgaacccatctgtacggtatgtgctcagcctgagatgcccatattctacaaagagcaatttaagcatgagtgatatcaggtgttaagcccccatgaaacatcagagataaatactaggtccctggctaacctgctttcgatgttttactgttcaatctgtaatctgcagtgtattttaattaaatcatcaaaattacagaattttctttggaaagatgtattcttcatttgttgtttggttcaatacaaggagttggcatttctgatatgttgagaagatttcactttcacatattactaggataagtccttgaaatttactagccatcaggatttgctgcttttaatgattaattacctgttggcacacttttcaaaggtattctctttagctgtttcctttcatcttgccctaccttttttgtgaatagcctttcatgtttagctcaaaagagtattcataaaggtttatttcgtttctttgggtagagatgctgatttataattttaatgcagttcgtaacagcagtgaaaattaaagtcctgagaactgtacctcagtagggtcctaaatattttatgacaggtctaattgtttaataattatgcaaagaccttaaaaatttggaataatttgtcccttcactgtaccaggctaccaggattcatctatcccttaatttagtaaatttttatgtcaggaatagagtaccatgtactgttccaaacactggagtacagcaatgagcaaaacataatccttgcccacagggagctcatattatagagagggtagacagactttaaacaaataaagatatagttttctttggagaataaacaagaagggttagaggggtagagagtgcggagagataagggtttctctttcatataggatggtcaggggaagcctctctgttgaggtggtatttgaaggatgagaggggaaggttcaggcggatatctggaggaaaattattcaaggcagaggtgtaagccagttcaaagagtcagaggtggggatatgcttagcatattaaagggacaagcttggaagccagtgtgacatataaaatgaaaaaagaggacaaatgatacataagatcaaagacgtagtagtggtcagatcacagatgatctcataggccaagtcagggactttgtctttgactctgagtgaaatgaaaagctattgggaggtgtagagtagaagaatgacatgatctgctttatattgtaaattaatgttatactacatgtatagtttacatgtatagtggccaactaacagagtgaattagggaatgctatcaaggagtccacaattttccctccaccccatgtggcctcactggctttgctttgttccacagacaaagaatgaacctcagattttaacaaaacattgtggacatttgctctgtaggtcagaatggaattggcaagaaagtataattagctcagcccatcccatctacactgcacaaagaaaataatgagtacactcatttaactcagctatcagcagtgcagcaaaaacaactcccactgaagtgagtcaggagcatcttcataaaccaaggcaagcatattacaccctaaatgatggctcagtggcctcaaggaaataaagtatcttcctaagcacctaatttactaccaggctgtgactcaggctcaggaaaaatcgaatctattattatatattcagaatacagtgagcaactgtggctaaatattgagaatacttaaaagaatggagagttaatattgctaagaaaacaaatgtgtagtctgaaattattttcactgcttatgtgtatgtctgtcttcctgtcactgctgtttacacacccatctctttgcttttttgttggagttgtacacataatttgatgtgcttgcacagagttaaacatccctattctaatggcttcatacctgctaaatttgtctactcctatttccttcaaatgctagaaaattagtgaagtccctggcaactaagtatagtctgcagagcttaccccaaagctatgagatttgaaactctgttagtgtttactcagagtcttcatactatcttttactctggtcacttggcttatggttcccctgttccttcctcctccctatggttttcagcaaatatccagcttctgtaaacattccttcagtagatctgaattgcatagagtataacttcagtgacaccaaagtgtgttttgtagcatgttgtttctgatgattgaagcaatcttcctgtgcagaaaggtgatttaaaaatggagccgccttatacaaaattacagctagataagaggaatgaattctggtgttgtgcagcagtaaagggtgaatatggttaactataatttattatatagtttcaaaaagctagaagagaggatttttgaatggtcacaacacaaagaaatgatgaatgtttaaggtgatggatatgctaattatcctgatatgatcattacaccttgtatacatgtatcgaaacatcactcttatcccattaatatgtacagttattatgtgtaaactaaaaagagaaagaaaaaattgaatcttaatatcttatattggcatagaatgtagtgtattgtttatagttcactatgattaattgactcatatttggctagtcataacatgtacgacttgtatgttcttgtaggaacatgtacgacttgtatgttcttgtaggtactgtcatgatggcaacttgggtcattctgaagtgtgattctgaaagatctggttttaggtttcaacaaaagttatttaaattttaatctgttccttgctctaggataatcacatttttttttagagattggtaagcaattagctgctgccgcttctaatgataatagaatacttaactataacatgaatttaccaaatgaatccttttggaatggaataaatgctcaagcaggttattctagtaggaagagattcatgcaaagtagagttatatcttgtttggccagtgtagactatagaactcagttttggtctgttgtcttcttgctgtaagaatacactttaggatacttcatgagttcaggctgagacctgggaagtgctctttggacaactgtctagagaaggcacatgctattccaaaagtgctaagcaccatggttgtcagaatctagtttaggaaaactagtgcacgtgataggcacttaagaattctttgttgaattgaatgagtaaactcttcattaaatggcatatagaaaaaatggtcttcataagtcagccagaggtgataccacacattctgctaaacaacaaacattatgtgaagatgttgttcagaggagttctgactgtctagggaaatcatgcattgtgattctttacacaaaccactttctttctggaaccagaacttatacctgctttacctagagaacagaatagaatagctaggctcatctgaaaatgttttagttgatataaaccagcacacataattgaatgtcttcttttctgaacaactgacatttgagagtcagtcaaagaacaagtctatgtctcctttccccagtagtgagcttcaaagcagagcaaatggatccatgacagggccgaggagggaagaatcagatgtggagtgcatgcaaccctacccccagagacataacttgggcaggagaggaaaagaatgtatatctggtacaccctgtctcccttacagttatcacctttccatcaactgactgtgtttattttagttggaagtcagcatttaaccagttctgcctgaagcttagtgagggagtttgattctgagaactgtgttctcactgaagggcaatattctctttctcttggggaaggagtgttgtttgtatcctcctgatgttgagggatatagtagccatcatcatgtaatgacataccaaatgtattttatctgagagtttaaaaattagaagcaatccaattgctgatgtgattcatgaataaatgatgcaacttataatgacttggtgataacaatttattgtataccaatcacgtgcactcagaagaacctgtgcatgaaatcaatgtgagcgctaagactaaatgcaaatatattgtggacatttaaagttttagcccccttgattatctttaaggtaatatatacaacatatttgccaatatagatttttcttcaccagccatctggtaaaaattagtatgagataaataatttagcttccttctgttcagatacaacttcattatcctcttccttgatgctgtgaaaagtcttcagaaataatcaatggtaaagtgcatttgcattcctgtcaaagctgagcctggaggtttctgacatgctgacgtttgattctttttctctgtgcgctgtgaaaaggagaggtgcctattatcaactggccccaaagaattgcgtgcatagtggcagccttgcacaagtgcactgcctgctaaatcacagtgtgaggaagcatgacatgacacaactgggatgttcgagaactgcaagtcatttttcaggatttaaaaaaaataatactgcagaacataagaaagagatttaggaggaattagttacatactccttgtgacctaatgattctctctctacccacagagactatcttacccttgaagcacagtaattggtttgtaggagatatttttccattcataagaaaaaaatatctcctacttttcatcctggacttatttctccaatctggcttgagttgaggaatcttatgctagagttgtaggagagcaggtgccagattgtggagggccttgaacgcccggccagggagtttagattttatcctgtaggcagcagagagccattaaaagattttgagcaggaggaatgtaaaaaataggacttgatttggatgcacgcttagtataaaagtgcaatgataagatatattaagggagtgttacggttctgttcacagcatgaatataactgtaggattcatctctactagctgactagttcagtttttatagcatgcaaattttcagagccagctgtaagaggttgatggtaaaagaacaaagtacgaattgatcatgtgaatgtaattgtaaggagggatttttaaatgatcaagatcactggtaacacagaatagtaatcattttaaagggtgactgtagaattatttgttattttgtttgagttatctgaaaccacttctatgctatataattaccttaagttttaagtgctccctgcagggataatttatgcattttgcattctcatgcaaatactttaacagtctacattgttgaaaatagaactgaacattatttcagataggtaatggttgtacaaagcttatgaagtattcatcatttttatatattctcatggtttatattatattactgtgttgtgttttcagctacagtgatacttaggtaacaaatatttgaaaatttaaattgcatgttttgataaagaactgtaatttgccaatttcaaaatttaatgtcatcaaaatccttttaaaatattaatataaaatgttgcagtatttcaggaaatacaaggcaagccaaatttaatttaagctactaggggctcagttatgaattgtagctagatacgtggccaaacactcccgtaaagcattgcatttttaggattcaggcttcaccgcagtggtttctgtagagccataatataagatgataatcataaacagcatcacaggcgatggcagtttagtcgtaaataggaaaccgttgtcttgttcactgcaacatagctacacatgtaagcattatatatcccttgtgaaaatgtgattcactttatgatggtgacattcatatttcaaagtgtcttgttttaatgagctttcacaggatttctttgcaccaatcttgaacttctcaagagtcctggatttccttttttttttttttttttttccccagagatggatgtgcattaagcataggaaaacctccaggaagaaatatgtttactcctctgtttggctcctctatagacactaactttacagaagaactttacttaccttgggcagcctatcggatttcaccctgagctctgagcacagctgggagtttggacagtaaagagatgtcttctccagcaaaggggagacaacttactttccagccttccccgttaaacattcacgggtgagggtggtggatatttctcaaagtccacaggtttatagaattggggaaagcaaatggcccatttttttaactttctgtgttttcactctctgttgtctttctccgctttgtatttctgtgtttcgctctgtctctctcatgtatgtatgcatgtgagtgcacacatacacacacacgaatctgactaaataatttatatatctccttatatgtgttacctgcgtctgtacctgaaaaggcagaagcctaatttcagtaaaggtgctctagggtcatttcctgaatacctctagagtagagttcactggaaataaaaaacccaacatgtgcccaaactcagttgtgagtatttttgcagtagaagagtgaacttttcatgccatgatctaggagaatgttaagtggacagatttatataagataaatggaatgctgctgcccgttgtaatggaaaaagaagcggcctaggggataggctgcctggcttggcttctgctctgtgtcagacctcttcctaccctctggaactcaggatcagttggagctcctggatcttcagtgtcttgcagccccagaaatatcacatgccagtaccagctaccgtaaacagattccagcttcctctagaaggagctgcttccctgcactggattagttctccagcagaaagtgttaatgccaggttccagtgtattagcatctcttgtttcatttctttgactctaaaacaagctctttagagatttttttaaaagtctaccaaaacccattataatcattacttttgttatcattacttttgttaaactgtcccttacctgtcacttgaatgccataactattcaagcagttgtagaaaactttaaatgtaggcactgcttaaacataaaatactgttatatttttcattattgttattagtaatctacattatgaaagtagaactagtaaaacagtggtttggaacaaaagaagtgagataataacattgtagttttgtagcatagtaattaaagtgagatgtgtaaatgtcatctggcctattaatatggaattatttcacaaatccctttattatcatgtggtctcactgatacacattatagtaattctagtattagattcttagaatattttaagcgctaaatcaaaggctcatgcattgtcatccttgaaaaggaatcactactgtaagcatttctcacacatacaattaatgtgtagcattagcccctcacagaaatggaaaggtgcttttcttctctgtttttattgaccaccaccagtttttataccaatttcaagttgcggggtggggagaatactacattttcttatatatcacacaaatggaaagttaaaggaagggaagagatctggtagttgtcgagcatttccacttaagctaactgcttccccatgccttctgtgatcttccgtatgaagcacatgatgctgtccccatcttgcagatgcaggatcagaaaacacacgaattgcctacagtcagaaaacttggaagtggaagaggcaactttgagctgagctcttcaaaagggccagggcacacaaataggagggagggctgagccttcagcaaacgttgaagttgcgcatttagaagggagttggcattacagctgttgtctacccagtgactactctgtgggtgaaaaggtgcacttgcaattgagtttattttaaaaatgacttgttaagggcaccattgctgtgattttctcacctgtgaggtgggaggaactctcctctcaggccagagggaagtaattactgagaggtgccttcaagagtaaagcagattgttatatatttcaaagggggctgtcacagtgcctgggacacagtaggctttcattaaatcctagattagaattaattcttctatttgggtctcaaatgaataaattggctccctccattcagattcgtgacaaatgactgccactagcatcctctcatgtagctcctttcaaggggctgatgagtagaaatgcattcttcataaaaaaggttcctctctttagcacttgttatcctcagcagtcatttgcagatgtaatgtgatgcagcagtttaatagtcctctgcagcaccattctcatccattcaaatccttggtttatagatgaggcctttgcaccttgccctgtgacaccagcttttatgttttgcagcagaaagaatgctatagtgacttccatttgagcagttgctgttggctagcattactttcctacttgttcaagaaagtctcctttcaaagtttttgaagaagcagactcctaattactgtgacacttttcttcagagacaaaccctaccaaatgtaacagagctgctatccaatgtgtgtcaaaagtgtgattctcaaagattcctggccaggtgcggtggctcacacctgtaatcccagcactttgcgaggccaaggcaggtggatcacctgaggtcaggagttcgggaccagcctggccaacatggtaaaaccccgtctctactaaaaaaatacaaaaattagccaggtgtggtggcccttgcctgtaatcccagctacttggaaggctgaggcaggagaatcccttgaacccgggaggtggaggttgcagggagccaagatcatgccattgtactccagcctgggcaacagaacgagactccatctcaaaaaagaaaagaaaaaaaaaatcctgaggtacaagaatataatatgcacccaccttggtatcattttatttttaataggccttgccagagcttttcaattcatctaggaggaaaggacctttgtcttgtgcatgacagttggttggatctctgtgaaaatttttcagagctcctaagctttgaatttttagtcaagtgcttgcaacagctatttaaaaagacacaacctactaagcttgttctcctgataacatgtacttcagaactcatattcttgcagctggatttagatcccactctgaagtcagtacagagaagaggactgccacaaatgagaaagcttcatagtagcagagactatgtatccaataggcacaaattaattacagagaatggctaaaagactagaaggtttgtttttagaaatcatatctgatatttgattcacctttcaaaacacatagatcaacactgccattaaaaaaaccaatatactgaattaatacacataataagcaggttaatagggggttttttagggggttattcaccttagagaagtgttcttcgcttgaaataaaaaattccacagatttctgttaaacagtgagatgccctaataagttttaaaatatacaacagttcacacagtctctctagaacatattttatgtaaaatgaattacaccctctgccacctaattggattgcctaaacaatccgtatccttctgcagggttaaggtcagactaacacagtcttgggccagtcacacagtcttgaagacatatggcctatctctcttctttgtcacgagtctcaacaagctacttccatgtcaaaatgtatttgctgaccagtcttgcaggagagtgaggcgtttggatcatgtaatttttgtatcacgacaaaaataacccatcttagcctctggaagggatgtattgtatttgtttgttctcattctttaacttctagcttatttcagtgtgttttataaaacattgttttggaagaatggagagcctgggtaatccattgtatgacattgctttagagaaatatatgaaaatccagaacaattcagtatagaggactaaatgaactccagggctgaaatatggtcatatctgagtcctagctctgttttcagcagtccattggttgacaggttcctgaatagttttcttatttttgtttgtgaagaactaaggagaaaaagcaacactgtgttgacatattttgtggggccaacataaggtaaattaaaatatctatgaaatatctaggaatatagaaagtcttggtaaagaattcagtgtaaccatatgaggcaaaatagtcccaatgtgcatactcttaattccaatttgcatttctttagaaatcgttgctaattaacctgtgtatttttaagtcattttgtggcatggtatttcatgaagcccttttatttaagcactgcatttctttagtgctatggcttggattactgcagccatttcagcctattgcagacagaaatgaaaaatgaaaggaggcaaaacagttctctgagaaccaagcttgaaggagagtgctgaacacaaagtgtaattcatgtacagtcctaatttttgatagaatttatattcttccatgttaataaaacacatatagccaggccttttttttgtaaattgattccatagtgaaaaagaatcttgaaaagtggatttatttatttggccttgatttctgggcccgtattatcagaagcaatcccacatttcatgtttatggagctttacaatattcagagcttctttcaccctagatcatctcattgcatcctcatacaacaaccagtaagatcagcagaactggtagatttttttcaccattttacaaaaatcggtctaatagaatttaattgaaacacttaactatttgcagacaaaaagaccaggagtatgaggttcttgcctatgtcaggattattaggaatttctttatttttgcttaagtattgttttgcttttgttattctctattcttttcctccttttctccctccctccctccctgcttccctccctcaccctctcccccttttctctatacctcccctccttcccctttctctcatcctttccagttttgaaattgaatttacctctaggccactttcctcctttgatcgcctactttttctgctctcacaggcaagtttctgacttgcctgtatctactttaaaatagtcctctattcattggaaaatgtagtgccacatttaacccttttttggatttacacaagggagcttccaaagtttcttcatatattctatttttaatttatttgtttcactaggtatgtattgataatttactgtatgccagcccttatgttaggagctgccctcaagtatctaatagtccagcagatatttgagtgagcaatccatattctgtttatcgtgaattaataattttgcttagctacagtgcactgggtgagtattgattccctcttccccagtctctcccttcccatgctttgatctcagtaataatgaaattcattcacatcaaatataccctggaagagaacatcaaagccctaaatataataattagtcctggattttgaaatcactggtggaggggaagcctgtatagagaatataggtagttacattgtcacccctatgggcatgatttatgttttaagattctgttgtttcaagttttttaacagagttgaaaatctaattttaatctgcatattaatttcattaggctggggaataattgatgtacacaagtcaaacctgcttaaataacctaacttttaatctggaaaattaattatcatcggaacatggctcagaattagaagagtgacccttgctattggcagtaattgttcaattaattggaatgatcaggctactgaaaatgtgactggaagagaggagaagaagagagaggtgggaatatagaaggaaaaggtagattagttaaaataggtttataaaacctactgaaaagaggaaactgtgtttctaggttcattatgaaacattctttaaatgcctactcataatatctatcaactgtttttctttctgtgttctatggttcttgctttaaaaaatgttacatgtgaattaaacaaaatgtattgagacacattaatctataccaggatgtgtgcacttggcaacactgccatcacaggctttgttcgccaggctgaggacttagtgttcccattttatgtatggacaacttcagtaccctctgttgttctctccagatccaagggaatcagtgcagcccatgtaaaaaaaaaatatgtttttgagagaaatgtgttaaagggaaacatttacagtctgcatggcaatcctcaaagcctcccatcctgctgagatacggacacacatgaaacagtgccaccctatcagttgcactatagctgaaaatacaagagcagggtgaaaaaaaagtatgaaaaacctgttattaaggcctatgtttgccaaattacttatttgcatcaggaaggcatttagtcttggtgtgtatcttttggtattggagatgtgtttaagacgctgaaacaacataaatgttttacagatattttagctctcatcattttggtatggctactgaagatatagctacacaccatctgctgactgacatggtccttacttggctcaattcagggaagccatcatcacagcccactcgtctattaacctggctccagctccgggaggccaaagagatactacactctgtccatactttgccctcggtgccaggggcaagccaggccactattgcttcttctgactgtaacagagaataacaatttatattgctcccaagcctttgttcgggggaaaaaacgttttctggcacacctttgggtcttgcggttatttccatatattcaacataactggttgcactaatgcattctttacttgcctctctaaagtctgtgtggaggtcttaatatgccctgagaagggcagctgatcattaacatctgtggctgtaacaattccccaatatgttatacagatgtggtgtttagggttcaaatgttttattcttgtcagtgatatttcaacctccaaagaattatttcctccttaataatgtgagtacattggtaaaaaggagtattagattttgctcctggatccacctactctctgaatgtagattcctcattccttatccaaaatattatcattatactataatgatactaactgataagaattttttttttttattgagatggagtctcgctatgtcacccaggctggagtgcggtggtgcagtctcggctcactgcagcctctgcctcccaggttcaagtgattctcctgcctcagcctcctgagtagctgggactacaggtgcccaccaccatgcccggctaatttttttttgtatttttggtagagacagggtttcactgtgttagccaggatgctcttgatctcctgacctcaggatccgcctgcctcagcctcccaaagtgctgggattacaggcatgagccaccatgaatttcttaaataaaaggttcagtattcactgagaagaaccaaacattgaactgcaagagaaatagacatgattatacagaggaaagatattagagacagattgattatttcattaactaaaaagttgttatttttctgaaaaaacatagatatgccaaacatacatttcttttaagagaaatcaacacataaaaggtcagaagacttaaagcatcttttattttgtactcatgtcaagtaatttctcagtaactatgcagggaatgcatgacatctttttaactcattcatgcattaacgacaatagcagacatttatccagtgcctgttaaatccagaacacagtgattgctgcctttatttagtgcctctcatgtgtcaagagcgctatggtaccttcttccagggcactagtgagcatcttccagatcagtcaaagtaggttggttccttggcatacatctacttagtctcctctgaacagggatttcgtgggttgggacaaatccaatttctattattcatatgaatcactgcagagacataggggtgaaactgtatccttttggtggacctgcctgtgttgggtgacatgctcacatttttccacatttgataaaaatcaagcctcttctgcctactcaacactggataaaatgacagtgtcatacacagagaacagaacactcctttggttgcttcagcattctttttttggcctcatttttctccctctttactgagtttttgagtccaaatttagtggtgatgactaagaaattgccaggatgtgacagagcattcagttcattgagtccttccttgccatttttcaatagttgtaacaattgccaagattttctcctgatgttataggtgccacgttataggtgccagatactaaattacacttgcagaatctgtccatgcagtgacagcctcattttacatacagctgatttcatgatatggtattaaggaaaatccctgcagactttttactagttgataattctgagtcctagaatttccaatatttaaatctgaatctctgaaattcaaatcacataaacaataatcaagcggtctgccatgtgctaacgtgtcatttttgttgggggaaggtagattggggaaaaaataagacaagttccctaccatctggagctaatcatacagttgtatgagtcacagggccatgctagagatgtagatagagtttatgggagcacagataacaggtgtaatcagttctgattgggagagattatatgtgattctggaaacagtcatatttgagctaggccttggagggttagaggaaagccagtaggtagagaaacaaaggaatgacattctaagcaaaggaaatgaatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaaggaaatgtggagacttctagtcaaatttcttggtactttcttggctttctctatgttgagaaatcctacaaagaggagttttcacagcccataaatagaacattttggttcctaacatgtgacagttgccttagaagtacattgcttcttgagtaggttgaatttgtgtgaatcctctgaacatctatcgagtgtgcccctaggctgaaataaccccaaaagatacttcagttcgtgcattctgggagccagattgggaagatggggggagattaggcagattactgtgtgaaacactgtttgtagaatcccagaaaaaaggaaaggaaattgcttgagtgcttaaatttcagagaaaagctgccttgcctgaggaatatatccctctttgctgaagtgactgagagggcttcagatgttgctgctcagctagtgtgtattgcttaaaatggtatccaatatgaaaaataaaggaaggtagaaccatggagacattgtttttaaaagactagtgccccagaaagcttgcaatatttgtttgtatacatgtttttggtgatagtaccaagtgtttttcctgataacatctcagcaaattagcaaaaatctgatagtttaattggtgcctctatgacatgtagctcacttagcattttcctaataatcttccactccaagtaggccctttgctactctatggattacttatacattcaaatctactattcatttcatttagcttagaaattatcatttttaatggctgtttattgtacacatagacacgtgtacactcaaacacacaaaaggttttttgttgttgttggtttttttgtttgtttgtttgtttccttgaaatggtctattgagggcaggagcccttcatttgaaaaatccagtctaaagtaaaaatggccaaatgcatgacagaaaaccatattcctgagttcaaagtccactgggctgctctatcgtgtctgctagtaaaattgctgtaaattccttgcttttgtattgatttgcatgtaaatgttactgtaaggcaaggatggggtgaggggggaatttttctttctgtctcaagtcaaggtccaatgatccaaaaaaaatcaatttggtttacctaaaagtaaaaggtaggctttctttgtagcattcttttagaaatataggcagaaagcattgtaacacagatttcagcctgaggcaattgacaaccatagtgtataataactcaagaatccatgaaaattaagtacaaggaccgaatgtttattttctcatattgaaccctgaagggaacaaagctccatgtgtcagttttatgcttgtcttttcaatccttggctcttgtagttgtccaatatatttcacttatgtggcttgttctaatgttcccattacctattacaaagagagctaatcattgatcaatagcactttcacttatgactttttctaaagcatcatgtgaaatgttatatgtagtctgatggtttccaatgatgatagtttatgctattaaaatagagcaccagtcacacgagcttttacaaagtatgtcttaatctcctaaaaggcaataccacatgattctacaggaaattcatagctataaacactgaacttttgtttatttacttttgttgcaggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaaggtacatttgatattgtgggaactatggattatgctactaaatatacttatttatttattaaatttcaatagttttgggggtacaggtggtttttggttacatagacaagctatttagtggtgatttctgaaattttggtgcactcatcacccaagcagtatacactgtacccagtatgtagtgttttatccctcaccccactctcaaccttccccccaaccaagttcccaaagtccattatatcatgcttatgctttatgtcttcatagcttagctcccacttaagtgagaacatacaatatttggctttccattcctgagttacctcacttcgaataatggcgtccagctccatccaagttgctgcaaaagatatcatatcatttctttttatggctgagtagtattccatggtgtatatatataccacatttttttatccactcgttgattgatgggcacttaagttggttccatattttggccattgtgaattgcgctgctataaacatacctgtgcagttgtgtttttcatatgatgacttattttcctttcagtagctagccaggagtgagattgctggatccaatgctacttttagttctttaaggattctccatactgttttccatagtggttgtactgatttacattctcgccagcagtgtaaaagtgttccctttcaccacatccatgccaacatctgttgttttttgacattttaattatagccattcttgcagcagtaaggtggtatctcattgtggttttaatttgcatttccctgatgattagtgatgttgaacatttagaaatagtaatttaaagcagtccttaataatacttttgaaaatgaaacagttgttccacattaagacatttatttaaaaaacttacattttgtaacactcaaaaacatttgctctcctgattttaatttttccatagtgcatgtacatatagtgacactttacttatgtggaagtaacttacatgctaactcaggacagccaagatccccaaattatgctaaaatgttgcctgggcagaaacataggtgttaaaaatgtgtatacacagccgggcacggtggctcacgcctgtaatcccagcactttggggaggccgaggcgggcggatcacgaggtccggagaatggcgtgaacctgggaggcggagcttacagcgagctgagatcgtgccactggactccagcctgggcggcagagtgagactccgtttcaaaaaacaaaagaaaaaaaaaatgtgtgtacacttaacacttaccagaaagctccttgggtcctctctaagggcccaacatattatttcagcaaattttgcttatagttttcccatcattattagcagattaatagcaaattagaaagggtgagggacaagaataggctatggaagatagggaggtaagaaatagtgagatatggtagagaagagacagaaaatgcgggcaaagcagaggaagacttcaaagagattactagcctgaggtaagagtaggggtttagagtagaggcagacactgtgcaattcgaataagcacagcactgtgttttacagcacattttttggagccagactacctaaattcaaggcccaacttcactttttgctaactggatggtcttgaacaggttatttacctgtgtatgcctcaagttcatctgtataatatggataagagtacttataagattctcatagggactaaatgggataatgcatgcaaagaacttagagtagtatctaatgttatgtgttccataactataagctattatgtttatttatagcacaataataaattttaccatttactgtaccaagaattatccaatacttagactcttgaagtgtttcattttaaagtatgatagaaatcagtgttttaaaatattttaaattttaatatttgccttgtacagtatgctatagatcatatttaaacttctaagaggtttattaaatgcattttttattaatcctctcttacataaccatatgtggttgaagttaggcattaaaattctttacacactactacaccaaggctagatttttgcttaatctgaacctgtccactctctactgagtccttgaaagcagtgtttttcatgtctggcttaaggcacagaagcctagtaaccaaaagaaaagttgaggaccagtgtggtaggcccatttttttaatgtattttttttctctttttccttttctgaatttaatttataattgacacaaaaattgtatatatttattatgaacaaggtattttgaaatatgtatacattgtggaatagctaaatcaagctaattaacatatgcattacctcacatacttatcatttaggtgtgtggaatagaacacctacaaactattcttagaaattttcacaattggtatgcccatttgaaggccttttacaccatctttgtgtgcttttcagtggccatgtacaaggagccatcactgcacgatctcacggagttctcccgatctggaagcgggaccccaaccaagagcagaagtgtctctggcgtgctgaacggaggcaaatccatgagccacaatgaatcaacgta

SEQ ID NO: 5899 - DNA, 571258 bp, human; identical to SEQ ID NO: 5898

SEQ ID NO: 5900 - DNA, 571258 bp, human; identical to SEQ ID NO: 5898

SEQ ID NO: 5901 - DNA, 571258 bp, human; identical to SEQ ID NO: 5898

SEQ ID NO: 5902 - DNA, 572052 bp, human
gagagttctttggaaggagagcgcgagcgagggagcgggcgagctccgagggggtgtgggtgtagggagagagagaaagagagcaggtaagggccatcgtctcccactcctccgccggcgagcaactccggccccctttttggcaaaataataggaacctggaaatggattaaatagaaagaaagaaaagaggcgaccctctcctccccattccccgcgggcgagaagctgcgcgactctgcggtgtaacaggctcacacgttgctcatcacatgttcaaacatttccctttcagggaggcttgttatttttaagtgaatatttttatctttgttttgattttttaaaaagccttcctcggggttttattttgatcgagttggcggcccgcagcggattgggagaggcgggggaaagcagcctgccagtgcgcgggcagcccacccaggcaactcccagcgagcggcccgcgcggagcccagggaggccggcagtgaagccggggagtcccggccgctcctctcggccgccccgggggttgcgagcgtggctctccgcaggcgggcagaagctgagggcgcggggcgcggaggaagcgccgcgccgctttgtctcttcacttcttgagcgcggcgagcggctcctcccgcggccggccgctcgggatcgcggcggcggcggcggcgacggcggctcctccttcacccctttcctttcctccccactctctcgtaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggtaagcccgcccgccgagtccgcctgctttcctttccttcgtttccctcgccccctcgcgtgcgcgccgccctccggcggctccttgcctccttcccggagcctaagctgcccatgacctctgcgaccccgggagaaaagggggggcagaggtcgctagggggtggatctaggtttgcaccactttccctccttcctcgcggaattgtcgaccctcgagtgcctccagcctcctccacttcccctctggacgcacggtggtggcgctgcgggcagacgaagctgctgcagcctggagcgccgggaaccgcgctgtctgctgacagccggccgcctgtctgtatgagtgcatgtgtgtgcgtgtgcgcgagtgtgcatatgtgtgctgcgcgcgtgcaacatggtgacatactcaggaatctgccctgctgtcagaacccaagcttgaacccaccttcagccccctctccccgcccccaatgcaaacaaagagcctggtcgagacgcagaacccctcccccctcctttcccaccacctccttccccccccccgccacccgacacctcctaatcctaaactccttatccaccccaaccctccgggaaggcaggagtttgcacccttcgacacgccgcgtgcaaaggtgagcaaccctggtgccctggcgccgcccgcgctgcgctttggcagcgcagcctcgccaagccccaggagaacaaaggctgatgtccccttgtcactagtgcccagcgtgagtgggcctccgcgggagggggcagtcctcttcctctgtttgctggggttcagccaccgcgcccggggcacccgaccactggtccccctggagtgcgcgcctctgcccagggcctcccatcggcgggttggggaggcgcagcaaagcggtgctcaggctggggagaactaaggcaaaggcaggggacgcccccccaccctttgccggttctagccgttgcctttctcaggaccgggattagctccagaatgtaaactggagacagcagccttggagaccggggtgcggagaggcacagagagggaatatggaagagcagtggggaacagcaggtgccttaggtgcaagtgtccgaatggccacggagcagacgctggagtgggctggactagccctgagggccccaagcacactggaccgcagcgacccacgccgagtccccactgcagaagtgaggttgcagcgcagggagtcccagcttttgttcatgggggccccagttccttcctgagccctcaggcccccttcactcccactcctttctctattccttgttctcctctcctccttctcgcctctccccatctctcagagctttctttcccgggagattctagggcagcaccagccctcccccgcggaaagttgtcaaagtcttcagctcaaggcctttatccttgtttctaagtggagccatttctcccccaaataggcgaaagggtgactgaaggttccggaagtttgtggaggggttagatccgttgtcatacgggtcattgttgcccccggtctggctcaaggctagcattcaatcccaagtgaaagagtaactttggaaagtagaacgacagctgtaggtttccagagctcccctaattgttgagtctcaaacaggcatttatatgataaaggaaaatgacttcagggtcattaaatcgttttgttttccactgagggcccagagaagtaaatgtaattaaagaatgtagcaccagattgatctaggcacgtcattcccctgttgaatctgggagtatttctcgtttgtttctggaactttggttcctgatttccatcaggtggttacttcaggtttatttcaggctaccgttgggagaccctgaaaccaaattcattcacagaaaatgagtttctgttctgtttataatttgcagttgtccagaatggattaacgcatctggaaacaggacaggtttctgtaattcaataatacaaatttgtactaggcatgtgtcataacattttcttgtgttgactcaccacatttgaaaccacatacctctgtaggaattgagtaattagcacttgaaattatggctgtaattagaataaattaattttacaaggcaacttttaagaagggagtttacttccccgagaagatgggaagcttttggctgctaagagcaagattgccatttcagcctttctgttcgttgttgaatttagagcattttcaaaatattaagtgtgtagtagccattagtattttcttctttcaagtatatgaaaagtcttatgtgaccaaattttaaagactactttttatattagagatgaaaggtacaaggtctacttatcttttaatcaatagagtttatatatgttgaccatatttctgaagagttttccttacttacaaatttcctatatataggtcatctttaatttttttaagctgaaaaactaattggcatattctttgtaacatagcaagatataggatcaagcatttcatagataccttgaatatacacacatttaattttgaacaatggtgtgacagatgattggatgaaatcaaataatttagtaacagtttgaatgaatttcataatctgttttcagagtctactgctcatttaaattcagcctcccacccccatcagttagggctcatacccacagtgtatcataactacatcaattattatagagtacagtgtttccagagcttttaaagcacaggtagtaggtttccagtaaattattttgtgctgctgaatgaaatatggccttaagagtacataaattgctgattgtctttttaaatgacattttcttcaactcactgaggttaagaccagtgatggacactgatctttttcataaccttttcaaaaatgtagccagacaagataggctgttctgtttggaaagggggcggggaccttgattctgtttgaaactattaaaaaggcctcttgtgcagccagtcgccttttgtgtatttatttatgctttgtataaactttaaaattggcagatgtgtatatagtttgagtcacgcggctcttggaccggaggatctgtttccatttcagggaagaagaaagcataatatttgtttgttcaagcagatattctcttagctttgactcactcttctctaccttgtcacataagatcttttcagcagtcttctgttggaaaagcactcagttaaggctgtttctggtttgttgcaacagttttcctgtggcatcggaaatcttgtaggctgctatagataaaaccaaatcttttttggattaagtaaaaatgctagctaattctcgctttcaaaactgtctttaggtttgtggctacatgtttggagttgggtgtgttcttttcaacaaccctttcctttgtgcttagcttaacagccaccatatccaggcaagtttcaaggctctgtgggctgtgggttctcttggtgagacagcactgttgtcaggctgggctcatgctggctgctggacaatggaggacaattccatgcatagcccaagaagccagccacttgtacagctgctgttgtaatgggtagtagtggccccatgcatttacaccacagttcgttttttgttcacttcctggccctttccaatagtctttctatcctatcctactgaagaaggacaggtcactgtggtcatgcagccagcatatctaggcttgagtcctgaatgccttccaaaagatcatcttgatcattgtggtttactataataggtttcatcaagtgtctttctcagacttgggccaggcaaaagcagatgtttagaggtattttaccgacaagaaattatgaggttggtgacctcttattaagaagtaacagtgatcatctgtctattactcatgtagggacttgtttttttcactctgacatcatggtcccatggttttacatacagtgtcataagccacacggtcttttctgtgctgaaggaggtgatcatagccttgctaaggaggtgtgaccagggagatctctaatcagaaatattggtctgttcttggggataggtggagaaaatgagtgcacattatacccaaatcctcttcataattatttgtagcagcgtgtagcttctttattgacaaaggctaaagctagaagggggagcaagttgaggcatgggttaggggtactgtatcttttctctagcttagtactgcttcctctaagcctcttttcagcacagttcaaataatttaaagggcttagtatgtgtcctaggtctggagatgtgggtgaggttggagtgggaatggatgttgaattggggcctgggtaagaagcagagggtgagctgtggggcgaaggaaggagttgaggtctatgcccacagcagggagattttatgggtggctttgaggacagggtcaggactggggagagaattggaatcagggagagaatttgaatcagaattggataagccagagggctgatttgtaaggcggtaagtaaggatatgaaacagcgttccaggtctctttgcagctgtgctgttttatgtccaaatcaacttcttattctgggaattacaatcaacatagaacaaccagaatgtgttgcagttcttcaaatatatccaataaaaaggctttctagtgtctgcttcagtatgacttatatttttggagttgagaaatttgaaaagaatggacaataattgtcaagattaagcaattgaaggaggggggaaaaaccatgtgcattagagtagatgaaggggatcctacatgtctattaccttgctcagctaaacattatctttgaaatgtgaagactaggcacataatatagttttagcaattagtacagaacacaaatgtctgcataactcattttctgcagtcactgatttatgtttccctatcaagaagacacatcatcaccatgatatatcagcacaggctgaagagtggatttcaggctcattgtcctgtgtaatgtgggtcatcttagttagttttcatcaacttgaaatgtaggttatctatttgtaatataccagctctacaaacttagttgaatcttatttctgacattttttaacatggcattttatcacttttttgaatgtcatatattgatgaaacatttcctaagagtgtgggtttcccggtaaatgcattaatttcctaaagaagtgaaataatatttagtagtcattatgaccaccactccaggccttagatccgatttctccttgaattggatggccatttttttcctttaaagcagtgttttccagagtattaattctgaaaatggtgggggaggggttattagaaaagaaataaattcttgattcttagggcacaatggatatatgaaggactattaagggatctgagttgtaataaatattaagtctaaattacaatgactgtttattgtgattactgtaaagcagttctcatggctgatcttgcctctgccctttgaaattacttttagcattgattttcaaatagaaatagtactagtgtcacgggctaatgaccttccccacaggcaaaggcttctgctggtgtagggttgtggttgacattctagggagtacagtagggctgtccagagctaagttgcttgcttggcctgcctgcagagacatcagatttggtctggacaatcactctttggcctaaaggaatccctagttgtatatgtctgtcctttattttgtggttcctgtaagtagggctgggaagaaagaaaagaatcttctggtgaaaggcaggccagtcaaaggccaaattagaaaagaaaaacagtaaaactcaatttcctttttttgtaattgaaatttacctgtagtaacatgtacagatcttaagtgtgcatctcaatgatttttgagaaatatttacatccgtaaaatcaacaccaaagtcaagatacagaacattcttgtcaccccagaaagttctttcatgcccttttctagtcattcccctcacctaaagacaactcttattttattctttttttttttttttttttttttttgaggtagggtctcaatctgtcacccagactggagtgcagtggcacaatctccgctcactgcaacctccgcctcccaggttcaagtgattctcctgccccagccttcctagtagctgggattacaggcacacgccaccaccgcccggccaattttttgtatttttagtagagatggggtttcaccatgttggccaagctggtcttgaactcctgacctcaaacgatccacccgcctcggcctcccaaagtgctgggattacaggcgtgagccactgcacctggcctcctatttttatttctatcatcatctattagtttttcctgtatgcactctttggtttctgacacacctagccacctccccatccaacactcttcatcccctgttgataacccttcttgtcttgtcctctggtttcttggaagactcccaccgtgccccacactggggcattcaatagaatcttagacatggttagtcttctaggagtagttgttgaatgacctgggaaagatagggaaatcctttaagcagaggtatgtttcattcatcctttaatagcaaataacaataatgaacattgctgtctttataatagtagcctctaaattattgagcagttactatttactaggcaaacattatttttacatatatctaatttaatcctgacagccaaatgaagtacagtagctcttagtacatacagactttagagatgagaaaattgaagttcatggagatcatgtagcttatatgaagtcacaccactagtggtttgcaaattactaacacggtgcttggccttgtagtaatcaataaatgatgaatgcatatgccatgcacctatgaaaactcatcggtcctatgccctgctcacttcctgttttgttgtcatatcagaaggcactgtgatagagaaagactttttcagagcctcctggtggcttaatctgacaaatacctagggatatttacattctatctaaagattgcctggggtagagctttcactcaaagaattcaatagttaatggttgactttccaacacctagatacgtggcagaaataattttgactggtgtcctaaaaatagtattttctgagcactgactataggccagggagttgacatgaaatatctcatgaaatcttcataacaatgtatggacattcaatgtatggagaatgaatatccacactagtcttcaatgtgacagatgaagaaacagaccgaggccatccttaggtcactcagctaacaagatggtgaagtgaggatttgaccagatttcattgactccaaatctacctcctaaccactaaccactatatcatactcccttcctaggcagcacagctgagtctttctaatgcaggtttgcacaaagacgaaattacttccattcaccaaattggacataattaggaggagtgtgcctatactaaatacatggttgctccagggctgtggtctttgttcagttaaacaaaatctgaacattttttgagtgacttttctctatcaggtgctgtgccggggtaccctttccttcttctctggcctgggacattctgactttaaactttccgatgtgcatctcacttcacttggccatcctcttgaaccactgctacaggacattggccaggtgactgtgtctttcattggccaggtgactttggctttcatattggtttaaaaacaatggtactttcttttgcaactgcatctgagaccttgtttcacctgtgtcttcaagattatacatcctcttaattcactgttgagtaaaaactccacttgtttattttagttttcattacatggtatatgctttcagtctgtctcccatcagaatcatatgtctcatttcccttctctttgtctctcaaccctaccccgttcttcctccgactctccttctttccctccctccttttcttgttaacaaatgtcagtggtttttattaaccgaatggggctcctcagggtgtgctgagctcattgaaagattttcatttctggattttttcctttgatagctatattaatcgtgatgaaagaaatccaccccccacaacaaagcgtagctccacagaagaggtttttcactacttacgtaactcattttaaatggaaaaataaaaaagtgcaagctttattttgtatactatttatgctgccttcagttagataatatttccaaaaatatatcttgttaacagagacacaacgccttgaacaagcatattaattacagttctcgaagttgggaatcatgtagtatttatctgtattgtagaactgttgctcaatggtaataattaacagtgatgggtctattgcatggctataggtaaatttaataacaaacatgaaacccagttctcaaaacttgctccaaataatgtaggtagcatttgttactgttctggagttgagggttagtaaatagctagggttcttaaaatatttatctagctcttaaaagtagaagtaaacaacctaaagaagacaggctgagtgcacttcttgaatatgcccatagatattttcagaaacttctttcaatggtgactttgaaagtattgagaattgacctgcttattttgcctttgattctctgtgtgtatgcttgcctctccccttggggggtttattgaacattaaggcttccaagagctcttgaatttgtgagtgattttcggagctctgggaacaatgtgagccattctcttggaaacaggacaaggtgctcctagatgctctcattccggggaacatttgtttttcggctagctgggaaccgacgatcgcgctgaaaggtctggtcaaccagcctccctcagttcctgtgtatctggcaggcaggtttattacaaaccttagtgtgctcattagcctcgtgatgtggcagctgcctaaaaaagaaacacggaaaagttgtgtcaccgaaggtgaaacttggcaaagagctgcccggcgccggctccgggcatgacaaagcgccttcctggcggcggcagcggcggtgggcagtgggggtttctgtttgcttgtcctcgatacccacggcccagtcgactcacggggaggcgtcgcaaagggaaccgcgggcccgggccagggctccgtggctggcggtgcgggtggtcgcagtccgggggaagatactgcgcgctccggtgcagcccgcggcctcgcagtctagaccgcgggcacgttgcagcctgtggggaagcagcgttaagatggtggcggtcagagcagcgctggtggtggccgggcggggctcagggaggcgcgccctcctcccttagcgacacctatcaaggctttcttgctttccgtacacctgacccacccactagacacctcaaaggcaggcatagaaggccaagagccttgaagtcagggcttgaccaacacaagagctttgctttctctgtcttcttgttaatgctaatttgactttagctgctcaaaaaccgaagatgcatcttgagcaggacgctcacaggcagatttgaatttatgtgtgtgtttttatattgcttatgttttattacattgatttttttcagattacaaaataatgcatgtttaccggagacaatttggaacatcataaaagcgtagagaagaaaatatcacccaaggttccactaccaagttaactttttgaggctttgcttctagtcctttttctctgcatattataatacatagacatggctaattatctttaagtgtgtatgtgggatcaggcacatacacgataacttcctttttttccctcaacgtcttagaatgttattttatgtcgttaaataatttgcaccatcattttcagtgtgtatactaggtgtggacttaggggtaaccaaggagagatggtgatttgtgcctggggtgtgaacatttttcctgcacctccttgagatccttctcactggacaccacaagcatgattagtattttgtaaaagtacatatatgaatatgtgcccatatggggctatgtatatgtgtgtataaatctgtaaataccaaattaaacacacatagacaactatgcacatatgtaaatagatacacaacaaatatgctaagaataaatcttgaaagaatatacaccaaaaggaatctctgggtggttggcttatagaaatttatagtgtttagtcatattttctatttttatctatagtggaaatacataattatattaatgatataataataaaaataatactaatgaaatattacttattgattgtcttcaaactgagttttctgctccctcattccttgatctaccgtgacctacttattatttttatattatatgatgcttcaagtccaagctaaatctccatcctccatgaagcctttcttccgccctcccagcaggcactgactgcttacttctgtacagggcttctatgtcacccatctggcaatctccatgggctactttgggtgtatctcatggttaacttctcatctgcttatgtcttatctctctgaatagactggaatgtcttcaaggatccttttcacaaagcaagtgctcactaaatgtgttacgtaatgacaatgcttatcatccatcgtaggtttctgtaaatgctcctttacctttgaaactctataccaaaagcccttagactgacagcaataatcctgctggatttaattttgctaatttaatttaggatacaattgctacttcataatgggctatctacgtagaatttggtcaatgatgatactgataatattactgaaatagtagtgattttcatattgatttttcaagttagaggactcttgatagagggtttcttggtggtagaaataaatctacagattcacacatgcattggacagtcataccccaacttaagtgatttcagttattttaatgcatgtgtaaattaattcatctgttaatttactcgataaatatgtattgaaccttctatgtgccatctgctttcttagacactgagaatacagcagtgagcggaacagataactatccctgccttcatggataatacaagcatattttgcaagttttcttagggaaacagactttcagtgcatgaagcactctgtttcatgttcgtggtatgtcaagcagtgagtgatctggtgcccatcatagccatcaggctctggccaagccaaattactaatgagtcaagctggatggagtcatacatgggttgcttatctgtggttcaggaaccaccgaagctgtggttcctggaccagcttgggcatcagcatcacgtctaaccacatatacccccgaccatgagaatttgattcagtatatctgggcatgagccttagaaagccacattttttattaagctcctcaagtggttctaatgcacagctggtttagggacctactgcctctgggcagtgtttctcaagcttgcctaaagaatcacctgtagggtttgtttgttttttctaaacaaaacaaaacaaaaaccctcccgctgacctactgaattagaattttaggaaaagagatggtaatctgacttgtaagcaggtgtcctggtgattcttatcatcaggctagttggggaaacattgtcctagagacaatcacaggactcccctagaaattatgtataaatgtcaatttttctggtgagcaggctccattgctttgaacagattctcaaaggagtcatccactccaaaaatattacatgaggtggagccctgatgtctaggaccagcattgttgtcaactgtatgttttgagttctcagtgtcctcatgggttgaattaagcaaccttaaagaccttctcggccctattcatcttccacatataaatgttctgcttggaagccttctttctctctttttgctgcttttttctatcttattgccagtcctgcctcaattgtttcccttgatggtctccctttaggagaaagtagggaagcaggagaatttcaaagcctcggctctcgcagagagggcggggctgggagggagcttcgggcatgccattcagagatggcaatcctagcacagctgttagaatagcagaggtcagtgtccaaatattttgacccttatgatagcttgaacctcagtggatcttaaactggtgggataagggggtgggagtgggacttccaagacatttctctgccagtctagagcagggtgacacagggtggacaaggtaattccgcttttccttggacataatttttctgcctgtatctggcagcaggtggtgatgggaggtggaagcaggagtgtgagtgttgggctgggcctaggtgcacccccaccccttctcatccttgaggcaccaagcagtgtctctgtaattggttcatgaccaatcaagtgcattgacctattactgctagttactttgagttataaatggtttttatttcctctgtggaattgggggttcaggctgtataggatgacctgatttgtatcacaagagcctttgggactttgacagatttcaccgtttaaaacacaccgagcttcctccctccaccccactggacataaaagcaacctttgaatttctggcacaaagagcatgtctttaaagggcagcatgcagaaaaagggaggaaaaagaagtaaggcagttcatcttcttttctgaggccattgtctccaaacaagtgacaaaactgaataccttgaaaaatcttgtattgatttttagtgcagaggcatctccccaggatctgaaaatcctggcagaagataataaacttatttccctgcctttgagccagagttgagttgcttgttttacatggctggaagaaatgagagtagttgctctgctgagagtgagatttggttcagagtgcatctctcttgaccatattgtatataggggagactcaatttataaaaactatatatacaaatctaactcaaatgccgaatgtggaggtagttacaatattgaaagagttattgttttatgaaaagtttttcttttaatagcatcatctttagtgtactcgcacgtttctttgggcatgaaggactacttgattaaaaagaaagaaatcaaaaccaagcctagaggcctcttgttgaggcatttgtttcctgctattctaattagaaactgttgctcagagtggctgtcttgcttctcggattattatcttttttattttaattattttaaatatgtttactgtggcaaaatatacaacataaaactgaccattttatagtcaattctatggtatccagttctatggtattaagtatattcacattgttctgcagccttaatcaccatgctccacagatccttaattacaggctataatggctggaagggaccttcatcatcatttggtctaaccttcccactacagagtagaagaattaggcccacagagaggcaatgacttgcccaaggtcatagaacaagttagtggcaggggcctagcccagtacatttccacattgacacagtaacagattcaggcaggtggcctctgttactctactgatagcagaatcaaggattgacataaatgtttagggtatttttctgttttttttttcttttatcaagcaagcaaccaattattatggtttagagccagaaggtccttcagacactgtctagttcaatttccttatttaaaataattggccgtatttgtgatttctaaatccaagttgaactacagaaagatgctaacattcttatttctaaaatacaggacaattcttccccagccttcctttcactgactccatggcattctttggttgaaaccaggtcctttgtgggtggctgttattaataagcttttcttgggatgtttacagtgactgctgtgacctaaataagtttgcttgtattgttttccccacaaaggcaagaacagcttttaaaactatgttcatccctctcatcacaatgtatttattcatgactaaaagaactgaagtattgcattttctcacatttggggcctttgtgtaccccaatcatgttttcttggagtagagcttcaggacaatacaccatgtaacattataacatgatccctcttgaaaattttatttttacttttaattgtggtaaaatacacataacataaaatttaccatcttaaccatttttatgtgtacagatcagtagtgttaagtatttaactgaagtatataatctgaagactgcttgtgcaaccagtcttcagaacgttatctcacaaaagtgaaaccgtgtacacattaaacaattccccatttccccattaccccagtcccttgcaacctccattctactttgtctctatgggtttgactactttagctaccttgtataagtggaactatagttatttgtcattttgtgactgactgatttcatttagcattgctataaagagacccctgagattgggtaatttataaggaaaagatgagccttgaggctcatccatgttgtagtgtgtgtgggaatttctttcctttttcaggctgaataatattacattgtatatatagaccacatttggcttatccattcgtccaaggagggaaacttgggttgctttcatcttctgactcttgtgaataatgctgctatgaacttgggtgtagatcttttttcaattgatgggataaattgttttaaaatactcaatttattttctcagtctttagtctaagattattaaaataacatggtgaataaaataaaggaagaatgcaaatttttagggtactggagaattgaggcatcaatccaaatgacttgcaagtttgagaaccatgagtagagtaaataggacttttttaggtcctcttgggtctattatgttacttttttatagtgattttgtgtgtgtgtgtgtgtgtgtgtgtggaaacaatgaacttcctctgtgatagcctctatgatccttcatccttgcatttttgccctttaccatttatttccattcctgtttatatgtgtcccccactatactgtaaacttgttgagtgcagggaccaagttattaatttctgaatagtacttaggacaaagcctggctcataaggcaaatgcaataaatgtttgaagagaaatttgactcactctgtcatttggaaaaatttaacttcacagttagccttggaataattcaacatttttatttgtttttatctgcttcttttatatttgaaacatagctcatgtttaggagcacaaattagttttaaatatgaagcaatcaagttttttttgttttcaactctttttgggcagtgggagaaacatttgttgaatacttggcatcaaatagaggaaatatccaggccttgactttagttttgatttgagtaagtccctctgaatttccactgtgaattctgtctcctccctgccacctctgaagtgctgtgtgtggctttgagttgtgcagctagtgctgtgagtgctgtttctgtatcagggcacagatttcccactccatgtattggctcctaagctttgttttcatgccccctaacttctcctgaactgtctccaacctctttataatgttccagaaatagaaatctcccaaagggattgtcatttgtaataaacgccctcaatccttaatatattatttcccattggtgggcagaaagcctgcagatatatttattttcaggtgatagacaatactttagagacacatgcttaagaatctggactccattcattcaaagagcatcaagcattatggcaggcccaggcactggtgaaacaccaatgaggaagagtctctattcttgctcttacagagctgatagtgggagaaataaaaaggaagcagtgccttgactgggaaacacagagaactaaggaagctcataggagagggagctgacatagttgggtggtggtagcaagtgcgatcgttaacttgacacctgaaggatgagtaagaatttgtcagttgatgaagaggaataagagtgtcctggaaagtggggacagcacatgtagaagctaggtgatgagcaagaacatggcttacttagagaacggaaggaagtacattattcctagagtagtgagtcaccttagttacgtggatagtcctggcatatcctgaattatgccactctcatttcagtggacagtcccattgattccaatttttaagcagaaatattgaaaatgcagtttttctgtgcattaacaaggaggttccctggtaggaagaaatgcatgaaaaacaagtaggctcaatggtaacttaatgcacttgatgaaatgctgattgtgaacaaaacttcaggatactatcattataaatgaatgaaacccattagattttaagtagaagacttattttttttctgctaagattagaggcctcagggttttgttaattgtggactccatgatcagaaatccatatatgtgtctgcagccatgatttttttattagtaacaagaaagagggataacttcttaactattcagaatatgcattatttagcagtaagacacaactattccagaaagtggcttaatcaactttattcatatgaaagtacatagttttatggctattattagtaggccatgaatttttattaagtcaaaaagaacattgatatttaacagataatgccattcttggcagtgtagggtgtaatcaggcagaacacaactcatttctgacttccaactatatcactcatgttgactttctgctttgtctccagcagttgcatgaaagtaaatgtactgccacagatacttcccagatgttgccacacagaaatttcaggatagttccattcataccatttattcattcaaggaacacgtattgggtgttggctctctgtcaagcttgattgtaggtgttggaaaaatgtgaccaagctacagagtgtccctgcccttgcagggctcacagtgtagtggggaagacagacaagcaaatagtcaatggagacaaatacagtgtgaccagtgctgtaatagcagatgccctggaaactgtgcaagctcagaggagggcagctaacacagccttgaaggaccagggaatgctccctgaggagagagatcggctgggatcagaaaagtgaattaggacctggcctggcaaagaggaggacaaagagaatttcaagcagagagaacagctcatttgaagacaaagaagtgagaagaatggcaggaaggaagggagagagagagggaagggtattgcaaatgtaaatgtaaaagggcataactgtatgacatgcattatggctagagaggcatgaggtgtacctgaataggtaggcaggggctggcacacaaaggcattgaggtgtacttttgtgtatgaggatgaagagtttggatttcatttcaaatgcattggaaagcctttggagagtttcctgatgggaagccctgtgatctgatgtacatttttaaaaactctgtctggctaggaaggcagtgagaaagctgatgcggtgggtccaggctgagacttggtagagtaagaatgaagatggacaatgtctaaagatttgagagcactatccaggaattggggtagattgggttttgtgcaaataataacatgagtggtacaatgatatctcatttacttaagcgggagacaggagtcatgaatgatgactcttatgtttctgggatccagtcccatctctagcacttacaactgtgtgattgagcagtatcacttattctttgcatcttctttttttcatctcttacattttcccactgtgattgcagcctgattttcagtggtgattcataatgatcctaatatcctttgcttctaaggtacatagcagaccatttataaatattgcccaaataaatgaactggcattatgcagctacattcttatgcaggtatacttcctggttaggtgcagattagcctatttagtctttcttatctgtagcttattactgggaataatctaaagtggaaatcaaaccatagattgtgtgtgatataatggtcccctgtactggactgggccttaagaactcacatttttcccccttactttgctgttatcttgcctttatttagtgcaacagaaaatcacttatgtgctttatatcagtattcccatttgtaaaatgtctatgataatgccagatcctgactttagttttggggtgatattattaacaagataatagcttttaagcataatcatttagtgtttataatagacctttcctctaagaacttcctgatgtttgtcattggaggtggtgtaaggcagagaacagaagcccctgaagagctttttcagagaatctaggtcctaactctaccccacaccagcttcagtgggggcccattggtggacatgcacggtggactccggctgttatggaccttccctgctctgcatagtcttgtagcaatatggtcttctcatgtttcagaacatcaaatgtaaaagccaaaactacaactggcaagaactcacttagcagtaaaggggaaatgtataggaattggaactgctattgacaaaagttagattatatgatcaacatttcaaaggcacagagatttgcaataattgcatggggtataggtgttttctgaacaatagaaacaaaagccagtattatatagtgggttaaaagagacacttattatgctcaagtatacaaagtaacatgaacttctagctagtagaattttatggatttcatgatttgccataatgaagaaataaaaatattttaaaattttcctattgtttttgaaagcagttattgtgagtgtggttggcaagtattactatgtactcagcacccccttttcccatggatagctaaacgaattctgcattgttgggtctgatttcatgagttttgttccagtgcaaaacaaacttaatacaagtactttccaggtctggtttcatctgtatgtgaactagaactaaatcgtttacatgtgaggctaaaatgagagtcctcccaataaagtgtcctggaatgtgcatttgagtgttttctctaaagaagaagacagccatgttaagtcagaaatgaatcagcaaaagaaggaatgaaaaagattgttcattctgaaataacactcatggcttgtatgggaaaattttatttcaactttgaaaataaagatttttcatttaacattaattcaacaaatatttattgaatacctactatgtgccaggcagtgttctaggtataagtgatatagcaatgaataaaacaaagatctttgccctcctgggcttacattcgtgtgtgtgtgtgtatgtgtgtatgtgtgtgtgtgtagggacatacaataagcaatatatatataggtaaaaaagatatgttatctgctgacaagtgctatggaggaaaataaatctgggaatgtgtatgtatggtagtggtggtggtaaatggctgtagttttgagtatgatgatgaggtatggacttactgagaagatgatatttgagtaaaattctgagagaaagccatgcaggtgtcttggggaagagggttaccaacttttgcatgttgcctgggtaaaataaaagtgcacaagtataaaaatgtattacccacaagtcaggcagttagaggtgttttttattgaacaagggtaaagccctttctgcattcctgtgtaaattctgcaaggcagaatttcaaatgtagtctctggttatttgaatcttaaaagttcatgaacagctttttaaattgtactctctgaaatttctgtatatgcatacagatagcatttacatgtactaagttggtatgaacccatggatatacctgctttggtgttgaagctacttgatgatttgcaaattcaagcataccatattttcatttatgcaaaagaaagtattaactgttctgatgtctgggaagaatgagcacctctcaggaacataggttctgcttgagctactttagaccatttgactcctgaaagtaggagaaattatcagttagatagatcagcctctccagaggacctgcaaagtgcaagcaagaacagtgtggagccacttgcattgagtagtatgtgagtcaaagtcatggagaggagtggttgttgttcagtatttgctgtggattactgttaggactagtagatccatattctccctatttcctggtgttggtcattttgcattgctataaaggaattcctgagactggaagatttatacagaaaagaggtttatttagctcatggttctgtgggctgtgcaacaagtgtagtaccagcatttgctgctggcaaggcctcgggaagtttacaattatggtggaaggcaaagggaaagctgccttatcacatgatgagagggagtaaaagagagagggaggaggtgccaggcccttctcacgtgaactcacatctcacgtgaactcacagagagagaactcactcattaccatggggatggcaccaaggcattcatggggcatctgcccacatgacccaaacacctcccactaggccctcctctaacactggaggtcgcgtttcaacgtgagatttgtaggggacacacatccaaatcatttcactctctgaacagtgctctgtgtaactcttgccacttctaggtggataaggtggtgaagacccactaggtctggaagggcagagttgattctgtattgaggaggtcacagacctaatgtgaaaaattattgctccagcctcccttgtacaaaatttggacatgtgatacttttgacatgtttttggcgtgtcctgccagccaatggtgtgcaagtagacagagcaggggagtgaatccatgccaggacaattagctgttgtagtaaggggctgcagatttgcccttcccctttgtcttcagtgaagtgcccatctgttatataaatatttgaatgtggtggtgaggagggagggaactgtgtgtatttgtggaaagaagacaggaactgggtgcccttgagtgagcctcttaatctcaatgggtcacagttttgtgaaacgctacagtgagaatagtaacattaagcacccactaagcttgttggagtataaaaaagacatgatatgtgaaagcatttggttagcattatacatgtaaatgtacttttttaatgaatggacttgcttttccctagaaggcctttactggtagaatattgttcagctatcaaaaaacacggccttttatcaggaatttttcctaaattagcattattcacaattgaaactacatacttggtttctaagttttcatggcccagattattttattttgctaccttccccaccccatcccgagggaatatgtgaacaatttactattgacagataaaagataatgtgttgtgaaagtgacaggcccgaatcagcaggagagcctgcagttctcctgccttgctgtcattcagtgatgaaaatattacagaacgtttaatactatatgaactagaacaatacgcaatttcagaagaagccaccttatgacacttcaatttatttaacataaaagactgatggtcctattgaagttcaaagcttggaaaattttcaggaaggacaatttatactatttaggaaatgctctccctgagctttactgtttcatatttaatccagggtactacctaagattgcttataaagtcccttttgctgtgtggaccttcaacatctcatagtaaagagagaatatggtgtagtggttaagcatgcagagcttgtgcctttgttttcccatctgtaaaatggggataagagtagtacctacctcactgggttgttgtgtgtattaaatcagttaatatatacaacacatataatagtgacagacacagagtaagctctatataagtgtttgctattattattattacttaagttcttattatgaagattatctgcctagagtgtctctgtctaaaacaatagtctgcataaagtctgggttgtgttggagagggagaagagggtggtgaaggaatttttttcagtaaagaaccagcaatatctgctgcaaaggttcttccccacctcatccaactggaaaagccccgccagtcccttcaagaccctgttcaagcatcaaccctctccaccttctccacccttctcccagtggataattcccactgttatctcagcactttatttctgaattatatcagtcagtttctgaattatagctgttatcatactgcattatattatctgtttatgggtctctccctcactaggctgtgggctccttgaaggcagggactagtgtaattcaagcatagtgtcatggtatgcagtaagccattgatgctcatggagtggcagactatagctgggcagatttctctttcagagttgcccttccttgtgttcatttccttccctgcaggtctagactagagtcagtctcaaccgccctcaatttgccacttggccaaaggcctggactctctgcagtggggagctaaacatctgaatgaagtagtcatcaaaaccaaggtgagctttggagattgctatggcagaagtgaagagaagaggcaactagagtgacagtacatctttgctagttggggtcagtgttgggcatagctgttccctataactcagtactccagctagactgagatcaagagcatggctgagatcaagaacatgccctgtgttaccccttttgtgaggtcttctgagatgcccccaggcacacctaactgctagtactcctgtgcttcactgcaatttgaacatctctattaaaggactagtgattttattgcacatctgcttctcaccagactgtgagtcacatgagggcaggaactgtgaggtttcggttctgtagagctgctttaggtaaatggttgatgaatgagcaaatgaatcggtttgtctttctgatactacttcagtgatctgtccaaatgccgttaagaggcatattttgttacttgtttatcagtcatcttttctgcttgtttcaaccttcagtaaactgtggaactgttctctttcatgtagtacctggcacgtaggaatagtgcagcagataactattgaactgaatggcacctgagagcaacacagatgtagggttcttttattttctggatgtatttggaggcagggatataggtcagcaacccatagtgcagttgtcctttggggagggggtcagtgtgccaacctgtacagtttagatcggggactgtgaccacacacagtcaccagttaaatcaggcagccctattgcgcacatcatcatctccatcttcagttgtgtgtacagccaattgtaattactgaggcatataaggtagccaaatcatgtttgtgagcctccacttgaaaagtaaaagaaatatatgttatatgttagaatgagggttttttttcatacagagagaaacagaactaagaaaaaaataatttgtaatatttcagaaaactcaatttttgaggactctggatgatagaattcttacagtagctacccagctcagagcaatttgtgcatggaatacctttagggtatgtaagttccagaagatcatcatttagcttagtgcccagtatgatgccagtcattgtagaaaatttgacagattgatgatgcatggcctttgcccccaaagaatttgcattctaattgatgatctcagatgttatatctgcagtggtggtgagcagcttggaagagtataaaatataaagctaagctgtctattttgtgcgtgtgggaggcattcagaggagacatgccaagggtggggtatgtcaaggaaggctttatgataaaagcagtaggtgagtggaaattaaagtcaaagtgggagggtagggggacctgggaatgaaagtaaaagtgaacctgaggtgttagtaatggtgtatcctcactggattattcattaattcatcagttgaaatttatgtaactgactaccttgggccagacactatgatggatactagggacacagagatacacaggacatggtccctgcttttggcatactatggggacacccaaggagtgccttcctttattgaccatacagttaaatgactgacgagtcattcatgccttcaacaaacatttattaagtgtctgttttgggtcttactcagcattggatgctggggatacagaaatgagtcagaccagtccaagatactctcatactccaggtagatgcatgtgttaaaacatacaatcagctatttgctatttgcaaagtgcttctctcatatgaggcaggtttaatcctcatagcaatcttgtgaggttgtttctgttatattccccatctcacataatttgtgagattatgaactaagagattatgaaagtgagattatgagtttagttgataaactaaggcatagagctgttaagcaatttctctacgctcatactgctaagaagtagctgagctgagaagtgaatccaattcctctgcatgttttttttttttaatgtcctggaatcacaagagtatttgactcatactgtaggagcagaaataaaatgaaataaaatgaaaactgattttttgcgaaaagagaggcatcttctaagaaaatgaaagaatgattcttcgaatgggaaaattgccatcaactcaggggaagttatgaaaagtttgaagacatgtaatgggagagtgaacaaagtactaaaataagaagggaccacattggggtgtgttgctttactagtccactgtgagatattaagttggtgcaaaattaattgcggttttgccattaaaagtaataggcagtatcatggaatattggccatagagttaaatgttctataaggtgaaactattgttaaaaagtcacttgtgttatggaatcaccttcatgtgttagttattgatcttgccggcttgcaatttataaatgtatttttaaaagcaagagtccattatgtagattttctttctctttccttctttcctttcactgagtcaataattttaagataagaaaagaaatatataaaagatctattatagaacactgatgtccagtttaatcccttattcttttctgcaatcaaaagataaagtaggaagataactggaatcagtttgtgacagagaggaaaaaagaaattgactgtgattacaaacctcacaccaaaattattattatagacctgactcccaaattatgcagattgagaccacatgaaacatatggtgtattgtttttctacgcataacttgtttgatgtttgtttaaagaccttagatgaagaactggctcttgagatatcttgtctctcataatcacaatctgaatctgccttaccctcacttgaggtttacatggagagtttcaaactgaaataatgcaaaaattccttatgtgacatggtgatgtggagtgtgggctttggctctaagtttgtgatgggattggtgtagtgttcgcatggaaataatcatatacttggcagcattttctctgaggctattagacctgaatggacagaaatactgatgtttgcaaattccctctggcagtatggtgcaagtgatatcattcatatcctttctttccattttctatcttcctacactcagtgacctcagagatcatctggccattctttctacagttgatgaactcagtcctggagagtgtaaaggacctgctcaaggttttttggcatagccaagtatagcttctagaagtaatttccattgatcttattgcttgctcttcagaactatctaatgaggtggctggcaagatggccgaataggaacagctccagtctgcagctcccagcgagatcaacgcagaaggcaggtgatttctgcatttccaactgaggtacccagctcatctcattgggcctggttagagtgtgtgtgcagcccatgcagggcgagctgaagcagggtgggacgtcacctcacctgggaagcacaaggagctggggaagtccctccccatgagggactgtgctgtgaggaacagtgcattccggaccagatactatgcttttcccatggtctttgcaacccgcagaccaggagattcccttgggtgcctaaacaaccagggccctgggtttgaagcacaaaaatggctggccgtttgggccaacacatagctagctgcaggagttctttttcataccccagtggcaactggaatgcaagagagagagaaatgttcactcccctggaaaagggctgaagccagggagctaggtggtctagctgcccggatcccacccccatggagccccgcaagctaagatccactggcttgaaattcttgctgccagcaccaggcctgccttacaagagctcctgaaggaagcactaaacatggaaaggaataaccggtaccagccactgcaaaaacataccaaattgtaaagaccatcaacactgtgctgaaactgcatcaacaaacagacagaataaccagttagtatcataaggacaggatcaaattcacacataacaatattaaccttaaatgtaaatgggctaaatgccccaattaaaagacacagactggcaaattggataaagagtcaagacccatcagtgtgctgtattcaggggacccatctcatgtgcaaagacacacagaggctcaaagtgaagggatggaggaatatttatcaagcaaagagaaagcaaaaaaaaaaaaaaaaaaagcaggggttgcaatcctagtctctgataaatcagagtttaaacgaacaaagatcaaaaaagacaaagaagggcattacataatggtaaagggatcaacacaacaagaagagctaactatcctaaatatatatgcacccaatacaggaacacccagattcataaagaaaattcttagagatccacaaagagacttagactcccacacaataatactgggagactttaacacctcactgtcaatattagacagctcaatcagacagaaaattcacaaggatattcaggactcaaactcagctctggacgaagcagacctaatagacatctacagaactctccaccccaaatgaacagaagatatattcttcaaagcaacacatcgcacttattctaaaatcgatcacataattggaagtaaaacactcctcagcaaatgcaaaagaatggaaatcacaacaaacagtctctcagaccacagtgcaaagaactcaggattaagaaactcactcaaaactgcacaactacatggaaactgaacaacctgctcctgaatgactagtgggtaaataacaaaatgaaggcagaaataaataagttctttgaaaccaacgagaacaaagacacaatgcagcagaatctctgggacatagctaaagcagtgtttagagggaaatttatagcaataaatgcccacaggagaaactgggaaagatctaaaatagacaccctaacattacaattaaaagaactagagaagcaagagcaaacaaattcaaaagccaggagaagacagaagacaagaagtgaataggatcagagcagaactgaaggagatagagacaaaaaaaaaaaaaaaacccttcaaaaaatcagtgaatccaggagctgattttttgaaaagattaacaagatagatagaccactagccagattaaagaagaagaaaagagagaagaatcaaatagacacaataaaaaatgataaacgggatatcaccactgatcccacagaaacataaactaccataagagaatactataaacacctctatacaaataaactagaaaatctagaagaaagggataaattcctgtacacataaacattcccaagactaaacctagaagcagctgattccctgaatagaccaatgacaagttctgaaatcgaggcagtaattaatagcctaccaaccaaaagaagcccaggaccagacagattcacagcctaattctaccattggtacaaagaggagctggtaccattccttctgaaactattccaaacaatagaaaaagagggactcctccctaactaattttatgaggtcagcatcatcctgctaccaaaacctggcagagacacaacaacaacaaaaaaatttcaggccaatatccatgatgaacatagatgcaaaaatcctcaataaaatactagtaaactggatctagcagcacatcaaaaaacttatccactacaatcaagtgggcttcatccctgggatgcaaggctggtttaacatacacaaatcaataaacataatctatcacataaacagaaccagtgacaaaaaccacatgattatctcaatagattcagaaaagggcttcagtaatattcaacactctttcatgctaaaaactctctataaactaggtttgatggaacctatctcaaaataataagagctatttatgacaaacccacagccaatatcatactgaatgggcaaaagctggaagcattccctttgaaaactggcacaagacaatatgctctctctcagaactcttattcaacattgtattggaagttctggccagggcaatcaggcaagaaaaagaaataaagcatatttaaatagaaagagaggaagtcaaattgtctctgtatgcagatgacatgactgtatatttagattagacaaccccatcctttcagccccaaatctccttaagctgataagcaaatttagcaaagtctcaggatacaaaatcaatgtacaaaaatcacaagcattcctatacaccaataatagacaaacagagagccaagtcatgagtgaactcccattcacaattgctacaaagagaataaaatacctaggaatccaacttacaagggatgtgaaggacctcttcaaggagaactacaaaccactgctcaaggaaataagagaggacacaaacaaatggaaaaacattccatgctcctggataggaagaaacaatatcatgaatatggccatactgcccatagtaatttatagattcaatgctatccctatcaagctaccactgactttcttcacagaattagaaaaaactactttaaatttcatatggaatcaaaaaagagcctgtatagccaagtcaatcctaagccaaaagaacaaagctggaggcatcacactacctgacttcaaactatactacaaggctacagtaagcaaaacagcatggtgctggtaccaaaacagagttatagaccaatggaacagaacagaggcctcagaaataaagccacacatctacaaccttctgatctttgacaaacctgacaaaaacaagcaatggggaaaggattccctatttaataaatggtgttgggtaaactggctagccatatgcagaaaactgaaactggaccccttccttacatcttatacaaaaattaactcaagatggattaaacgttaagacctaaaaccatgaacaccctagaagaaaacctaggcaataccattcaggacataggcatgggcaaagatgtcatgactaaaataccaaaagcaatggcaacaaaagcgaaaattgacaaatgggatctaattcaactaaagagcttctgaacagcaaaagaaactatcatcaggttgaacaggcaacctacagaatgggagaaaatttttgcattctatccatctgacaaagagctaacatccagaatctacaaggaacttaaataaatttacaagatgaaaacaaacaactccatcaaaaagtgggcaaaggatatgaacagacacttctcaagagaagacatttatgtggccaacaaacatatgaaagaaagttcatcatcactggtcattggagaaatgcaaatcaaaaccacaatgagataccatctcatgccagttagaatggcaatcattaaaaagtcaggaaacaacagatgctgcagaggatgtggagaaataggaatgcttttacactgttggtgggactgtaaactagttcaaccattgtggaagacagtgtggtgattcctcaaggatctagaaccagaaataccatttgacccaccaatcccattgctgggtatatacccaatggcttataaatcgttctgctataaagacacatgcacacggatgtttatttcagcactattcacaataacaagacttggaaccaacccaaatgcccatcaatgatagactggataaagaaaatgtggcacatatacaccatggaattctatgcagccataaaaaaggatgagtttatggcctttgcagggatatgaatgaagctggaaaccatcattcttagcaaacttacacaggaacagaaaaccagacactgcatgttctcactcataagtgggagttgaacaatgagaacacatggacacagcaagggtaacatcacacactggggcctgtcaggggatgggggactaggggacggatagcattaggagaaatacctaatgtagatgacgggttgatgggtgcagctaaccaccatggcacgtatatacccgtgtaacaaacctgcacgttctgcccatgtatcccagaacttaaagtataattttaaaaacatttacatatatatatatattatatttatattcatatattttaaaaaaagagctatctgatgagacaggtgaggcaggttgttttgtatcaatttctagaagagacagtttagagccagggaggttaaaatgctggttaatggcccaagacgtagccagcagctcagctgggactaaagtccagatcttctgatttcttgtagcacaccatattgcctctgaattcttttctttcaaaacagatatttctgtccttttgggtttgtcaaggaatcacttcctatgttattcttttgacactggtattcgttggcacttgcaaattgccttagattggtaattaacttttaaaatttgtagatattttgtttctctaactatattataatctctctgaggattgagggccagccaggttttatactgcctttgaatcttccttagtacctagcttgtaatatatgcttgacaaatatttgtttagtgtctgatagtggaagtcagctggaggttggtgtatgtctaatataaatctggaaattaaagtctcttttggttcttggctcaggatataaaaagcatcatgggtaataaaatttacaagttttctagcctaatcaggtattatgtaaaatttgtatcctgatttgagaaaatctgtatctgccagtgtgttctgactgttggaacatgaatataaagattaatttgagattgcagagttctgccatagggtttggtgaaatactacctaaactgtcctcagagctttctgatatctatcaatagtggaaagttgatcttgtttctcctttaaagatttttgtctttagagctttgtgcaaaggttgaccagaacctcggaatcctaggatggatcgaatacctggtgtgtgctaagagctaggaaagtggaagctggattatgcacgggtagaaaatgaagagagggcaagaggaaggaagaaatggaaagtgtaagccaatgtgagtaggagtttggacgcaagccccatatttgaatcaggaaacaaggctgttggcagggctgattgtcatctccccagatgacctgctggccagaaagagttaactggccttacaacctgctgcaggaatagctcaagagctatcaaattcatcacatgtaacttttcactcagattggttttgggtcctgatatttacgagttaaaacatcttaacatcatttcaaatatttgtgaaagtatatgggaattttatggagcagcggggaatttaatgcaaataaagtagaaatatagagtcatatttgagtttttatgttgaaatcatatcttgatgaagttagttttaaacaactatatttactgaggacccactggggacaaaacacattcaaggtatttttttcagtttttaaaatttttgcaggaaagaaagaaccagtcacatcgaagcaacttgaatgtttataaaggaaaatcatagaagaatggacatcctttactcttgaaaagtttatgaataagctgcatgtcaaagcaatatcataatcacaaagtagagaagataatccattgttttcttgtataaagtcattagcattctaacttattcattcatttgtaaatcacacattgaaaagaaaacaattagcacactctttcacatatctgtgataagtcctcaggcctactcaggaagctgttgaaaatgggcatgctgatttgttattaatgcttatatattttagaaaaagcatccaatttagaaattaaattgatttttttttctttttacaaaatgaaagtcattactacaggaggtagggagacaagcaggcagacaaacaagacagcagggcagagccctgactggggcataggatctgttcacatcccatttctgttgaaggaagattatagcctaagagcatacagtagagggttggattagaacctcccatcagaagccatcaagaggtattctctttcccctgttctcttgcacttgtttctttcacaagttttttcagcatttttgggtactctgttgtacaacctaaaataaattaggcatctaataatagttttcttaaggaggcaaaaggaaaaaaaagtagaatttgtatttctcatgtttctaatacggattcttcttttaaaagtagccccaagaatgcatccttattctttcagcataagaatatgctgtcagctctggggacactaagatgaatagggcacaaccttacttgctaggttctcataatccagttggctgctcaggataagtcaagcataaagacattatcaaggccctgtgggaattcagaagggaggaaatttattcctgctaagggactcagggaaggcttcctggaagaggacaatcagagctggactttggcagataggtaggatctgcacatgaagagatgggaggagatggaggcagctgtcacatagttgagaaatcatgtgatgtgttggctaacagaacgcacttttttcttggagtctgaggcttgggaagggaaatgacgggaggtcaggttagcaatataagttgaagctagattggtagggacagccttgaatgtcaggccaatgtctttgggactttataggtagtgctaagacatatccagagaattagctaggcagtgtcacgaacagatatttatagcatattgtggcaagaaacatgagtgcaggatggttggaggccttgaggagggagccgctaagctgccaaggtgtgaaagctggagcatcgtcaaggaagcttgcatgaaagtgatgacattttgctgaaccttgaaggatggatatgaattccccagggaataggttgggaaaggacatttcaggcagaaagaatagcacctgcaaagtcccagtggtctatgagggaatgttatgctgaagaatggcaattactgtgatgtagagaatgcaggtatctgggaattgggtagcaagagaccaagctaggaagagggcaaagaccagatcccagcagaactagtaggcctggctgggtggtttcaacttcaagggctgtatgcaggaaacaattgtgatgtgtgcttttagaaatatcatgctagcagtggtgaggaggatgcattagcataaatgagaaaggcttagcttgctgagtggtagggtggcaatggaactaaaatacgtaaagaaacagtgtttggggcttagagagagtctgggcaagacagagggtggactgaaaggatttagggggaatggtttttatactttaattaatgctgtggttttcacaataggtctctttgtttcaaaggaaatcttacgcaaactccatgaaagataagggccaagctgcatggagttcaggtgggaattgggcttggatccaagcctgcttgttcccttgaaatcctgcaatttcgtgatggctcctgaggtacctctttgaaccctttgtagttcagcaaatgcagtttgaaagccactgccctgaaaagattcatgtgctccaccaaaaacccaggcctttgccctccatgctgctgggagagggaaactggcctcttgctgtcatggttgggcaccgaaaaaggcaggcttatctagggacaatgaacttgatctcttttagaggctctcactgatcctggtggctcactgatgaggcatctggagtattctttgatacctagggacattgtagttcccaaggcattttgaacaatcgtttgtagtccaatcaggccgaattcatgaaaggaatttctgggttctaggtagaaagcagggccagacgcagtggcttatgcctgtaatcctagctctttgggaggctgaggcaggaggatcccttgagaccaggagttcaagctgtgattgcacctctgtaccccagcttgggcaacagagcaagatcctgtctctttaaaaaatacaagcaagcaagcaggggataaaagaggtgcctaggccagagataagcaaggggagctggagacagggccattgtacagggatgtctggccctcggggtcagtgaggctgatattcagacagtgcttttggcagctgatgaggagctgcactcttccagagggattacctttttctaattcatagaaaggcaccttatgctctagcattggatatttgggaagatagcatgaagaggtggtgaagagcaagagataaatggggagttggggttggaatcaaatgtctgctcaacccttatgaggtgtgtgaccttgcacaacttccctaatctcttggatcatcagcttcattctccatgaaacatgaatgatactagtacctcctgttgtgggcttttatgaagattaaagaagataatttgtgtaaagtgcttaacacagtgcctggtacatagtaagtgttggataaattttggctgttaatattctttatttgtaatcagaacactgtctactccattacagcagtaacttcagacttcatatcttgatacatttctctttactaagaaagaatgcctctcagttcaacaacatgggcatgagcatcttatattttcagttatgtcctataaaagaaatacaaggaatgactactagcatggattttaaaaattactagatgtatttcagatacaaaattggatgctatggtgaataatccagggggtactcatggacccaccacttagcttagtaaaacattactgatgcagttaaagctccttgtgtatccctcactgatattcccttccttcttgcctggaggggaccaagtttctgaatttggcgtgaataactttcatgaatgttttaatattgctattacatttgtagctatctgtaaagaatgtataatttgtgttttaattattttagctttatgtagaagaccttttactgtattttttcttcaacagccctctttttccccctcaacatttacctaacataaacatatacttgttgctatacataaggtagggaagtaataaaaattgttatttattatggagaagagtgtcagctttttgttgtaaaataaaaaaatgatatatttaaaaatactaaatgtatttcaaattgactttctgaaagatctaggtagaaagagagttaggttttggaattttatctgatatacctacaggccactcataattatagggtacccaaacctgcaccttattaaaccttgatcgaatggttgtattgatgaaacatccacaattctgtttacataacacttgcttggatttggagacttggcatcttgactattaagtatgaaactgtcttgaaaaatcactgggttcatgaaaggttttaaatgaaatagcatgcatctataaaccattctctcatatttatccatttgagtgtgaagtagtatcctagttttcattttgaactccagagtcttatatttgtgaaatatgatgtcttctctttaactacaattgtatgatttttgaaagaatagatattggcatttatattctggtaaagttgcattgttatagtttgcaaattattaatccacagcacttatactttactgtttgaaaggagtcctatgcttttttcttttaaagcagaatgtggcatatacattaacacattgtcccacatttttgctaagtggaatgtgtctgactttgtgggctgatgaatgatgccatatttatttctgaatcaatcttatggcttatcagtgcagttatcacttatgtgatctgagacttttagctgggactccagagacattgatgatctttatcattctgtatcactcataaaggatcagggtcagttgaggttttgacacctggccatgtatttaatgttttggctttgttggatgtaactcatctggcacaatgttattaccacatcactgagtgagatgtcctcattttcagatgttgccaacattaatatctcagatttcaggaataaaaagttacctagggtgagttgagatgagtgacattgacatgtgtgtgtacctacatacatgtatttgctgacttgacttttgcttatctttatctctgtaattagaatatatcttctcttgattaaattaaacctgtcattttcccataatcatttatcaaatgttcctatacgccagctactatgccaagtacagggtatatacaagttactcttgaagagctcacagtccaataagggagacagtatactttgtcaggtgcttccgttgacttatgcacaatgtattagaggaacagaaaaggaaggagatattcatttatataaaataattgctcaagggaggcttctcagagcaggtgatatttgatgtgagtcttactgggtgaataggagtttgccaaattgaaatgcagagggtatatcatttgcaaaggcacagaagcataaaagaggacgatgagtttgggaagcatatgtgagggtaagagggaggctggaaattgagattgggccagatcatgaagggtctcatgtatcatgataaggagcttgggtgttatcttttaaggggaattgaaggagtgtttcatatggaaaagtgaaattttcatatggaaaaggttttagggaggctgtcttagtctattttgtgtgattataacaaaatatcagagactgagtgatttataaaggaaagaagtttatttagctaatggttctagaggctaggaagtccagtggcatggtgtctggcatctgtaaggccctcatgacctaaatacctccaattaggcctcacttcccaacactgttgcattgagaattaaatgtcaacatgagttttgggtgggggtattcaaaccacagaattctgcccctggatacccccaaatcatgtcctttttacatacaaaagacattcattccatccaaatagccttaaagccttaatttatttcagcactatattagtccattctcacactgctaataaagacatactgggtaatttataaaggaaagagatttaattgactcacagctcagtatggctggggaagactcaggaatcttacaatcatggcagaaagggtagcaaatacgtccttcttcacatggcagctagagagagaaaaacgagaaccaagcaaagggggaaaccccttataaaacaatcagatcctgtgaaaacttactatcacgagaatagcataggggtaactgcccccatgattcaattacctcccagtgggtccctcacatgacacgtggggattatgggaactacaagatgagatttgggtggggacacagccaaaccatatcattctgtgaccttcccctaccaaatctcatgtcctcacattttaaaacacaatcatgcccttccaacagtcctccagagtcttagctcattccagcattaacccaaaagtccaactccaaagttttatctgagacaaggcaagtcccttcttcctatgagactgtaaaatcaaaagcaagttagttacttcctagatacaatggaggtacaggcattgggtaaatacacccattccaaatgggagaaaatggccaaaacaaaggggcccaggctgtttgatacttcttttgaaatctaagtggagactatcataccctcatacccccacagttcttgcattctttgggcctgcaggattagtaccatgtggatgtagccaagcttaatggcttgtaacttccagagtgggagattgaggcacaccttgggccgcttgaaatccagctggggcaaactaggggacaaagctccagaacgtggggagcagtatcctgaggttgcacagggcagtgaacttttggaggccacccaggcctgttcccccaaaccattctgcccttgagagctctgggcccctgatggaaggggcagagtaaaaaatatccaaagtgctttcgggatttttctcccattgttctgatggctagcacctggctcccttctagccctaccaatctctttaacaaatggtcacttggccacactcttgcaagctttttcagtttttatgtggcaggctgcagattttccaaatctttctgttccgctactctcttttaattatgaatttcatctttaagtcatttctttccttttgcatctcactttatgtggttaaaagtagccaatcatcatcctgaatgctatgcttcttagatatttcttctgccagatatcctagttcatcattttctgcattccataaaatcctaggacatggacacaattctgccaagttcgttgcaactgtgtaacaaggatgccatttactacagtttccaataagttgtttctcatttccatctgagagtttgtcagaatggactttaacgtccatatttctaccagcattgtgatcacaaccacttaagtaatccctaagaagttccagactttctctagtcttcttttcttctgagccctccccagagtctcccttagtgccctattcacagcaatctagggtttttaaacttgctcctataaattcttttttttttcagtttggcaaccattcttattttatttaaagtacagataagagaaaataatattaagtagttcatttactattgtgatgattaactttatttatcaatgtggctaagctataagtaaacagttcttcaaacatcagtccaaatgttgctgtgaatgtattttttaatagaattctccattcatttatttatttatttatttatttatttatttatttgagacaaggtctcactctatcacccaggttggagtgcagtggtgcattttggctcagtgcagcctcagcctcctgggcttaagcaatccttccacctcggcttcctgagtagctaggactacaggcacatctcatgacgcccggcaaaatttgttattttgtagtgacaaggccttgctatgttgcccaagctgctctcgaactcctgggcttaagtgatccacccgcctgggctctaaaagtgcagagattacaggcgtgagccactgcacctggctagtggtacttttagatgtgatttgacatttaaatcagtagaccttaagaaaaaaagattaatctccataatgtacatggccctcatccaatcagttggaaaccttattagcaaaaactgaggttccccgacatagaaggaattatccacagaactaccacatgaaaacccattgggagatatacctaatgctagatgacgaattagtgggtgcagcgcaccagcatgtcacatgtatacatatgtaactgacctgcacattgtgcacatgtaccctaaaacttaaagtataataataataataaaaaaaaaaaaaaagaaaactcagcctgaatttccagcctgcaagcctgccctgcaaatttcagagctgtcagcccccaccttaacgttgtcataaatacttcggttttggttgttcacaaaatatgattccttatttggaatatttggggggaatattctagaggaaaaaagcataccaaataagcatgctgtgctcagttattccaacttaaattcatgatgctgcttgaacatactgtttttggatctctaatgcacagcatccttagactggattttcctaagaaaacttcaggaaaattttagagttgttgaattcatttgatagaaacagacattaacccaaataataatagaaataataatggtggtggtgatagtagtggtggcagtaataatagtagtagtagtagttattataatattgatttgcatacctgaaaggagtaaaagtagacctggcttcaaagctgaatgacctccaacaatgtgaccaggactccctcactatccttgagtttgatttctccagtgtacaacttcttcttcttcttcttttaaattattatgcttaaagttctgggatacatgggcagaacatgcaggtttgttacacaggtatacacgtgccatggtggtttgctgcacccatcaacctgtcatctacattaggtatttctcctaatgctatccctcccctaggcccccaccccctgacaggccccagtgtgtgatgttccccttcctgtgtccatgtgttctcagtgttcaactcccacttatgagtgagagaatgcagtgtttggttttctgttcctgtgttagtttgctgagaatgatggtttccagcttcattcatatccctgcaaaggacataaactcatccttttttatggctgcatagtataccatggtgtatatgtgccacattttctttatccagtctatcattgatgggcatttgggttggttccaagactttgctattgtgaatagtgctgcaataaacatacgtgtgcatgtgtctttatagtagcatgatttatgatcctttgggtatatacccagtaatgggattggtgggtcaaatggtatttctggttctagacccttgaggaatcaccacactgtcttccacaatggttgaattaatttacactcccaccaacagtgtaaaagcattcctatttctccacatcctctgtagcatctgttgtttcctgactttttaatgatcgccattctaactggcatgagatggtatctcattgtggttttgatttgcatttctccaatgaccagtgatgatgaactttttttcatatgtttgttggtcacataaatgtcttcttttgagaagtgtctgttcatatcttttgcccactttttgatggagttgtttgtttttatcttgtaaatttatttaagttccttgtagattctggatgttagctctttgtcagatggatagaatgcaaaaattttctccaattctgtagggtacctgttcactctgatgatagtttcttttgctgttcagaagctctttagttgaattagatcccatttgtcaattttggcttttgttgccattgcttttggtatttcagtcgtgacatctttgcccgtgcctatgtcctgaacggtattgcctaggttttcttctagggtgttcatggttttaggtcttaacgtttaatccatcttgagttaatttttgtataagatgtaaggaaggggtccagtttcagttttctgcatatggctagccagttttcccaacaccatttattgaatagagaatcctttccccattgcttgtttttgtcaggtttgtcaaagatcagaaggttgtagatgtgtggctttatttctgaggctgtgttctgttccattggtctttatatctgtttttgtaccagcaccatgctgttttgcttactgtagccttgtagtgtagtttgaagtcaggtagcgtgatgcctccagctttgttctttttgcttaggattgtcttgcctatacaggctctttttgtggttctatatgaaatttaaagtagttttttctaattgtgtgaagaaagtcaatggtagcttgatgggaatagcattgaatctataaattactatgggcagtatggccattttcatggtattgattcttcctatccatgagcatggaatgtttttccattcgtgtcctctcttatttccttgagcagtggtttgtagttctccttgaagaggtccttcacatccctttaagttgtattcctagctattttattctctttgtagcaattgtgaatgggagttcactcatgacttggctctctgtttgtctattattggtgtataggaatgcttgtgatttttgcgctcattgattttgtatcctgagactttgctgaagttgcttatcagcttaaggagattttggcctgaggcaatgggattgtctaaatttacaatcatgtcatgtgcatacagagacaatttgacttcctctcttcctatttaaatacactttatttctttctcttgcctgagtgccgtggccagacttcccatactttattgaataggagggctaagagagagtatattgtcttgtggccagacttcccatactttattgaataggagtgctaagagagagtatattgtcttgtgccagttttcaaagggaatgcttccagcttttgcccattcattatgatattgactgtgggtttgtcataagtagctcttattattttgagatatgttccatcaatacctagtttattgagggtttttagcatgaaggagtgttgaatattattgaagcccttttctgcatctattgagataatgtggtttttgtcattggttctgtttatgtgatagattatgtttattgatttgtgtatgttaaaccagccttgcatcccagggatgaagcccacttgatcgtggtggataagctttttaatgtgctgctagattcattttgccagtattttattgaggatttttgcatctatgttcatcatggatattggcctgaaatttttttgttgttgttgtgtctctgccaggttttggtagcaggatgatgctggcctcataaaatgagttagggaggagtccctctttttccgttgtttggaatagtttcagaaggaatggtaccagctcctctttgtaccaatggtagaattcagctgtgaatccatctggtcctgggtttttttggttggtaggctattaattactgcctcgatttcagaacttgtcattggtctattcagggaattgacttcttcctggtttagtcttgggagggtgcatgtgtccaggaatttaaccatttcttctagattttctagtttatttgcatagaggtgtttatagtattctctgatggtagtttgtgtttctgtgggatcagtggtgatatcccgtttatcattttttattgtgtctatttgattcttctctcttttcttctttattcgtcagtctgactagcagtctatctattttgttaatcttttccaaaaatcagctcctggattccttgatttttttaacggtcttttcatgtctctatctccttcagttctgctctgatcttagttatttcttgccctctgctagcttttgaattcatttgctcttgcttctctagttctttcaattgtgatttcagggtgtcaattttagatctttcccactttctcctgtgggcattcagtgctataaatttccctctaaacactgctttagctgtgtcctacagattgtgttacgttgtgtctttgttctcattggtttcaaagaagttatttatttctgccttcatttcgttatttacccactagtcattcaggagcaggttgttcagtttccatgtggttgtgcggttttgagtgagtttcttaatcctgagttttaatttgattgcactgtggtctgagagactgtttgttatgatttccattcttttgcatttgctgaggagtgttttacttccaattatgtggtcgattttagaataagtgtgatgtggtgctaagaagaatgtatcttctgttgatttggggtggagagttctgtagatgtctcttaggtctgcttggtccagagctgagttcaagtcgtgaatatccttgttaattttctgtgtcattgatctgtctgatattgacagtgaggtgttaaagtctcccagtattattgtgtgggagtctaattctctttgtaggtctctaagggcttgctttatgaatctgggtgctccttaattgggtgcatatatatttaggatagttagctcttcttgttgtgttgatccctttacgattatgtaatgcccttctttgtcttttttgatctttgttggtttaaactctgttttatcagagactaggattataacccacactgtttttttttttttttttgctttctctttgcttggtaaatattcctccatcccttcactttgagcctctgtgcgtctttgcacgtgagatgagtctcctgaatacagcacactgatgggtcttgactctttatccaatttgccagtctgtgtcttgtaatttgggcatttagcctatttacatttaaggttaatactgttatgtgtgaatttgatcctgtcattatgatgctaactggttattttgcccatttgttgatgctgtttcttcatagtgttgatggtctttacaatttggtatgtttttgcagtggctggtaccagtttttcctttccatatttagtgcttccttcaggaactcttgtaaggcagacctgctggtgacaaaatctctcagcatttggctgtctgtaaagtattttatttctccttcacttatgaagcttagtttggctgcatatgaaattctgggtcgaaaattcttttctttaagaatgttgaatattggcccccactctcttctggcttgtagggtttctgcagagagatctgctgttagcctgatgggcttccctttgtgggtaacccaacctttctctctggctgcccttaacattttttccttcgtttcaaccttagtgaatctgatgattatgtgtcttggggttgctcttctcgaggagtatctttatggtgttctctgtatttcctgaatttgaatgttggcctgtcttgctaggttagggaagttctcctggataatatcctgaagagtatttttccaacttgcttccattctccccatcactttcaggtacaccagtcaaatgtaggtttggtcttttcacatagtcccatatttcttggaggctttgtttgttccttttcattcttgtttcaataatcttctcttcatgctttatttcattaagttgatcttcaatctctgatatcctttcttttgcttgactgatttggctactgatacctctgtctgcttcacaaagttcttacgctgtgtttttcacctccatcaggtcatttatgttattctttaaactggttattctagttagcaattactttctttcagagatgccctgcccagagaggaggaatctagagaggcagtctggctacagagccattctgtacctggctccgcccagtttgaacttcttggcagctttctttacactgtgaggggaaacctgcctactcaagcctcagtaatgtatgatgcccctccccccaccaagctggagtgtcccaggtctacttcagtctgctttcctggcagcaagaatttcaagccattgaattttagcttgctgggctcaatgggggtgggctctgctgagctagaccacttggctccctggctgcacccccctttccaggggagtgaacggttttctctctctggtgttccaggcaccactgggatatcaaaaaaaaaaaatgctgcagctagctaggtgtctgcccaaatggccgcaccgttttgtgcttgaaacccagggccctggtggtgttggcacctgagagaatctgctagtctgtgggctgtgaataccatgggaagggcatagtatctgggctggaatgcaccattccgcatggcacattccttcagggcttccattggctaggggagggagtttcccgcccccttgcacttcctgggtgaggcaacgccccaccctgcttcagcttgccctccatgggctgcacccactgtctaaccagtcccattgagatgagctgggtacctcagttggaaatgcataaatcacatgccttctgcattgatctcactgggagctgcagaccacagctgttcctattcggccaccccgacagccacatcctgtaacttcttccagcccctacccatcatccagttctaaggctgcttccacattttcagatatttgttgtggcaacaacaccactttctggtactaattttctttctttgttttctattgctaaaacagaataccacagactgggtaatttataaaacaaagatgttaatttaactcatggttctggaggctgggaagttaaaaaccattacacctgcatggggtgaaggccttcttgctgcatcacaacatggtgaagggcatcacatgttaagaagggaagaacaagagagctagagagagcttgcttttataacaaagccactcctgagataacaaactcactcctgatagtgacattaatccctttatgagggtagaagtattaagtttccaacacatgaacttttggaggatacatttaaaccatagcagaggtctctcagatagcagtttggagtaaatttaaacaagatagaagtggaaggtggggctcattataatctgatctagtacaaagtgcctgggtctaaatcagaaatacctgggtttgagtccttgctttgccacttattagtcgtgtgacctttggcaaatgatatagcttccgagtttagtttgcttatcagtgaaataaggatgacaattcctacattacagggctatggtaaggaaataataataataatgataataatcagacttacagcatatttcacgtggctggcatatggtagatgctcagcaaatgtcactttcctttccattctcttcttatattggcagtttgcccttctaatggttcctggaatagtgtgttgtgctcctagattttctcagcggcctcttgtttggttcttgttttcctcagatgactttctgatgtttacttagtttccttagcgttttacttctcatttcaatttgacataaagcaatgacgtaaggaccaggtacatttttctcaccttcatttattgtggcccataaagcttaaacatgttggcttgtggactgcagtgtactttttctcaccttagatgttaagtatgtgccccatggtagagttactgaataaaaatttctgggagtgggctctgattttgttaagaatggtagaatatgttagaataaatactatcataagctcccttgattattcttgtgcatactgaagttggagaacgacttaagcctgtgggctttaaggttgagcgcctcggtttctaactggctgttggccagagaccacactcagtttcttgccacatgggccttaccaataagactccttgcttattcaaagccagtaagggagtcacttagcaatataagggttacattttgatgcattgtaatcatgtacacataatcaaattcgtcttatcaccttggcaatgtcctgttggttagaagcaagtcaggatcaaagggaggagtttatacaggggcgtgaataccaggaagcagagatcatgggggccaccttaaagcctgtccccatagaatgtgaggggagaggggaggtagtaagttcagttgtctgcatgtgacatttaaaaaacttgtgggcaaaagtgggtttataatgaatctaaagaagttttgggtgatttattttctctcacaggagaagactctgctgaccagggctcaaccctgacaaaacaattttatgttcatcattttgtattccattcctaaaaagagtctctgaaattgtataaacttgaagcctcaccaaacattgactttccctgcctgtgggaaagcttcctgggtctggagaatattctgctgcccagggctcaccctgaaaaacagccccgagctgtggcttgcatatccctggcctagcagcttttaccaggaggtggccattagcaatggaaatccctaaaccatgatcccaagcactttctgaagagtggggaggacaagttccagaagactgcttttgtatcaggtctattgttctttgggagctcatgttaagcagaggagaaaaattgacttctcagacaagcatttccctactcttctgcacccaccgtcagttcactaggcatctgcatctccagggcaaacatgcctctgaagactgctggagctagtctcctgtgttgtggccagtaagaacttttgcacatttctgcctttcttcctgtccccagaaacttacagtccctaccctagaatggtgagtcaaagtagtccacggttagctgcagtgtcctgaagataactcatggagacaaactaaaaagtcaaagaagttgtatccctccacctgtcatctgagtgttgggggatttctttgcttaagtgggtgacttgggagactttctttctagtagatacttgttggccagcactgacctggaagggcctatagagagacagagctggattaggctctaaagcgtcttcagtgctgggtctcatgttattgcatgtaaattagagatccccaatatcaaaatgtagctattacatgacaattccttttcattaagaagcaattgcttttcattaagaagaggcttcaagacacaggagccatgcaccctgagggtatgggggtgtcattaatgcttaaggtactaaatatgcacacctagttttagctatagactaaatgattaatatggcctgtatatgtgctcctgtttttcacaagtatatgcatactcttgtgatggcaggataagtaataagctctggaaccagactgcatggtttgagattctccatctagaacatacaagctttgtatgtatgtataatgatgctagacaaattgcttaacttctctgagcctcaacatccttgtctgggaaatgaatataataatagcatgtacctcaaaacgttgttgtctaccttatattaaatatttttttaaaaatccttagaacagtccctggtacaaagtaagtgctgtatatattaacctttattactactaatatacaaattaaaagaactacccaagacatggtagctgcttgcagtttgttgttttctcaatcaaaatatattgaaagcacaactgctgctgtgttccttaaatgagcgcagagccagggacagggcctagggctcctgactacacttgccgcatcatttttactattgcagattgcgtgttttgtctctttgcttaatgaaaagcaatcacaccttttgttgttattaagggcttattgtcatttaatggctacattttgctattggagacttttctaatttacaagcggtaattgttctggacacgtgactctcatttagtatctgctgaagagcccttgttcataattattgcttccgtggttatgttatgtatttatccagccctttctttagacaattgatatgttgtcctggatacctccctgttgctgatttggagttggtcaatccatcgcttcatcagtgctcttaaaataatgagttatggcatgctttgtgatcagcacataatgttctgagtggaaaaaactcatggcgactctcaggagtgctattttttgtccccttgcccactcctgcacacatgcttgcttctgtttagccagaacctcatcttgctaatagtggtcataggaaattttctcaccaatgggacctatgtgtgcatatacaagggggtagtcatggggtgttagatttcaggtaaaatcagaagacttttttgtgtttggtcttttctcaagatggtatctgtgtttatttcctagaattgttgtaacagatgactacaaatttgattccttgaaacaacagaaaatcattgtctcatagttctggaggctagaagtctgaaatccaagtattagtaggactctaggggagagtgcttccttgcctcttctagcttctgctggttgctaacaatctttgacattccagtctctgcctctgtcttctcaaggccttttcccatgtgtgtgcatgtatttcccctttctctatgtccaaattttcctctacttataacgataacagtcattggattagggcccaattaacctagtccactatgacatcatcttaccttgattatatctgtagagactttatttccaaataaagtcacattcacaggtacttgggagttaggatttaaacgtatctttttgggggacataatttaactcacaacagtggcttttccttgtctctcttatttttcctagtttttaaattttaaagaagggaaaactcccttccacccagtggcacaggaatgagttgatttatatggattaaaagtcatagatgttagaagaggaggaaagtcctagaagaaattgtagcccatttctttcaccaactgaggtctaggggagagggggctatttggctaaggtcagaaatctgataagggatagagccagtcgtcagacttcatttcctgattctgagattaggataggacttttttttttttttcattatctcttcataaaggtactggcaatagtggttgaaaaaccatgtggcaacagacattgaggcaaatttctataaaaccagaaatagctgggaaagcggaagccaggttggacctgccaatagttggaattcttggctgtctgtagagggtgaattgacagccaaaagccctaccaaggtccaaatctctcttccacccatttcagttcaatctgatcaatactttttattgagctaataaccagaagtaggccctgaggattcactgatcacaagggtagagattatccctgcctttacggagctcacagtacagtgagcacctaaacagtgctagactccaattgcctacttatttttctgagtgcagtaagagaaggacatagtaggggcatccattttgaccttgggggaagggaggtaggagtgggggaaggtcaaagagctgagatcccaaaacatgagtaagagttacccagtaaaggagcagtacaaaaggctgcaggtgaaggagtattcctgacaaagggaaggctttgtgtgagggcttggcggtgagagagagagaaacacatggtggaaaaacagcacgaaattcagtttgcctgaagcacagggtctggggggcatcaagaagagctttgtaaactttgaagagatttgatttttttcccctgggcagtgggaagtcatttcaggtttctgggcatggagtaggcattcagactggggatcccaagtcccatatgatatttaacggagctttattctaaacaaataaggcttcagggatctccattctgggtagatccacctttccaacctttccccccacatatttgttgattcacaattagccacagtgcttgatcgggctctagaaccagagtcccttttataatgttttcaggttttagtctgtggttgaaggccactgttcagtatgtatatttgtgcacctgtgtgctgggcccacatcggaggcccagtacatactggcctcgtcgtttttttttttgtttttttttttaacttaatcacatcggtaatcgccccggggcctcctccgttttttttttatgacagttcgctctgaatttaatgtttgtctggatctgcttttacctttcctgcacatgatttgagctatggtttgctcttctcttgtcgatctgatcccatgtgttttccatcttcagggaattcctcaaattctagtacacagaggcaccctcctgttacccagtctctgttaatggtgttacagttagctctcattcaggcaatggagattagcttatcttaatgtttctcaaggctttttatttttcattattgctcccctaaggagcctttctggacatttttcctaattgtaggacattttaataccatgacattttaataccagagatatactatttatgtgttgtacctatatctgtcctttatatagaacaaggataagtataaggcctacttactctttttataacatgaaggattaagaatgactaacgtttgcagttaacaattaagttaaaaattaaaaagctattaacaattaactttgtgtgtatttgctgagtacattttaatttaatttatttacttaaaaattccagtgtatcaactacatataaaaattaacaatttatataaatttgtaatatttaatagcaaggtgcttcaatgtttaaaaaattcatccaaatctgctctttttccggcgaaagtaaagtaattgaaaaaattaaattagcttcttaaaaaattttactgaacttaacatttaactactgcttgatatgggaaaataacttctaatttaactagctgctagacagtcattcagatcttgctaacagtttttctttatatttgacataattaataatgggctgaataatgttattagaattaaatgataacatataaactgaagatcaaatataaaccacattgacaaggcagccagtggcagccacctctgccatttaacttttagaatgggcgatcaatggagagaaagtttccaatcacagtcatctattcaccgtagttttctagtactgatctggcacacattttgtatgtctactatgaagtcaaggtcagtgttactagtatgatacccaagaaaacacaacaggagaaattaaataacaagctgtaagattttgttgggtaaggttgagctctcgagagccaaaaaccattgtaatatgtaagttttttttttttcttccctcccaaagaaccaacttcaaccctttggagactgtattgaccctttgagaatgcgtggcttatctgattgtgtcctcttaggagtcttaacttcctaacatacggggcccaggagagctaagtattaaaaggatatggacagagtatgagaaaagattcagtcatgagacattgctgtgggtgtagcaccctttgtgggccgctgaaacaagtggcctaggctactagcatgaggttactacagtaatggagtcaaagcagaattaggggctgctccttggagttcttgtatctcttaggttcactgcatctcagtgcttatcatacaatgagtagttggtattttataagttgtctggtctatcagctctgtgcaggcattggctgtttctatcttgttcctattgccagttatctagcacagtgcctggcacatagaaagggctcagtaaatatttgttgataggatagagagaaggcactgcaggtggactcagcctacttcacaggctagatgagggctagatacaataacaggaaaaagaagattcactatttgaaaagaatcccaagccaccacctccaaacaaagccttctctttaacaccacctcatctctttgagcaccagggagggagtcattgtggataggtgggtttgaccatttgccatttagatagcaaagcagttttaatttgaaaagttttagtagtgtctttttaaaatgtgttagtcactactttggttttttaaagcaaatactgctgaatatattttatcttttgttggcaacctagaatcttcctaataagtatcagttcttgaggtacggggatcactttatcctgcaacaaatggtctgagaccaagaactttttgagttcttgggctggagtttctgagtttttctgtcttcttccctggcaggctagcagctatcactttgagttgttgttagaggcctactggtagcacttgctcactgtcctccctctcatttggtagttctaggatattcagatggagagaattagccaaccctgtaaaaactttgtgtaaagtaggagaatggaagttcctagtgaggagttgaggagttctcctgtaaataacaatttctgaaactttgtgtgtaggtgtgggtgtgggtgtgtgcaattgtgcacctctacagaatctgttttgcccttcttcccattatcacctgagttctggatgggtgacatgcactgataggttttgtgctggataagcaagtgattagtatcatattttctcagaagagtttatggagagtatgtacatgaagtttatttttgtcttaatggactgtccaagattcctttaatgggggctcacctttaaataagagaccacagatttccaattaatagaaaaagtaacctatggggatctaggttgttttgtacattgtggactggtacctgctcaaataatcttattcagtagcactatccaacagtgttatcaagaagtgctaattaacttttggttggggaaatgtaattacttgaatgggaattttgacccagatacttacctgttattctcaggacattctaaacttaaacacagttttctttcaccaaacacactttagtaagagataatatcagtagctcttataagtgtgaacagtaccaattttcagcatatgtgaagattaggttcctatgtacatttaacaaagtatttccaatgtaacatggcatgtggcctccctttgatgtcaattccatatttctgattttaaatccttaatctaatgtattgcaatagtacatattatgtgcacaggtctagaaatggaaaacctttgaaatggtgcaaattaatgatgtgttaagtatcacaatttgaataaagcagtgtgaatatcttgaaagaataaagggagagtaaagaatagaagaaaaacagggagggaaaaggaattctcaagggaaataatagggttgtgtaaatacttcaccaaatcgccaagactgacagcagaaaaggtcaaggtcattttaaaattgcaggagactcagttcaagttgcctttgagaagtaatgatgttttgagcaactcaaaactgaatttaagatttggtattgggggcaaaaggggatcacagaaggactccaggcctgctacctcattgtctgacaaattcctatgttctgggtctggggtcaggaccctgcccatcctgcccccattattgtcaccatatttcccaggcatccaagcctctgtgagctggtagggtttgttatgcacttacagcaaaactgacattaggagcacactcagtacagctaacagatcaagtgcaggttcctaaatgtgggcttgttgaacatccctggcctttcagtgttaaagatggacatagaatatttacttgtatctgttttttcatgaaggcttttgatactttgccatgatatttcatgtttttccttttttttttttttttttttaaaccaatggctgctacctggcattagaaagccaaatcacattatagcattttggatcagagctagttgtgaaggcatttttagagtagtttttttcagtcattctttcccttttattcattttaaaaagctggcctttatgatttattatgtaggctgcacacaacaaacattccctcactgggatattctatactcatcactgagaaattttagcaataaattatattccctaagtgtaaggaagcaattcctgggtagtgtatgaagttctactctgaataggcaggtgtgtgttctgtatggcactgcccatgtgggtgtggagtgaggaaacaggaaaaaatgaaggcagagcagtcacgggaggagggcaatggctgagaaggaaaacagttatcatccacttctgtctctcattttccttccagttgctcctacttggttggtaagtgtctaagtacaaagccctccataagcccaggttatcctcctgggaaaggggcctctgctactcttctacctttgtagaaagaaaggaggatgttcacatgagcctgtcacttactgtgtaccttcacacatgctctgtatactgtgctgagtggtgatacatccaccaaaattcatgtctacccagaatttcagaatgttgccttatttggaatagggtttttgtttgtttgtttgtttttgtttttgtttttgcagatgcattaccttcaatggcaaaaaaaaaaaacccagagttacttttgcaagaacctagtaatcaaattaatacaaggtcatacttaattaggatcaaccctaaatccaatcagtggtgtctttataaggagaaagagatttggagacgcacggagacataccaggccatatgaagacgagggcagagattgaaatgatgcagctactagccaaggaagcatgtctctgttgacaacttgatttcagacttctagcctccagatctgtgagggaatgcattcctgttgttttcagacatccagtttgcgattttgttatggcagccctaggaaaataatacactctgttgataaggacttatggcaaccctgacaggtggatactcttagatgccttttatgtctgaaggtcttactgaggaagctgagtcttactgaggaagtcctgcttcccttgcagcacaggtatgtggtaagaacctgtgatgggcttggtgctttaaggattataggtggcttaagtgtaggccttgctatcagcaagctccctgcagatgtgtgtggtggggagatggaacacggaggaaatcgacttttccaataggccctgtagcactaggctgcttgccctaggctgtcttcatctgctcatagacttttggatccctttttttttttttaacttgtttttaaattttttatttccatagatttttgggaaacaggtggtatttagttacacaagtaagttctttatttttattatattttattattattatactttaagttctagggtacatgtgcacaatgtgcaggtttgttacatatgtatacatgtgccatgttgatgtgctatacccattaacttgtcatttacattaggtatatctcctaatgctatccctcctccctcccccaccccacgacaggccccggtgtgtgatgttccccaccgtgtgtccaagtgttcttattgttcaattcccacctatgagtgagaacatgcggtgtttagttttctgtccttgagatagtttgctcagaatgatggtttccagcttcatccatgtccctacaaaggacatgaactcatccttttttatggctgcatagtattccatggggtatatgtgccacattttcttaatccagtctatcattggtggacatttgggttggttccaagtctttgctattgtgagtagtgccgctataaacatacatgtgtatgtgtatttatagcagcatgatttatagtcctttgggtatatgcccagtaatgggattgcagggtcaagtggtatttctagttctagatccttgaggaattgccacactgtcttccacaatggttaactagtttacagtcccaccaacagtgtaaaagtgttcctatttctccacatcctctccagcacctgctgtttcctgactttttaatgatcgccatgctaactggtgtgagatggtatctcattgtggttttgatttgcatttctctgatggccggtgatgatgagcattttttcatgtgtcttttggctgcataaatgtcttcttttgagaagtgtctgttcatatcctttgtccactttttgatggggttgtttgattttttcttgtaaatttgtttaagttctttgtagattctggatattagccctttgtcagatgggtagattgcaaaaattttctcccattctgtaggttgcctgttcactctgatggtagtttcttttgctgtgcagaagctctttagtttaattagatctcatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaaaggttggatcccttttttagtgtcttttcttgattcaaagaagattaacaggagacaagtcaatctgaggaaattcagatagaaatgtgcccccgctgctctcacctgattccttcctgacccactaaagttgaagaaacaatagcttaattttcctggaagagggtgttgggatctaggaaagctttttagggatgatgacatttgaggtagattttgaggaatttatccagttggagaggagggaaggtggagagtggaggcattggtggggaaaggattttaggtagaggaagggatgagaggaaaggtgcagaaagggaccggtgctggtgggtctggggcaccactgttagtaacacacagttggagtgtaagttttatggcttgaaggggagtagaggcagagggggaagaaagggaggttgacgtcatgatgaacagcatttttgaagcttttttctcctatttttaaatagctttattgaactaattgacatatgacaaatagcatatacttaaaatatacaattttataagttttgacatatgtatataccatgaaaccatcaccacaatcaaggtaatgaaaacatccatcactctcaaaagtatacttgttcgtttttgctatccctctctcccagcctctctgatttgatgcccatttgatttgatgctgatttgattcctcctcactagagtccctttgagggggtctgcaaaatcctgcctcttctaattacatatctgtgtaatactggagtttcttcatgtacctcagctaaaacaaactaccataacaaatcagatgcagaaacaaacataagaatccagctgtcctccattaacccagacattaaagagatttgcaaaaatacaaaaccgtgttgttttgacctacatttttggttgttttgaaaaatatggttatgtttcataaaactttagttatttttcttaaaaatatgttacttatgttaccatgtaattatattatttatatgaacatgttgttggtttattattgtgaatttcaagggaattgatacctgaatatttaaaaattttttgtttttatttataattcaatatatattgacagatgtagctcacaaaatataaggtctttggagtactgtttttttcccccaagaaatcaccctttttttctctgccacatctcaattatttttaagattctgagatcgaaaagcttgatgatcgttgctctagaggctttggtaacatgctaacatttgtggaatttctttccttaactaatggggacctgttgaagatcttttcagcagaggaatgaggggatctgacttgcttttagaaggaggactttggcagtataaggatgggggaagactgggcagggagaccaggaaggagaccattgcaggagtccaggcaaggcagaatgagtgcctgactgcagtgcatgtcaggggggtcttctggagaaagtgatatggcttgaggaataatcaggacaggaggtacaatctcagggctttgtttctcataggatgtgaatgtgaactggcttccccaaaaggggagtgtctcaggcagtggttaagagagaagcaacttcttgtctccagggtttctggcttgggttgtggtagaacaccatcagagtagaggaaaagggttggcaagggctgggctgaacttaaggtcagagttcttttcacacaggccaggagggggttcaggcttccctgctcaatgggcactcaatgcatagagtgagactgtggtgagggttacagctcagtgagtacgccatcccaggcctgaggctagcagtgccagtgagaacaggaagggagagaaggaggggagtgctgcaccctgccagggctacctttccttggctttggtgtgtgtgggcttcagcttgcatgttggtggtctgcagagctggccactgggaagggaagtgaactaacagaaatttgggggtggcaggtgcatattagggtagcaagaagagaaaggcagtcatttgggcctggaaccatactagaaggcagttaggagactggagagtttgatttatgtgatcagctagtatgtaggtccactgtgcatggaagtcccttgggactagattttgatgcatccccaatctgtgctcaaaggctccagcaatgccctagtggagtctggttggagcccaccttggagggaagcagtcttcatcacctaaaacagcagcgccttatttaggttagtttgtcttcaagtccagagaacattttgggggacaagcaggtccaaaatgggatgaatgggggacatcttccctaattgaacagtgagagcgcatccacagcgtggggaagacagacaacacagagtgtactgaagtacttccttttgaactttgttaaacctccgctaatttgaatactagtaatccaaataatgtccattcggataaaaccagggctataatatttacttttgtaattatgttatatatttgttaacatttaacatttagtcaggcctgtgttgcggttgctgtgtggaagcttatcagtttttgcaaagtgtggaacacctgtaaatgatgataggcaccttgttgatgactgtgaagcactggggctcttccagactactaggactattaccataggcatgagtaatatggaatcagtaacccagattaccacataaatatccaaacacaaatgagcttagagacttctggctcccctttcaacatctttatagcctgattttcagaggcaggatatttcccactggtttttattctcatgagtaccttgcattgcttatcctggttatcaaacttagggcatatatagtgttcacagtgctaagccctatctttgacagtgtgctgttataacattttattttgtatggccttagatgattctccaaatgctgagtcttttcattaaaaagtctatcaggacctctacttgcaaatatttctttttgtgatatgtggatgatgacatatcaaccatccaagatggtgctggatttgaacctttttctaatagcagtgggaagtcattaaaggattttaagcctagggtaacatgattcaattttcagttacatgcgatatgtggatgatgacaaccaccaccaccacaatgaaagtaagaaaaaactgatcagtgctttttctgttcttttcttatgttattgcatttaattctcacaacaacttttgagacaggcattaattttactcttctacagatgaggaggaaaccaaggctccaagaaataacaccacttgccaaagtcatatggcttgaaagtgaccaagccaggaattgaattcaggcaggctggtggcctttcttaaccattacattgtacccagaaattgaaaaccactttttcccccaaactgttaagaattagagagatttggtactctgccagtactacttactggcagattttgaaaagccgtgtacttaattaaagttttcctgaagagagtactttgctattctctgaaagtttacaccttccctatttttattgtctgtgatgatgccatttatgtttttatgtggtggtatttttatctttttctttctgttagctgtcatttttacctatagaacctgtggccaattatctgtgccattttctcacttgacaactaaaatattgacaataaacatcagtcattgcttgcagcttagaaaaaaatgcagtgagacacatttatcataactgagttttggaaactagctgtctttatattcaggtgacagacacacttgtaaacaactgatgtttacagcaccaacttagatctcacaggaggaatggggtttttttcacttgcctatgtattcttcaggcagaatgtgtaccttaagtgtttgagcccggcaatgtcttcagtctgcctgagctccaaggttctctttttcggcttcttaggctaatcagtgtgtgggtcctagggcacacaaaacccatgacattactactttcatagatgttaatgtgatctgagctgtattataaggcacttgcccttagcagttagttaagaaatattcactgagtacctattatgtgcctactggaaaccagagtattgaatagaatatatatggtctccatgttaatggtttattcagagaaacagaacattgaagaactaaatatacataagttaataagagaagtaggaagaaactgcaaaggagatgtacaaacctgacggacttttccaggaaattgacttttcagctgggatggaagaatgtggaggggtcattatatgatgagaagggaggagagctttgcggttagagggaccagcatgtgtgaaggcttatcagtagaataaacaataccatgatagagaaacagagaaattcagcagggctggagcagacagagtgagtggagggtggataagacggtgctggatttgaacctttttctaacagcagtgggaagtcattaaaggattttaaacctagggtgacatgattcaattttcagttacattttgaaaaggtcaatgcagttactattcatttcacaggtaattattgaacatttactacattccaggcattgtcctcggctctgagggataagccaaataataaaatagacagtgaattccttgcttttgtggattttatattctagtggagtggagtttggagatagtaaagaaaccaacaagtagaacatatcacatggtgaggagtgctatgaaagcagcaaaggtccaagagtgtgcccttggggaaagggtgccaattgtgtgtgtgtgtgtgtgtgtgtgtgtgtgtacactcttatctatctatctatctatctatctatctatctatctatctatctatcatctatctagtggtgaggaaagacctcgaggaaaagctggcatttcagcaaaggcctggtggaagtgagagattgaccatgaaggaaaagagctttacaggcagagagaagagcagacacaaggcccttaggagaaaggagaattggcgtattcaaggcccagcaacaaggccaatgtgacagaaatggagtgagcaaggaaatgcggtggaagatgacatctctgagatagtagggacccagatcatggagagcattgttagccagtgtaaggattttagttttcatgttgagtgagatgggaagacattgggggaatgataaaatgcacatgaagtgttaaaaggattgatctgattgctgccccatctcccctcccccatactgcctggatgctccgttgaaatagaccctaagggacaaagtggaagcaaggaaatgatgacttggaccaggggcttcttgtaaaggtggtaagatggaatgacttactacagaacacatttgaaggagggtgagaatagaagcagggagcagcctgttgcagtagatacattaggagactggaagaaagctgatggtgttctggaaatgaatatgggcctggagatggagaggtgtgggaatatcagatagttagttagaacacagagctgacccacaggactttgccgatgggtagcatgtcaggaatgagggtgagggaggagtcaaggatgacttctgggtgtctggctggagcactggggtgatgtcatttattgggaccactaggcacatactagtttggtggtgaggtgagtgaatgactccactttgaactgggtttgatttggaaattcctatgaaatgtgaaaggggagaaacagagtagatcattggatatatgagtctggatttcagatgtttgacccaggctggagatgtagatttaaaggttaatgaggaggaagatatgaatgggaaatgaagtcctggattatggatgatcttgttgaagagtagagtgagaggagaaaaagatatgaactaagttgagtaacacctcttttaaaggttgagaggagtagaatcagtaagagacatagaaacagaatatttaaagacatagaaggaaaatcaagagggcatgcttcagacaagccatgtatagggtgtttcaaatagtaattgtcaatagcaatcaccatactctcttgcctctgtgcctttgtacgcatttttctcagtacctagacttcccttctacccttctctgtgtttttctcttacggtatgctttatttttcctttcatgcctagcaactagtatattgcttagcatgtagttctaagtaggtatttgttgagtaaatgaatggatgaatctataatggacccataaagatgacaggtcttactacatttaggttacctttttctttaaggtatatttgaatcattttaagataagtagaacaaataaattttccccgctttcaatccatcaccattgtgcaatcctgaaagcttgaacattcttggtacctttaactggatgccttcctttgtgtagtctcctttttaagcctgtaaggaatttaacactttgtttaatagacttctttaaaaatatgctcatgttttgttggactttgagtgatctgttaattcccaggtaagcatttctgtgtgcacatgaagatgcataactcatacctatttttgtggactcttgggcatttcatacagttctctgcagatagtaaggcactcaatacgtctttgcctaactagcttagcagtgtagtgatgggtttatattaattaataacaggtcgggcatggtggctcgtgcctctattcccagcactttgggagactgaggcaggcagatcgtttgaggtcaggagttcgagaccagcctgaccaacatggtgaaaccacgtctttagtaaaaatacaaaaaaattagccagtcatggtggtgcccacctgcaatctcagttactttgggaggctgaggcaggagaatagcttggatccgggagaaggaggttgcagtgagccgacattgcaccactgcactccagcctaggcaacagagtgagactcttatctcaaaaaaaaaaaaaaaaaaaagataaataacaagtgtgagctggtatagacaaactggtttagaatcaaaagacctgggtcagagtccacgctgtgtctcgtacagattgtgtgatattggcaagtcattggacatccttgaacctcagtttcctcaaatcagaagtgagaatcattttaaaaaggttgccaggaggatcagatatgaaagtgctttgtaaactggaaatccttcctctgtggtagggaagcttgccattgaaaacccatccaagcattctgaggcctggggtacatgatctgtacccagtctatgctgttgtttcccctgtactgtgtgtctgtaagatatgggtgtattattaagtgagctctggtggctgccttaagccctctgtgtacttgggtctctgtggatggagttgttcatgtgaaaataactgatgggctgtaggtcacagacctgctctttgagcctagtgtggacctgcaatgagcagactttttgtccttggtgcagaaatagcctctgacttgggagagaggggcagagtggccaaatcctgctgtcttacttcttcaattggtttctataatagcttctctaaggtagggagtgctatggttaagaacttgggctttgtagtaaagcagaagtgggtttgaatcccactgctagcacatatttggtgtttgggcttgagaaagttacttggttcctctaaccttccgttttaccatctgtaatttggggataataagaatatctacctcacagggctattttgaggaataaatgagtgaagcatgtaatatgcttagcatagttcctggtgtacccagtaagtgcttcataaatggtgtgtactattgttattattgtttatgatgattccagtgggtcctttcaactttgcattgacaaaggatagtccctagtcaatcataggatatgggaacaacggaaattccactttttaaccattactctggactctgtctgcaaagatgatgattggatcttgttcatttctgcattctcagggctgaggctagtgcattggccagtgagcaggcactgaatacagggcagagaacttgaactggccgtgtgaccattgcttcacggtgatctaaaatgctttccctaaacatacacacaacacctaactcattagatgagttgttgaagtgggtttagcctgctgttgcagtctcaaaactccatcagtgggtgccagagttgacacaatcaaaatatttcttgaggaaagaataattagcaaaagtgagtgttcctcaattagggcctgagggttctggtgctttgattatttccaactactcatcactaggctggatcccaagtggaatacttgggtgggcttctgtgtgcttagccctaatgagtgtggcagtacatctggtacatgcctgagttctaagtggtgaagaagtctgtaacttagcaattgcacagttaagtagctgcctctggagagtggatggaatcaagaaaagggcccagaaatctctgcataaggtactgcaagaatgcctcttgagaacttttggaaatttggttggtatgtgttctacaagttcagttgcttgtttgtgtgtttgcctaaccatgcagtttctgctgccttgttttacttatatgctgcttatataatccccctgaataggcaattgtggtaaagtgtaaaaggcgtgagatctagattaggcagctaaaatatcaaatcatagccctgtttaattgactgtgattctgggcatgttgtttagcctctctgagcttgtttctgtctgttaacaattagaataataatgcttatgttccagtgtgattgtgaaaagtcatgggataacataggtgaatgacctatctaaatgtctggcagtctcaggcttaatactaggtgtaatggattgtgcagaaaagagttagcagagtaggcctgactgctatctgttgacatggttgggccttggctggcatctgggaattcgtctttcaggagggtttccaccattctttaattgataaagtgtctcttggtgcctaagccatttgtacaaacactgtcatttttaccaaacacctgctttcctctggggtttttgacattttggtatgtgcttggcagaaagtgtctacatgaccaactctctccaaaaacccttggcactgagtctaatgagcttccctagtagatgacatttcccatgtgttgtcacaacttgttgctgtgagaatttagcatgttttacgtgactttactgggagaggactcttggaggctctcacctggttcttcctggactttacctcatgtgctttttccctaggctggttttgctttgtatccttttgttgtaataaattatagttgtgagtgcaacaatttgttaaatccactgagtcttcctagcagattattgaacctgggcttgatcttgagaacctaacacattgatacagatttaaatgtagaacacatgtgttgcccttcagaacactcacactttactgcaaaggcatacagagtcatataatggactttagagactcagaacggggagggtgggggggcagggataaataactatacattagttacagtgtacactactcaggtgacaggtgcactaatatctcagaattcaccactatagaattcatccacgtaaccaaaagccacgtgtacaccaaaagctatttaaataaaaaaatatattgaaaaaacaacactcatacttcagatagaaagcccaacatgtaagcatataattacaatacaatgagtgatgttagtgcagagggcaagggtagccctgaagagtagccctggggatctgggagaggtttttggaagagttaacacttgttaaatcttgaaaggtaattagaagttaactatctgaagtgggaagaaaagagattatatacctttaaagtataacatgctcttctaaataattttagatttaactcaccgctttcttttttttagcattatttaattttattttgaaattttgacatgatgaaggacgtgataggactgatgaagacgtacagagacagaacccccatagggtggcagttgagtggatcactgtgcagatatgaaagtggaagtaaaaacaattctttgagcccccaaatattaggaattggcagtgatgcttttagcacctccatatactatcagtcattttaaacatctaagactcccattgcagaaacatggcacatagagtcaggaaactaaggttgtatagatatttgcaatctgtaactgtcctagtgtcaagcacaagaaattcagtaggtgcctcacataaccaagcactgatcattgataccaagaccagatatgtgatctaaattagcaaagacacactccatgctgctttgaaaagaattaccatagatattatgcttttacatgatcatctctttcagcaacaccaaattgctctatcacccttcaattcagatctccgcagtaaaatgtttttaaagcaatttgcagcatttcactttctgtggaccacaccctgcctggacagtcacttttacaatcatcactttcttatggagctaaacaggtgaggatcagccccaggatactagaatcttgaacaaatggatatatagccactctaaaattgcaggtaggctctttcactcccactaatacctacaagacattgcaaatagaaaggacagcaggactggccaaatctatctttggctttctaaagtcagtctcactgtgcactgctctctaccagagtaagactcaaggataaatgattttagtgaattaaagagtttttaaaaataaagtaatgaattaacaatttaaaaagaatgaatgagcagttttttttttctgccattcatctgagctcctgtgaaatagttccaatcaaggttctgcccagttaaaaggaggaagagacctcagaagttgtcttgacaggccggttgcagtggcttacacgtgtaatcccagtactttgggaggctgaggtgggaggatcacctgagatcaggagtttgagaccagccgggacaacatggcaaagccccatctctacaacaatacaaaaattagccaggcatgaggatgggtgcctgtaatcccagctactggggaggctgaggcaggagaactgtttgaacccgggaggcagaggttgcaactcactgctttctttacaagggtttaatgactctatgtttaatcattcatcaaacacgggttgagaactatgccttaaactactctacgttgtgtatcgggctccaataatgaacaggaatggtccctgctttcaaggagagtctggcagtttatgggttgacatggttggattttgaggaaaccatgatgcaaggtgatgcaagggacggggtgtaaggtaaagcattctgtgagagatgctatctaggcttaaggggaggtaactttctaccagcacaggagaaaggcgttccatgaagaggaaacagcatgtgcaaagtcccactggcaagagagacctgatttcttctgagaataataaatagttatgtggatctgcagaatggcagatgaaggggatttaaacaggtgctatattttgacaggtagtaaaatcaagcttgaggaaacagatgaaaggattaaatgagctgtattgaggaatgggaaagaaattggattaggacacatagtattagtacacaataatgttgttgagcatggttgaagacccaagtgaggttggacaatataactagtagtgccaggccatatgattccatgacatatgttctgccatgttgatctggagttagggggttgccaggtgggaaaaatggaaagaagaggcaaagttgttaagaatattcgtaaaataattattgaagtcagggaccatggtatccaagatggaagacaagtgtggcctgatcgatagacttaatggagacttcatagcctcctgactcttctagtttctaagttccagaagagtgagaataaaaggccgaggaaactagtgctcagaaagtaggctgcttcaatttaagatttcagagttgaactgttccaggtgagaacaaactctagtggtcaaagtgggtatgtaaaggtaaatatctttggagatgaagagagcaaggaactcagaggccggaagttggatatgttgtccacatgtgtgttgaagtcacctggggtgaaggtggggcttgtggccaagaggaaacttgggagtcaggtaccacagcccccagtgaatatgagaaggtgcctgtgaggcctaaggtgacagtgatgaggagagagagagagcactataattgcatagttgtgaacctcaaaggagaaaagatacatttcttacaatatgaagccattcttcttcctttgctatgttaagtggagtttgacttgggacagtctatgctttggcctttggatgtataccctttgaaatctgtacaacaaccaccaggacattcctctcactcctttcccctcatcttgggcgtttctcaccagtcttctggtgagaatttttttttttttttttttcacgtggtcccagcttgagtttactgagcctcctccaggctcagatatgtgcttgcctggagaaactgcttccaaaggccaagcagccctgcctttggagagctgcttttgttacttacaatagtgtttcccagagtgcattccatgaaaatattagtctttcaacatgctgaacaatgaaagaatccatggtcaaatcctgagaacatatgtccctcttttagagattcataaggtacattagtatataaagaacctaagagattttgcagtaagaaatcctttgtgtaacctagcattacccaaatgtattttaccactgaagccttttttcccacttactctccatcaatacccagtggatatacattggaaagtgctggtcaattataagaaaagaagtatgtggattttatttcccttgacctatggccatagaagaggtacatattgcaacactggtgtattttcactctactaaaatgagatcttactatgttcctgagtttaaatagcaagaattactacatttggttagaattaacacattaaaatagtttgtttagtctgtcattcttatgtttaagtggcaatattaggaaattaactaagagcatttcattttcctttggaagaattcccatagtcaagattagaatcttaaaatgaaaatatacatttttcaaagtcctcttgctcttattttaattaaaaatgacagcatagatttcaaactaatcacattatttgctcttaaggtagtgataagatttcttcacagatgtgtgcatatcattcataaaaatgacatacttggacttagatacatactttgtaaatgttaaaagacaaaagtactaagaaagcattttgtgaaactacaataaaatgagaaaaaattaagggaaattaccaacatgctctcttacataacaccttgattttgatagaagtgcagatcctaataacctagacattttaaaaagcaaaacaagcataaatatgaacataacaaaatagtgttgtatgttgccaaagtggtgcttggaggaagatacattactctagatgtttatgtcttaaagaaaggaaggccaaatataatgaattaagcttgcacctagatgctttctaataggaagaatgtcagaagccagaaatggtgggcagaggaagtagtaaacgtaaaaccagaaataaactagagaaaaagctattaaatactacatcttgtctttgaaaaaaatgaacaactgtttagctaactaaaaaaagagaaaacacaaattcattacattagtactgagacaggagatcagatgatgaatgtgaaagatttagaaatttgcagagaaacaataaccttctgtatgtgctaataaatcagatgaaccagagcagaaatgaatgacctcctgcaaaattatataaaactcgtgcaagcttaaacagaaaacatgaatagactggtagcaaaggaaggaataagaaaaataattaaagtcctatcataaaatccacacaaaccatgggtttttggctccaatagattaatagaaagaattcagacttctagagcaacgttgatcttttttatttttattttttgagacagggtcatgctctgtcacccaggctggagtgcactggcatgattatggctcaccgcagtcttgatctcctgggctcaaacagtcctcctacttcagcctcctgagtagctgggaatacaggcatatgccaccatgctcagctaatttttaaaattttctgtagagacagggtctccctatattgccccagttggtcttgaactcctggtctcaagagatcctccaatctcggcctcccgaagtgtgtgagccactgcacctagctctgttcatcatttttgactgcctactgtaaatttaatcctttgcacacacacacacacacacacacacacacacacacacacacccctctatattctaatccatacaacaattatatatgggtaccattagtaaaaccagtttacagctgatctaataggctcagaaaggttaaatggcttgcctgaatccctcagcaaataagtgatagagtggggatttgaacccagatttatctggctacaaagtttattatcttttcctatgctatactttctaccagaataaaaaaattctctcataaactgtttttaaatgttgaattgacactagtttacccaattcctaatttacattttgaggaaacatgatttcaatcctcaaattgggaaaaagtacaaaaaaaaagaaaattataggccaaccttatttatggatattcattcttcattaagaattataaatagaaaaatcattccacttacaaatttatctttaagtggcatttaatctaggagcacaggatacgatgataaaacaaaaattatgataatcatattaatacgaaaacgtaattaaaataatatttttaaatagatgttgaaaaagcatccaataaatgaaacaactattcttggataatttatttggcaacccaaaaacgagtatgattttcatatattttggtataaaatctaacactatttcatggggaaaagagaaagtccctatgaaaatagaaaaaattacagatgacaaaaataggactaaggctctaccattttttaacagtatagtagaaatttgagccataggcattaataaggaaaaagtaatgccatcagcaaagaaagccaaacctttcttaataggtctagcacctaccgtatgccaggcattgtgataggtactggggatacactccagaaagactgtgcatgtctaggacacagaagactatcaaatattagttggtataaatgagctcagcaatgtcatgtaattcaaagcaaattaacacatgtttttagttgcaaacaattgaagaatatagtgagtaagataattcatttgcaatggagacagaatacattaaatactttggcattaatttaatttgggacatgagatttatttaaataaaattatacaatcataatgggaagaataaaagacattaaataaatgaatggagagatgccttgttccagatgaaaagacaaaatataagaaagatgcaatattccctgagttaatatatagtgtcactacatgccaattaaagtcccagtgggttattttataagatgtgacaaattgctagcaaaatttgtatagaagaataaggaggcagaaatactaaatagtttaaaaattgttcatttgaagttatacttctgtcacatatttgttcaatcttttgttagttccttgttccctattcattcagttcttactactgtccccgcttcataaaaggtactccataaatattggttgaaagcagaaaggaatccttattgaaggactttgaaaatgggcttgagacggacaagtggctttctccgaaatgtcagagaatcgataaggtggaacatcagggacttgccctcattttaaacaaataaggcaggagtggtcacagtgagaaaggaagagactgttcctgggtctagtagtgtgtctgctgacattttcaagcaaataaaggatctgcctcctagccctctgcctggactttttctcagcatgtgtttgtgttacagatagggccatcatgacacttgggagctcgaactcatcattatcttcataaagaaatgtgagaattttgaacttgggccccagtctggtatctcctagctttcttttgctgctttgggtcttttcagacgcaagagatctgtcatcttttggggcctgtctctaatatgcaatctttctcaagtgccccttacaaaaaatgcctcttcctcctctgcacttatgcatgcagtagtttatttgttctacaaagggcctaaagaaggccatgctaacaagggtgggatttaggctgtcttctccctgttctccactgcatcagtttctgagctgggctggttatcagaatcacttgaggagccttaaaatacacatattcttgaccctggtgattcagatttagtagaactgaaagtgtaatatgtgatgaatatatcatatgatattataaattacattatattaaatatttcattatattattacatattatattaattacataaattacacacacacacatgtgtgtgtgtgtgtgtgtgtgtgtgtatgtgtgtatgtatgtgtatgtgtgtgtgtatatttccctgattattttgctgaagaaccaggtttgggaagaatgcctccatagcatcagccagagtagctgcacagaggagctcccccctcccccaccaccacatttattgaatgaagggattaaattaggaacaatgttcagactgattatagtgttgctatgccaaccgttgttgcaggtgctgaaatagactgcagaaggtctagtaaacacttaaaatgaaatggtccctgaccagcattgtcattattataactaatatttatagataattatttactagtttccattagaatgttaataccagagagcaccactctatctcctattgactgattagcacagtgcctcacacatagtaggcactcaaccatttatttaatgaacgaatgcaacgttttcattaattttcacaatgacattataaggtgggcaattttcatattatcatttcataaatgaggaagtcgaagcagactgacttgttcaaggtcatacagctagtgagcagttgacctgcagttttactccatgtctttgtcatgctaaagcagaggctatataggagaaagagcctttggactccattgactaggcagaggccagaccaggaagggcatggatgtagacagcaggcaccccagacaggatggcacaagcactggggagaacaattagcctcaaggtcttggaaaaaattcagagtatgagatccagagaaccaagtgggcctaggggattgtggtagtatataatgattggtgtcgtagttactgccgagagtatgcattctaggcctttagagattaggaaagaataagataggtatccaggcctttaggaactgggaaacagacagctttggacacagaaacaaaacaagaaacaagttactgggtttggaagatgaggcagggatctcactctaaggaagaaggataatcccggtaatgagaactagagtccaggaccagggcagcacctgcatccctggtcctgagcgtgatcctggtactgatgctgtttcttaagctcttgagtttcttaagcttctgggcaaattgttttccccatttgagcatagtccaggattcaggcttaggtagaataatgcctatgagtcctggctaaggaacatcagaagtggaaagagaggcagactcatgcagtgaaccaagaacctcccttaaactcaaaggagggtgaggttctaaagcgacatcagcctgttttcctagtgatgggatgtggttttgactcctggtatgccaggggttggtgggataatgattataagtatactcttaacccttgtattggcttacttgcccctgaaaggtggtcatatgtcaaagttaccaacatctgctcaagcacaatttcctaagtatgtgctgaaaaataagttaaggggtatttggcatgtcattctccttagcccttgtgactgccaagagtgctggccctgagttgcctgtggtggccagcagcctcagctgtttcccccagcatgccatgtacgattggcatgctgtactaagtgccatacatgaaaaaagttgggaaacattactggagccccattccttgttggcctcttcattactacactacaatgtcctcttccatttgtacaacaccagagtggtggttgtcaacccctttcctgcctcagacctttgagacacactaatccgccacaggtaaagatacctcacccagctctcattctcaagaggtgaagaccttgttctagatcttcccagggctggatatagttggagaaagtactccaggtggctctgaaaaaccttcttgtggaagggggtcatgctcctatctattgagaatcacacatcttagatggaagaacattttcactcctatgatcgcctcccttcctctgaccaggtggtgatatcatctccaaattgtgaataaggaaggtgaggcctaagttgctcaaggttctcacagtaagaaagtggaggaacctgtagtaacacctgggtatggtgctttttttctgcggcactgcaccctccattcctagtactaagattaatacctaagaagaaaatgatcaagtgaaaagccaaggtccatagccatgctagtagatggtgagtgaagtagtacctaagacacattggttgtggtgtcgcgagttggggattggccaaagttgggtgtggtgagctgaaatgaaggaggtaagccctttggacaggcaagaggacccagtggactgggatgtggctcagacaacagacccctggtgaagccattctcagagctgacatttgagtggagaaagatttggaaatagcttttgggcttgaggcttgcagggatgaaactgcccagcaggagcaggttgtactctcctgctgactttcttcagccacacctgtctactggagcacagctccctctagaggtcattattcttgccgacgggacatgactgtgacctcatctaagtgccaaggggattattgaatgctgactttgtgtgacattaaaaatacaggccagccaagcctgttcattgaagcaggatttatttggtaccattttccaggccatgccctgtgttctgggtactcagaatccacagatgaatgagccatcccacagagaagtcactgtcttgggtttcagacagatatttccagcccagtgtgattcgtactttgataggggcaggaactgagtgcaaagtggaggtggagaggaagggttagattcccgatttctttggagcactgacagggcaaaaggtctgggaaggtttcctaaaggaggggactcttgagctgaatttttaaaaatgagtaaggcttagccaagtagaaacaaaaggggaggacgttctatgggaagggtcagtgaacattttctgtaaagggccaaatagtaaatatgttaggctttgtgggccatacagtctctgttacaatgactcaactcggccttgtagtgcaaaaaccacaacagacaatatataaatacatgacctttactgttgtagccatggctgactgctgtcatgtaaagtataggtacatttatcatccctatttgactgtgaagaaatggagtctcacagcggtgaagtgacttgctgaaggccaaccagttgattgtgtgttaagcacctcatctgaacagatgaaacccaggcactggtagcaggggttgagggtgtacatgggatatggcatgtaggtgagctgcagtagatgggcatggactgagctgtgagaatctagaatggtcctagcactctggatctattttcaccctctatccttgtccgttccacctaccagactatccctttctaaggccttggctctgctgtagctgtgtgcttgtcagccatgaatcttcattcttactgtccccctaacacagggccaggcactgagcagatgcccagaccacgtctgcttaactgatttacctagcattcagttaagggctatgggtcctttaaataactctttttaatataactggtatcagattcttttgatatttccatttgttttaattgctgcaacttaatgttcataaaaactaagacatacaactttatggaactgcatcacaaccataggaactgcatcacaacaatgggaactcttccagattatactggagcttccccaaagagaaaaaaaatagttttcattcttaactaattatttttaagtgaatggcaggtggaacactacaacatccataattttgcaagctgagaaagagctgaacgtctttttattgccaaaaaaattgctggtgttagtgacaacagtttttttctggatctgattgaagacatttatgaaaaatcagtcctaaatatgaatattcccataaggaaactgcttctaaggagacttaaaaatactcctgaagtcagatgtgtatcaatttctatttttgtgacttccccccttaacttccataattgattttaattgattgggtccttgttccatgtcgtgaacatttgggactcataattttgaaaaaaaattaaaagattttcttttggtttcatggacagaagcaaaaaacatatattatgtgattttggtaattggactcctgttttggaggctgagaatgtttgctgtctatgcagctgggatgggagttagcagtcgcaccctcttcctaggggaaccatgtgagagagctcccatttggaagcctaggctggttgtactcatcctcaggccaccctcagcctgctttcttccccaaatcctggtttacttctgtggaacatttgtctttcttacttgattatgttaataatagcaactgctcattgagtaccaactctggactgcactccatagagatgcttttgattgagcctcacaaaaaccttacggggaacttattgttatttccacttttccagatgaggaaactgaggtgaggtaacctgtctaggttgactcagagtggaagctagagagctttgatcagaccccagaattgtctaattccaggatctgctgttttcatttcagtggtcagcccacatgtggagagaagttcctatgctcacttgtaggccctgtgttgcaaggcgggtatgatctggacatcaaaagtagtgtatgaggatggagagggtctgggagtcaagacctgtgagggcactgaagggactggatgatgtttatcctgaagaagaaaagacttagagggaagtgagagctaaattcccatatctgatgggccttagttgtgaaaagatttctacgttcattcatacaatgtcttacttgcctcctattatcccgttgttgagggagagattcatgtcatggggttatgtggatggctgaacacatgacgtctgtcactgaacagacaagactgacagcagtttattagccacatatactcacatcccagggacgagggcactacatttcatgcaaggacacatgggggttcactggtgaacaaagagaaactcctgaagaaattgaagcagcagggtctgtgggaggcaggctttgtagtgtcaagagagtggggttccccgttccctgggaagatgtgattggtcggtttgaataactccacactctggcagggaactgaaactccctactcgtatataggcaacaattgtgcctcgtccccttgttaaggaggattgtttggctaggggaccttatctacaagagtagagtgggaaagagaacttgtggttatggcattcaaggccctcctaattttaccacctgcgaaggcagcacataatactgggccttaatttaggacttagatcacatatattcaacacattgttattcaacacattgttattcaacacctgctgtgtgcttagtaccattcttagtggggaggatacagtggtgaacaagacaaagtgcctgccttcatggagctgacattctaatacagaagacacacaataaacaagtatataataccaagttgtgataagtgctttaaaagaaaaaaagaagggaatagtgcctagagtgctgttttagttatggaagtcctctccaaggaggtgacatttaaactgagacctagatatggtgagtgagccattgaacaactggacaagagcatgcctgggagagagaagagtaagtacaaagcatctgtgctcaagatctgcttgttgtacctgaggaccagcaaggaggccatcatggcgggagtgagggggaaggtggcaggagacaaggtttaagagataggcagaggccagatcttgtagggtcttgtaagccatggtaagaacgcgagcatttttaaaaaaatacaataagaagcttttagaaggttttgagccaggaagtgacatgatttgacttatgtttttaaaggatcagtcgatgttcttttgagaataaacttgtgggaggcagaggtgggaacaggaacactgtcctactccaggggaaagctggtggtggcttggacttgggtggaggtggtgagaagttattactttagggcagtggttctcaacgggggtgattttgctcccgccaccctggaacatttggcaatatctggaggcattttttattgtcataatgtgggtgcagggttgctacaggtgtctagtgggtgtaggtcagcgatgttgctaaacattctacagtgcacaggacggcctctcacaacaaagaattatgtggctcaaaatatcaatagtgcctaagttagacaaacctaccctagagatacacacatattttgatgatagagtttgcaagatttgctgatggattggatgcaggtgtgggagtaaggaggagtcaagaatggtcccaaaaagtttggtctgagggactgagtaaatgccagtccttttactaagatgaagaagtcttaggggaaaggtttggatgggagtaatcaagaattcaatgttgaattttgagaagcctgttatatatctaaagattccttagaggagaataagaaggagtagccaaggaggaagaatgtgaatcaaaagagtgctggttacagaagccatgtatagaaaagatttcacgtgtcaaatgccacagaaaggttgaataagatgagtgagaattgcctattggatttggcaatgtggagatcattggtaatcatggtaagtatggtgccagtggagtggtagagatgaaaacctgcttggagcaggttcttgaatgagaatccacctccttatgatttctgtctaacagctttacttctatgtgttctggaatagcacagagaaacttgcacttacaaatatgatatttactcctcaaaataacttcacaccatgattaccatccccaattatagagaagggaattgaggtcttgtattaatcctgtcttttattttctgtattctgatgctttggcatcttggggccttactgaccctgaagggaccacccctcctggtgttagccacttgttagagatggaaaacaattcagtttgagtgtcttttcttatgcaaaccaagcaatacaaagcctataccccagctgccttcattatcagaatctcatggtctgtgtcactatcttcttgcctaatcactgcagggctaggtaccagataactagggacagactttttaccccagagtccacaaaattattcaaactagccgatcctaagcttgcttaccttgccttacccgtgtcttcctgcagaaaccacaataaatgctcttgctcacattttctctcacatcctctgtctcctgactggccttggtgcttccccacatggccctatgtggtgtggtgtgcctcctgcttctagggacctttgagtagtatactaaacccctttcttctgacagtcatttccatgtctgtatacccgattaaatacctgattaaaacaagtcctcagtttggggtggtgactcatatctataatcctagcactttggtaggccaagacgggaggatcacttgcacccaggagtttgagaccagcctaagcaaaatagccccatctctataaaaaagaaaaaaaatagccaggcatggtggcacatgcctgttgtcccagctactcaggaagctggcaggaagagagtttgagcacaggagttggaggctgcagtgagccatgatcttgccactgtgctccagcctggatgacagagttagaccctaaatcaaatatttggtaccattaaacatgactagaaggatgactactttgctcacgatcgtataggtagtgatggagcaacttctgaaatccaaatctccaaaattaagatgcatgctctttcttttaccctgtaaaatttgcttattttacaaatggtgtggagatacaggtctcaagaaaacactataaacatttaaatcctgtctgatcttttcataaagaatgagaattgctaacattttgtgacaagctctattgaggaatagaaagaaatgtaataaattataatgatgtcagaatcataacattggaagcccttaggggaaatgtaaacaacaataaatgattataggcttctccccataccactttctactatattaagtggtcctattgcatgcagagagtcatccttacttgtcagcagagtgccacctgaaattattcgcgagtgaggtcataattgtacgtttatggtttaagaatgagtaacatgcttgttattttctctgcctcctctgccttcattattcatctgtatttcaatagtgaatctggttgtcactttaggcctgacttcagtctgcggctaaggaggcagggacttaagtcctctggctggcccacagcccacagtgcctgaaggcgtaggaagcccaggctctgaagctatccatgggacatgtcccaaactaattgaggtcagttcccatatagacctggggggaaacctgttgggggcctttagcagtgtggcttgaaaatacttttccttgggctcaaacctactgtttctggtgggtggtttaataatggacccagcttgggaggccccagacagcttatcactggttaggggtcatagtgtagaggttaagaccactgaccgtggagccagactgagtggattccaatcctagctcctcttccttttggctttgggacctcgggcaagttatttaacatctctgagcctcagtttcctcagctataaaaatagaaattatggtacctaccccatggggttgatgcatggattaagtgagttagtatacaagaggtaatacaatacagtgattaggaagacaagggacagcatgggagcaacattgcttaagttcataaactggctcaaccactaactagttgttattagtctgtttcacactgctataaagatactacttgagactgggtaatttacaaaggaaagaagtttaattgactcagagttccccatggctggggaggcctcgagaaacttacagtcttggcagaaggctatggggaagcaaggcatgtcttacatggcagcaggagagacagcgagtgagctcaggggaaatggcagacacttatcaaacaaccagatctcctgagaactccctcaatatcatgagaacggcatgggggaaactgcccccatgatccgatcatctcccaccaggtctcttcctctgggaattacaatttgagatgagatttgggtggggacacagagccaaaccatatcactagttgtgggacctttgtcaagtgccttcacctctttgtgctccacttgcctcatctgtaaaatggggatgatgatgataatagggatgttgctaggattaaataagttaacctatgttaagcaattaaaagagtgcctgctttatggaaggactatttaaagtctgctgtcattactattaatttatatcattaacaaaggtaacatggaccacaagagttacagaccctgtgtatttcagagttcagagaaacaagggagctcagagagctgggaactcaagagaggcatcacagagcaggcaggccctaggaaccttgcatagcatgatggaaagcccttagccatgagcctacaagaactaagtttgaataccggctcagccacttgttagctgagtgaccttggacaacttatgtcacttcgctgtgcctctttctctgactacaaaatggagaggatgatagcacgtccttgggaggattatgtaaagtaatacagacaaagggcctagaatagtgcctggcacatggttagtactcagtaaatgaagatgttattcacgaattactactaagcctcatagttgtaatgaatacaaggagtaactctcattattattggcggactgcaagctcccagtgcgaaaggtaaataaggatttgggtaaataaggacttgggaggagaggtttaattcattaattaattaaagacagagtcttgctctgttgtccagacgggagtgcagtggcacaatcatagctcactacaaccttgaacctctgagctcctcccacctctgcctccagagtagctgggactacaggtgcatgccagcatgctcagctaattttttatttttattttttgtagagatggggttttgtgttggtggtctctatgttttgtaaagatggggtctctgtgttgcccagggtagtcttgaacttctggcttcaagggatcctcctgacttggcctcccacagcaccgggattacaggcatgagccagcacacctagctatttttttatttttatttttgtagaggtggggtctccatatgttgcccaggctggttttgaacttgtagccttaagtgattcttctcgcctagcctcccaaagctgagagggagaggtttagatactggcaaaggcaggaaggtgaaaagctctcagggagttctggtggtgatgaacagaccagtttgtatcctttaacaggtttctgaggagggagatttggtttaaggtagggagtgaagggcattggattccaaggtagggaatttattttttaatttctctagtgatagcctataaaccattgagtagaaggcataaagggttacagtaaggttctgttgttttgcttaaatgtcaaaagctataaaactacgatggatctggggcctccttttctgtctgtttcctcttttgtggagtctcctcatttcctaattcagagagttcctaacttatgatggtttgacttacaatttttcaactttataatggtgtgaaagcaatacgcatttagtaagctccttaacttatgatgaggttacgtctgcataaacccatagtaagttgaaaatattataacttgaaaaagcacttttgacttacaatattttcgacttatgttgactttattgggctgtaaccccattgtaagtagaggagaatctgtatgtacatttctataaaggggcaatctgctacttgcttttggccatggagaatgcctgctaccttttctatgaagtgttctctcatcatttaaactgccatatgtactcctcttctcctgtgttcccctataggactgtgcgaactgcagagattcttatcacagcatacctggtggaaaattcattcattacccactccatcccctaccagccttggagtccctagtggacctggactgtgccttgttcttgagatctccttatcccctacgcctagccccagcttagtgccttgtaccaaggagataatatgaagaggatagaatatgtgaggaagcatgaaagaggatccttcattgagcaaacaagtgggtagtgattgaggaaggacaggggactcactgtatgagtcctgagcaacagggaggtattaccccaggcatctgtgagatgtaatgtgtatgtggggagtggggtggtgaggtggatgatctcctctcttgtttagatagctgtgcttctcatttaaaactaatgatagtaacaggaattaacaggagagtgtgatatgtatttctggatagtagtgggtttcttggaaaatggaaggaacacctgcatcagttcctctgagaatacctggggactggagcagtgattttcacacttttaatgtagcaggaccctttaagtgaaattttaagctaagcccaatagatgcctacatgcatggatggatagatagataaaaagataggtccaatatatagatgacagatagataagaatgaccttggataagacacacatccctggaccttgatctcctctgtaccataaagtatagagcttaattgagatttctgaactgctgatattttggatttgttaatttttttgctgtgtaggaccgtcatgtgcattgtaagatggttagcagtaatcctggcctctaccaactctacaccagcagcacctccctttccagttgtgacaaataaaaatgcctccagatattgcccatatgttttctgttgggaggtacaaaattacccccagttgagaaccactgggttaagtggtctctggtgccttccttttttttacttgagtgattactcctaaaaggcctttagcacagtgtctggcacatcttaagttctcagttaatggtagttgataatactgttatatgcttcccttcagtagtattgatagcttggctattcctcatgtcatactgtgactgatatttttaatgttcaacttggtagcacagcgcatcttagaaagccaagtgggctgctttactttcttgttagcagtccccagggaagtatagtcatcagtaatcaggtggttgctatggcggagatgggaacatggtcaccctgtaccattctccctcctgctgtatgttcttcaatttggcctttccttccctcactaatattccccctggtgttcttttctctttttctggtgaacatgacacagtgctaaatggatttttttccccccgctctcctttttcttttcttcaccaacttgaaggagcaggattcaaccttcagcacaacttccagagtgtttccatggaaagacaattaaaatgagcttttaggtttgcaatgagaagggatatttgcttttttcatattaatattcatattttctcaagattcaaaaaatgccaaaacaatattcatgggaagaattcaactactagaaaagacaaagctataatagaattattatagtctgtaatatgttaattacccaaaacaagttggtctttgggataaattagaaatatttgctcctgcatttctttttgacttagaaggaaaaataccaatggaaataaagtatgccagaaatgagcaaaataaattaagaatactaaacctgatgtcataaaatgaacatcccactatgttggaatttatacatttttaatgaaaattagcaatgatcactcattgtatatttcttggtaagatttaaaagtagcccacaataagggtcgggttgcttttagttttctattgaaatcaagacataggttttgtatgacatgcttgaactgaacatttgggaacacttccctttagtctcctgcatagagtctggcgcctagtaggtgctcaataaaatttgttgaactgtattcacagaagtgatcctggagatctatgtatttactcattgagctaaagagcccttcatgattccaaaaacgggagtggcctggtgtacccattatatatcaggtattatccaagacatttgaatcactcatgtgaaaatatttattaagcttctattatgtgccaggcacatgctacaagatggtgaaccaaacatacagtctctgtagtcatggagttcacgtttctagttgagaagacaaacaacggaacaatagaacactgaaagaaaatgaacaattattgaaagctgttgagaaatgtatgaagaaaataaatatttgacctgagaatttgtatcagaaagtcattcaactctagataacagaaatctttcgaagtagtagcttaaatatgtttccttcaagtgaaagatgtctggaggtgagcattccagggtagatatggtagttccaggatatcaggacacaggctccttctggctttctgttttccagagttggaatggggctctcatccttaaagtcactttttggtccaagatgcctgctggccttccagtcaggaaggaggaggatggcgatgtggacgcaaaatggcttgcttaccatataattcagtccttttgaagagcaatccttggaagcctcacctagtgattgtcttttacatatcagttagaaaagaggataggacatgctatctgttagccagatatgtagtcacactgaataaaatgggagctttgttagtaagaaagaaggcagatatggatgttggataatcaactagcagatttgaaacagactggaaggatataaagagtaggactgcatggtaacatttactgagatggggaaggctgggaggaatgggtttagaggaacggcaagagttccatttaggacacattaattttaagatggctgtgagacttccagttgagttttcaggttgacataccactaccttacttctcctgtcaaccccaggttttcataaaagaaggacttatgattgaaagggagagctcagagacttaacatgaaaatgtatctgtataatacatacacttttatcttaaattgtattttaggtatttctaaaaatctcaaagttttctatagtttcttctttcttccagaactgtctaataagcatttagtataagtaaagcactgttataggttttggggatatatatttagaacaaaataaagatctctttcctgatgtagagcattctagtgaggcagacagacaagaaataattaacataaaaataaatagattagttaagtcatcatttatataatattgagaaaacatcatgagcactaactatcattatggatttttattgtgctcagtttcttcactgatgtccttattgaactctcatatcagtcctatgaggcagacttttttttcctcgttgaacagatgaggaaacaggctcagagaagttggataagtccaatgccttgcccatgtgttatctcctccaggaaagcttcctgtttaagtgtttcttccactcacaagccagtgagatcttcatgggcagctactgattgtactgagtttgatagtcctatcccctgacctggaacctggcatatagtcaatgctcagtaaatgtccaattgttgaacacaactggcctacctagtttacacacctagcgtttatttgtcagagccaggatttgagtctatccgtgtgtttgaacagttgcctcctgattcatgtattttgtacatctagattttaggtaattgtattttcagaagcagaaccagttctcttttttgcataatggagcttgcttactttaaggcaaaataactcagatcctccaaggcaaatcattctaaacaaagggcattttttcatgagcttgaattttcccattccctttagcaagccagcttccggttaaccaggccctgaggccttagaaggagacctgagctctctgttttactcagagtagctcatgatgaagtcacttgatgacttgccatcgaaggctgtaaagacattaattattgaaattaagtgggtgttaagagaatccgaagtcacttttgctttgcctagagacaccggagaatctgagaatattggagccagaatctgagaatattggagccagaagggcgcttagtcatccttgtttcagtcttcctcattttccggaagaggaagtagagattcagagtggcaacaggcacttggccaagtcaagcatttagtggcctcaccatctgcctcccactccagtgctctttctattctatcatgctaccacttattcaacaattaaaaggtattctcatcatgtataaggaattgtgaacggacttttactaaagggtaaagaggtgatttgttaaaatgtaaccacgtattttaagtgataagccaagtataatccacccccaacctggtttgaaataacaacatttgtgattgaatattgaatgattattttttagtagtgtttttctatctttgtgttacctgctaccattgcagaatacacaaagagggagtatacttttctttttaattcctgaagaaacattaataattctagcaaggtgggaatgtgctgtagccaagaggtcataggctttggtgtcaggtggcctgtttttaagtcatggcttcacagtctactagccttgtgagcctttggtaagaaccttcttggagctgttggagaacctggcaggtgtaggtacatacacttgaagaatatgagaaggggtggtggagagacagatgatgggttgatctggagctcttgaatgcgactgaatcccacgaggtctctgtggctgaatctagacagggattttgataatttggagcactgttgatagacacagcctccagttggcattggttgtgaacatttacccttttgttttcatgacttagtgtcttggcactactcaaaaagccactttaattttattttctggaatagaacctggtctaaatgaaaacacacacacacacacacacacacacacacacacacacacacacacactacataatcaagtaattaattcactaaataaatattgtgcttactatgtatgaggcactgttccaggtcctggagatgcattctaatggaatgatgtgaaacacaggtaaagaaaaggaagaggaaaataagcagaatgtatgaagaggaggatagcaatgaagatgcttgccatttatctggtgctccctatgggccagacattagccggtactgtgtatacattgtgtcactggattcttacaactggcctataaggcaggtattattatcatctccctcttacagtgcagaaactgagagctggtaaagcgaagcagcttgccaagggttatgtagctagtaagttgtagagcttggatttgagcccagttgtgactggatccagggcctaaggtcttggcaacattttatggggattaaaaaggactgctaatgggtgcaagcttttgtttctgggagacaataatatcttaaggttagactgtggtgatggtttcccagctgtgattttttatttaatatgaaaaatcattgaattgcatattttaaatgagtcaattgtatagtatatgaatggtatctcaatgttgttattacaaaaaaagcagggtaacttgatggttaatgattatggagagcctactatatgttgggcactgtgctaagagttttacaaatactattttatttcatctcacagcagccctgtgaagtaagtgtatcataacccccattttacggatgaggaaataaggactcagaaagattgagagacttgcccaggatcatgtacatagtaagtgtgggagccaggactcaatcccatgtttgtttgactttaaagattatgctttttctgtctttgtaaaataggaaagtgattgattttctttttggtatcaaataaatatggccctggtttttattggtcttagaatttatgaccatttctactactaaatggtcatggaataaaactttgcaatgtttctgccacatcactacccacatgttttatttttccacatagaaacagcccaggctgggggaggaggttgttcatccagcaatttaatgattaagttttaatctattaggcaaaaactaaggaataaaaaatgcttcatgtataaggaatttagaatagggaaaatatattaggtattcgttgtgctcattttccggcagtacagaagcattttattttaaatgtactgttcattttgggtgttatgttttgtttctcttatgtaaactttccccgtttatgagaagcagcagcgtgtgttttttctagaaatagatagcattcataaactgaaacagtttcattggggacattttctgtggcactgcaacagaactgtcttggcagaaatactggaatcctataaaatagagttaatattgatatgctttaatcaaaaatttctgtttagaagcaataaagttattcagtattaggcagcctcggttctatctttatccttactgctaaaacatcttcatctttagagtatgttgctataactatatatctccagattttctttccccagttctaaaagagaactcttaggagttgtgatgctactgaggatctcccagctttgcctcatcggggtggtatgcaattatatcccgtcctcttccatgtctgataacatgatcacgaagttcattttggtgcatcagttcctattgaacacctttgccagacgtgctgtgattggccagaggccgcttctcctcatggtcgcctgaaagtatgctgcatatacctgatctggctgttcccaccagctgggatgcatttactctccctccactctatctctgccttttgagatcttagccatctgtagcagtcaacattcatctgtaggtaccataagctaaaataggtattttagtgctgttaattaggtacttacaaaatctatggggtgggtggaagtgggggctttaggctgtgtctccaggaatgaaacctagaccaccaccacaaaactggccctccaaagggagctgcagctgcttttacgtgcagagaggtggggagttgggaagccaccactggaacgctagatttcaggacgcatagctgatgccgcagtccaaggggaagaagccaccaccactgctactgcaattgtctctcaacacctcaaaaataagtcactggatgctcaaatattgctgtgaatactccatgtctccacaactttgcttaccaggagtaaaaagctaaacagctggagacgtgggaagataatctttgccttactcttgtttataaaatatataggcacatgtattagtccattttcatgctgctgataaagacatacccgggtctgggaagaaaaataggtttaatgaactcacagttccacgtggctgggaaggcctcacaatcatggcagaaggcaaaaggcacttcttacatggcagcagcaagagagaatgagggagaagcaaagtggaaaccgcttataaaaccgtcagatctcgtgagacttattcactaccacaagagcagtatgaggggaaaccgcccccgtgattcaattatcttccaccgggtccctcggtgggaattattggagtacacgtgggaattattggagtacaattcaagatgacatttgggtggggacacagccaaaccatatcagcatataaaaatgaaagatatatatatctttttatgttttatatatatacattttatatacatttatatatacattatatgtacataagatgcatgtacacatctatttatagtatacgaatataaaatacataaatatttgaaatataaatatatttacataaaaacaaaaatatatgtagcttattatgttccaggcagtggtctacaaaattgttcccattttttagatgaggaaactgaggcacagagaaattaagtaacctgcacagattgtaagcatcttcttctatgagacacattttattccatccagcagtgttttgcccagatgctcagtaagtatttggtgaattaattgaaaataggtgtgtgccattggtaaatgatcttttcctcttcgaggctgggtcttcctttgagaaatgaagggcttggactcaatgatctctaaattctttccagtttatatccctaaggtctccttaggttgatttgtatagggcaccctaaagaagagctactgttatggttctctaattatgtgccaggctctgttctaagcatttaacatgcattgtttcacttgagcctctcaacagccaggtgaagaagttttggtcattattcactactgtttcagatgtgaagaaatgggtgctcagaaaaaagtgatggctggtctgtggtcgctccgctggtgagtggctgagctcaaatgccaaatcgtgtctgcctgactttaagcccatactcttaatagccgagaaagccctagttttctcaaagagaatgacatctagggcatgcatttgtcttcccttccttttctcctgccatgtcttctttttcattttcgtcatcatccaaaaacatactgcagatactttggcatacattttatgattctcatcccctttgctggtaataaagtgcttactccacatgtgacatgtgttgacatctgagagcattttttgttgctgagttggttgttaataaacactaatgagttggtcgcatctcccagagcaaggacagataccacaggaacaggttttaatacctgtcaagagaatacaaagtagaaaactttattgtggtgccctcaccatattgtcctggttcttccttgcattcattatttaatactttttattttataaaacttgcttatttttgtgataaaatattctcactctttaaacaacataactatatgtcattgctgttttaaaaatccatgtgtactttgcagccataaaaaggaacgagagcatgtcctttgcaggtacatggatggagctggaagccattatcctcagcaaagtagcacaggaacagaaaatcaaacatcgcatgtgctcacttataagtgggagcggaacaatgagaacacatggacacagggaggggaacaacacacactggggcctgttggggggtggggttgggggagggagagcatttggaaaaatagctagtgcatgctgggcttaatataataccttggtgatgggttgatctgtgcagcaaaccaccatggcacacatttacgtatgtaacaaacctacacatcctgctcatgtaccccagaacttaaaataaaagttaaaattaaaaaaaatatatatataaaaatccatgcatacaacacagaatgagaacttcgaatacacactagagggtattaaccatggttgtctataggtagtacagctacgacatattttagttgattttattttctcatgtatattctgagatttttctgtcatgggcttgtatgacttttgtaagaatgataaagtaaaatgttgaccatggtcttaattggtatcttcttatagctgagtctcttacgttttttcctctgtgcctctgcctcccagtcaatcagacacagcactcttctatgtcagctgcccgggcagagctggggtttcgagacattagggttgcatcagatgcctgactaaggcatttataagactgcccatagcttagaacttccagtgatctggaccctctaaatttgggactgttgacctttggaatatattttcttacataggtttctgtgtcttatttgatgtggaaacaacaagaaatccgtaccttactgagatctataactcacgagggacttcaaaactgcattatgtcaaaggcaaacagtgttccatcattgaaaatacaattatgaaaaatgataactaacttctgagtggtactttttagagtttacatgggctcttcacttccatcatctcatttggtcttcacagtcttcctggtgggtaggataggattatttcattttaaaggtgagaaaactgaagcctgatatggacagctagggagtggcagagccaagacttgaatccacattttttttttctttttttacttttgctgcttcactacagtattttcatgaattaattgaaataatcctagatatccaataaaaccatcactaccgccactgctgcctctcctctcctcttccttctcatcattgtgatcatcaccatcatcttttccttctgttcaatatccttctgtcagttaatattttatattttgagggtctgaatatccgatcatgaactagtctcataatccaagaggggtcaaagtcatccctcttgcatcttcttctctccctttcctccctctctcctttccctcctttcctccatatttctctcattcttcagttactttcataaatatttattttgaactgttcttcacaatattcacttagccctggcagatggcctgagaggtcagctttcataacctgatccttctcttttcagcaatgaaggatgaatatttcaggatcagcatattttatcaatgacctaaggctttctgattactttccatctgtggggtctacttcattttgttgcctgggctatttaaaaggtttcttgcatgtagtgtattcatgataaataaccagttgcttttgtttcagggaaagccatcttaaaggagcaagtcacaatatgcttctactctcacaaccataattttaggcattaacttactctataagcattattaccaggggccaggtgcctcttataatagtggctagcatgttgccactcttcatcacacgttatcatacttgtcaatttacttgttcacacccctcctccctactttattgtgtactccttaaggacaggactgtgtcttaatcacttttatatccccagggtctcatacatattaaaagtatgaaacaatgaaaaaaaaatagcatagctttggcacaaaggataattacaagcttctgaagccttccggagatatccggaggctcgctttcctcatctgttcagtgggggtaatagtggccttacagagatgctgatcagacactcttgctttcttccccctagtttcttagaatcttcttggtctcctctctggccctcatggcactggttgcataggcaaatctagactcttacacacttggctatgaagagtttaaaacccctttgtaaagaatgtcaaaactacatttgaactttatgtagtattttcattggtacatttggaatcctaactagatcttagaagtcactgtctttgctcacatattctctgagcttaagcacaagaaaatgattcattaaaatatttaaatcagctactagaaacaataatgaggataaacatctcggaggcccaaatccattattctgtgctcccattccatctgtgaaggctggtactctatccagcactaaaaatttataaatgcagggtcagtaagaccatagtcagcaggaaattgcaaaactctgggctcctgcaagcaaagcccaacttttcttcagaaattcatgacattggaatggaacaaaactatgcagaaggtatagtgacaagagtaacactgaactttaaacgccaactctgtggctgcccagctggatggccttgggtaagtcacccaacttttctgtggctctgttgagtcatttgacaaatgagcataatcaatcttgactgcctctgtggagttgccaggaggcttaagggcgcctctgtgtgtggaatgtgctctgtcagctggaagatgcctgtcatgtacatgggagggactcattttaggatggctactcagagatttttgcattagaagcacaggtttgctttagcctcagtttgcaaatgtacaggattagcattcccatgcagtgtcactctatctctggaatgctgctattgccaacagaagtcaaccaaatgcctctccacaatctgtatcaagcataccatatgtttttacacaatggaagtgatcttaaagaattgaataatattttcttgagggaagtttactttttgcaggaaacctgtgatgaattatttggtaagagaaaaaagccctattgtaatctcttctaatctatcaattctaaaagtttaggttcttttatgtaattttttctagacatgccagccaggaatgcattctaaagtattgtagtgttaacataatgtattctaaaaagatgatgatgtcatttagatatctactaaataaatagtgaatatttagtaatagtgctgataattacttgtttattgtttgcttactatgtgtcccaacctgtgctagttgctttatatgccccatcttattggatcctcactatttaacagatgaagaaactatgtctttaagaggttaagtcatgtatctgatgtttgagagcaggccaaataccagtgtgatggtttacatccaggcctgcctgacttcaggataggagttcgtgagcatgaaggtagattctggtagtttatattctatagaatttggaacctgcatcatgaggtcagacgagaacataaagaatcttaggttgcaaccagaagaggactctgtggtctagaaagaaaaaaaaattccctgagttattaaaaaagttagtggaaaggcctaggttcccactcagcacctgttcctccataccacattgtgtctgctacacacagcacctcatggtctatagatgtcaattgtagcatggccattgagggtatggaatgaattgtaaacaggccttatctttcaaagcatccagcagccctgagttccacgactctttatacctgaggtgagagttggccagatagggaattgatcctatgtcctactgaaaaccagtgttggtattagcaatggtcttggtaaaatacaatgaagaagaataacgattttaaaatgaaaaaaaaaacttgaaagaaatggaaaattataaaggacacagttgcaggctcaatataacttaaattaggggttgacagactttctctgtaaaaggagtggagtttgactgaatgtttgtctcccctacaaattcatatgttaaaatctaaccctcaatgtgaaattattaggaagtgaggcatttgggaggtgattgagtcatgtggattgagccctcatgaatgggattaagtgcccttataggaatagagcagagagctagctccctgcctttccttcatgtgaggttacaaggggtagttgtttgttttcaacctaaaagagggccctcaccagaatctgatcacgttggtaccctgatcttcgtcttcaagcctccagaactgtgcgaaatacatttatggtgtttataagccacttagtctatggtactatgttatagcagcctgaacagactaagacagcctgtttatgactgctttgggatatgtattctctttttatctggcaggcaggaaatggccaagcctgagtaaaggcagagtagtccagtgctgcccaatattcctggttacctttgggtagccaaaggccacatttctctgagggtatttcttactgatagactggctattaagtttcactcttctgcttggaaacccagcttaaaagctattttgggcagtgaagttccatcagctaatatgtattccaatgacaatgacaagaagtcccagcctaggtttcatcaaataccaggccctacagactgctcctctgaatttaaagcttcaccctctctattattgtccatgtttgttcaaaagtatttatgaataatgataatgatgatcattatggctaacatttattgaagatctcctatgtgtcaggcattttacccaacattaatacatttttatcatccaattcttacaacaactctatgaggcagatactaccattgccgccattttgcagatgagaaacttgaggctcaaagaggctcagtgacttgttccaggtcactgttacttagtggccgaggcagatctgaagctcatgctgggtgataataaagtctgctgtttaccactctgccacactatcatccctgtttaaggttctagaaggcacaaggagcctgcctttctaaagcagacattatctccatcttcctttcagtctagttctgagaatgtgttctcacttctccctctcccatgttattcaattctcagtctcaggcctacagtaattcacacttggataactgcagtagctcttaactgtttcttttaaaaacaactatattgagatataattcacatatagtaccatacaattcacccatttaaggcatacaattcaatggttttagtatattcacagaattttgccaccattaccacagtcagttttagaacattaacatgtcaaaaaagaagcccaaacccttcagctatcatgccactatccctgttcactgtgacttccctccccaccagccctaagcaactgctaatctgctttctgtttgaatgaatttgcttattctggactttcataggtagacttataatatgtgtccttttgtgattggcttctttcacttagccttagtactgtttataattctcacatgtagcacgtatcagtacctcattccgtttgatgactgaataatattccattgtatggacatgctacattttgtttatccagccattagttgatggacatttgggttgtttccatcttttggacattatgaactaaccagcctcttaactagattctgcacagcactctcagattaattttctgaaagtacagctctcattatgtcttccctccaattagaagtcatcactggtttcttattgcctctaggacactgtttaaacttttgagtttggattttattgtgggaaagtgcaaggcatggagtgagcacttatactggggaaggaatggcaagggaactgtgctttactgagcccttgtccttaccctgccttatctcccaagatcctcaacacaaactctctcttatatttacatggatctaggcatcattcttcaaatatgtttctcattgtcttatctagactctgtttctcctccttgaaatgcctttctgttttatggctaagtcaggcccttctaaaccctgcttgtccatggagcctttccacgttgctgcggccttcagctagctctcccttccctttcatcccctaagcctctcaccgtctgtacggcccatttggccgtcagcatgtggggctgcacaatgagatggggctgcttttctatctcattttctttggtggattgggaacctcttgaggccagggatcaagtatgacttattatcatgatcattagtataagagtaatccctatcatttgtcctaggcattgttatgtgctgggtcttttactacatccttacatttgttaacaagaaaagacgtcagggtaggagctgttattccagtttcatcaaagaagaaacagactcagagatcctaaataacttatatttggtgtctcagcaagtaagtaatagagcttaggtctatctgatgccaaagtgcaatttccacaatgctgtgctgacaatgactttttttttgctcatcctgtcccttctcttcctcttcctcctttgtcatcacccagcatcattctcattttgcagatgaggaaattaaggttcgtacaagtttggtattttttccagagccacgttcatagtaagtaataaagcagggatgttaaaattaaaacttctgtctccaagcacaaatttattttccttaccatgatatttgtgtatgttggggcctcagcaggctgttttataataattatcatgctataaaacaatagggaggagaagattcacatacacaaacaactagaagaactataagatactgtattgtggtggggattataaatgtcatagaaattttgaaaaaagtcatgacaacttcttagatgaaggaaggctggtgctagaccttaaaggatgggtgaggttagccaagcacaaaggagagaggcaaagagaaggagagagacaaagacattcaagttttcttgtggagccattctcccagcccagtcctccacatcgactcaaattctctaagaaagagtgtagacgctggtcttaaccaccattgggacagctgttagaaggaaacaaatagttgcataatattgaaatggttgtgtggctttgtaatatgtttatatttatcaaagggaaaggcaaggacattatacaattcgatgaagtcctgatttaaaaatctgtattttcacttactacagtgtgaaaggggatagattgaggcctttatttattcgtttaattgcagacatatttaatatttattataaagattttatacttcctcaaattcaaatttttattttccaagtatgatagttcttttagtttttgtgaaaggcaaaataatacccaatccgtcgaatattctttttcaaaattgcaaatctgtttcacacgtaaaaatataataccaagtctgattataaaccacaaacaacaaaatgtgtttaaaaacaaatgctgtagttggaatagcagtaagataaatcacacaggtttttaggtatttgcagcagactattcagtagctgttggcttcaaggatgattaaaaagtagatttattgatttctaacgaaaccataatattaataatctgtggagggatagtagactattggctttttgccagaatggctttgaggagagtatggcctttggtactaatagcagcttctcagcagcagtcagaattgggtctctgagtccagtgcattaatggttcagcagcaaagttttttcagtactcaaatatgacttatgcccatcagtccctgatgaacttgttcaatttaaatgggcataagtcatatttgagtactggacacattcagagcatctcacccttacaaatgattgctcttcttgcttgattttttgtgtctttttgagatgctaagccatagcaactgcctttattcattcatggtatcacaggagaagagtagataatggatgatattaatagtatatccatttcttatacttgggccatggaaagtggaccacatagaaaaccacctacgggaccacgtaaggttagtgatcccgctttccctgttagaatacaagagattgcatccgtgaaccgaggccctgggaatgctgtgatgtcttcttgaatgtgatgcttggcttctgagcttttacttttcaagaaagtggtaattattacaaagcttttcacctttcttggctagtggaggaatcctatcatttgcaggtttccacatttttcaaaggaaaaacgctttttatcgtctttgttgtattgtagctccactgaagagttctcatcatggtcctttaaacgtaagtttttttttcagttggtagtctgcctttccctgagttgatcatcttttggggtttgggcttcagatcaaattcctagtgttgtttatagtcagtgctgcacagagcctctcattcttgttcatatctgcctattatcgtctctactcttctccttccctctctctttccctttctccatccttccctcctctctctctcccaccatctctccattcctctcacttttaagtgctaacatgttcttcctgaggtacatatttgatagctttacctcgcctccttaatctgctcgtgtgtccttggtttgtggcctgttgtacatggtaaagcaatgttccaagctggggccatctgctttgcaaattccaggtcatacctaatctttctgatgccatactattacaatgagttccagccccagagaagttattttgcctccctggcggttactgaacatgtgtttatgtgtgtgtgtgtgtgtgtgtgtgtgtgtgtgtgtgtgtgtgtgtgtttgctttccccagtaatgggaaggatgacccacatggccattgcattatttttggggttgtgggtgggccctgatcactttcaattctgcctctcagttgctgccaccagtatttcaggctatggttctggacttaactaatctaaaaataaatcgccatttttatgaccagaagtctactaatgtagcagttttcacaccttttaaggtttgttttgctttgttttcttctaacagtaattaaaaaaattctctctgaaatcttatgtaaagtttagtgtttcaaacaggtcaaattgtagttgctgtgcttgagatgttgatggagaattcagagttttccttcctcctccccacctcagctacagttctttggagcagactttgatatacccttggattggttctcttttctttcaattcataggtgagaaccagagacaaggacaggggagaggacagtaacataaaggctcaagggcagaaagttgaagtaccttgtgaccagggcctggtcattggtcctgcatgaagcaaaaggacaaccattgatcctacctacgtttgtcagtactctaacaactgtccagccagtattgaggcttagcaagtagagtttttgttttttctttccttttctttctttttttttttttttttttttgagatagaaacctcttcaccactattctctgcagccacaagcctcagacagaaccagttgtggatagcaactcgacaggttgccatgcttttaatagatagtttaagtaagttctgttcttataattaggttgttatttctaacttttattctatgtgaggctaggttagtcagacccagtaaatgcatatttgtttgattcatttggctacgttattttaggccatggctaagatgcgtgtgtccataggcagggagtggccagaggaagcaaaccgaggtgagatgagaccatcatttgtagccatgggggccataagagatcagctcccattttctcctagcaggggtacagagggagcaggctgtcaggaatgacgctctgtggcaaaggttgctaactcaggggagtcctcattgctagataggtgaagagtggctctgtcttgccttatttttgtttatttttgctgttcattcttttctttttaaattttagattcagtgggtacatgtgcagatttgttacatgggtatattgcatgatgttgagatttggggttctattgaacccatcacccaaatagtgaacatagtacttaataggtaatttttcaatctttgtccctctcccttcctcccctacttttggagtctccagtgcctattgttcccatctctgtgtttctgcgtacccagcgtttagcttccacttacaagtgacaacatgcagtattggttttctgtttggacattaatttgcttaggatgatggcctccagctgcatccatgttgctacaacaggcatgatttcatttctttttacggttgtgtagtattccatggtgtatatgtaccaatatatacatgatatatatgtaccaatccaccattgaagggcatctagtttgattccacgtctttactattatgaatagtgctgtgagaaatatacaagtgcatgtgtctttttggtagaattatttatttttccttgggtatatacccagtagggggattactgggtcaaatggtagttcgatttttagttctttcagaaatctcaccagtcagaatgaccattattaaaaagtcaaaaaacaaaacaaaacagatgtgctaccctattcagatccctctcgctctctccatccccttctgagctcagaggtgggggtcatgggcttcttctaagagccctaacctggcccatgctcgctgtcactgatctgtttcacacccttttctccctcgcctgaaatagtagagcataacactcatctttctgcctccaaactttttgtttgtgtgtgtgtgtgtttctaatgtttatggtgaaagatgcattcaaaaagtgcatatgacacatccatgaagattaaaaataattataatgaaaaaataaaatgaactcccatgtatttaccatatagcttgagaaatagagtgttacctatacttaaaagcctggctctggcaaccttgttaaattctcttaataaaattctaataatttgtaacattcttttattctatatagtcaatgatatcatctacaaataatgacacttttattgcttgctttctgatccctatgccatttactccattgttttgccttactgcactggttaagacctgtagtccaatgttgaatcagagtagtagacactcttcttttcttctagacttttaaatggaatactacaatattttattctgtgaatggatgttgacttttatcaaatgcatcttctgcgtcttttgagatgatcatatagtgtaatttatttatttttctctctcctttaaccctttttttttgccaccttttcctttaaattcagggagtacatgtgtaggtttgttacctgggtatattgtaggatgctgagggtttgggccatcctgaatgcacccgatctcatcctttaatcctttaaagcaagcttgtccagcctgtgggccatgagccacatgtggcccaggatggctttgaatgtggcctaacacaaattagtaaacttccttaaaacacgagattttttttgtgattttttttttaggtcatcagcaatcattagtcttagtgtattttatgtgtgtcccaagacaattcttcttctttcaatgtggcccaggaaagccaaaagactggacacccctgcattaaagcaatatggcactttacattcatagaacttttaaagtgaaacttaaattcctggatttaatctgagttggtcatgatttattttgttttctatacattgctggatttcatttcttaatattttatttagtatttttatatttatgatcacaagttatgctagtatatatttttcctttctcatgttattgtctattttggggtgacaaggtgagaatagctccataaaatgagttgggaaatattcttgtcttgttttctctggaagagttggtataagattggaattatctgtttctttaatatttagtaaaacttgactgatgtttgcttaatgggaagtttaaaaaaatttagtgcttataagaatgttcttgagtcaattaaaaaattttttttctactaatgtcgatatcttattgaaattgttaaatttatgggtgtaaagttactcatagcattgactgatcttttttattatctgctacatctgtagttatgacccttttaattctcaatattgtttatttgtgcctctgcttcttgtattactccttttatttcaaagtccacataattgctaaatcaatgttattaaacatgttattagtcatataattatcttcctcacttacaaatcacaggaggactttcagtgccctttatgatctagctccagcctagctttccatttacaaaacacaatttttctacttgtgattttgagttccagccacacaaaactagtgtacttctcctgatatattcttaactttcataacctggtacctttgtttatacccttctcaccattttgaccaccctttcctatatctttatcctttgaaatactcattgcttctcaaggctcatcgcaaattctacctgatccatgaattcccccagtttcccccagacagaatagataactcattctcctgtgtttccagcacacattccctcagactttttcatagcaagtattgtgttgttttattttaatgagttgcttacatgactgcaaactagtaggttgtgagcctcttgaaggcaaatccttgtctttttcatgcctacattctaaacacttagcaggggactactcagaatctgttcaattcaattggaatgaattaaagtggaattgaacaggcattcatactggagtaatgtgaagatttccttaccccccagaattcccccttcaccatctggctgaagtctgaaaatccactatttgaactccactaatttttcttattgtgtttctttcttgttaaaaatgctaactggtcttggaaagcagaggaggccctccctggcattgcaccctacccctcacagttttccctgttacctaacaaatggtagctttcctagatcttttcctgagagcagatatacaggcaggacatggaaaaggaacatccctaagggagaacaaagatgcagaaagtggtgggtacatatggttgttgttcttaatttagtatctactgtattccaagtattgtgccaagtcacatgtaatcttcacaccaaatcaaagagctgggttccattatcatctccagttttaaagatgagaaaactgagactcagataggtagaacaattaggccgaagccactcagcctgcaaatggaggagttgagattcaaagtgaagtctgatagactattattctactacccaagctatctcttctctatgacctcatctcaagacctcagctatttgtcaaacacctgttatgtgagtaacctctgcccggctccacactgttccacagtcagtttttcaggtatttattttagtggtcaaaagtgacctcatctctgctgattgatctctgaagctgctggaatgaggcaagaatgtgtgatgtgtgcaattcctttggctgcttcttgtccctacagcatcttactctgctccctgagcgagggcttttgggttttgaaaggatctggaactttttttcagaaacaagtctctgctttgtcaggtagttccaaccccatctgtaggatcttcctgaaggctgagcacaccaacatccagctgttggaaacaacagcttcctcaattaaagaagaggcagacaactatctgaaaggaagctgggaacaaaggttatcctcaggagattgctcaggaggccagccagagggcatgaatgtttggtgacagcatatatttgggggcaatttgtactttgctgtttcaagacagagctctgctggctaggagagcacattttttcttcccttactccactaattggcagcgccatttagggctgtcacagcaacagtcttacagatcttgtggtccagacccgtcactgtgtagataaaaagctaaagaccagaaaggaggagtgtctcatccagagtcacatagcagagtgggagtcaagcctgcatcaagactcaggacttttgatggaacgtcccaggctgggaaactttatttggccctcagtttagactaccctttttatcagttatcttttctatggaatatgttctttattttcagttagtccttaagtgccttgaagactgaaaacatattttgtaattgatttttggctctctaccatgatttgtacatataggggtttgttggtcaggtcagccctctcctcttctgactcttattaaacatgactcctattatctctgtatggccttgcccttgccactatgcagccctcaactgtatgcaactcctctcacctggatatggctcctaagtgtgctgaacctcagcttttccacagccagtagctccattagctctagttccttgaagtccattccaaactctgtttctaattcatgtaggtttgaaaacagtggttttgcattgtgtacatacagtttgtatagttttcttcactgaactttagaactacatgatagttcttcatgcagcaccattaacagagatatatagctctgtctaccatgttcataagatgcagagtaactcacttctcaatcttagttttctgggtcctgccacatttttaagaaaggaatcctctcttgggatattcatctaaaaaaacaaaaaggcactagagacggcctgtatgacaatgtgatatctgaaaggcatatcagatttgctagtcttttcttcattcacatttctgtattaggctgaggtgctatccctggcgtcctctaccaagcaaagtgactttggtcaagtcatttcattgctcccagtctcagatccttcatctgttgatagagataaaaaccctgaccatgaaatgttgggagaatctaataaagtaatgtctgccaaagcacttggacatgatgtattcagttctctgaatagtagcattacacttgttcgctattggagggctcagttatatggggggtgttgtgacagcagagatactgttgtactcttgcacgtgttcctaagcccagcgtcctgagtgctacccaacatgtgcatcttggctccatggaaatccagcaggctggaaccactagcatccccagtagactgaggccattagtagtcctgcccaagaagagcagcttgtaaaagtaataccccagtgtagattctgggatcacatcttcctttaacatccagaataatagatgaccaaatcctgaagtaagtttagagcccacttcactatctctggaagtttttagctctctagtgggaggtttgagtttatctctttttcttgagtcagttccatctgtcgcttgcttctccactgacccttggttcttctcgcaatagcagatgtttcaaagtatgtatgaccagctctgaaagcagcttccaaggaggagctgtctgaaagttgcatgcacaggcagggtagtaaattagaatcaggatgggacaaatttgaaggcaggaaatcacatggctgcgaaagctgaggtgtgattgtgacaactatccccagtctcctagaaccataccctccacctggtgtgttgcagaaagctgaccaactgactaattttacatctcttttcatagggatgattttgctcgccattggttctagtaaatagtgctccacaggtatttgcagcatgccccagtgctcatccctgtaaggctgatgcctccttctttattattcttttccctgctgatcactccaagctcttttgcttgcttgtggtggttccatttttagtctttgtgaaagttgttaaacagactttgttgtagtaagatttgagatgtgttctgttggtacagagatggctttactgagtattattgccttaccctaagatcagtaacttatcttagtggagaaagtcaaatccatctagtttatttttagcagatatcttcactgaatggtgggaggatagtgcagattgctctgagtaggtcaaaagtaaacatgcagtgccaaggactaatttctcttgtggggcttttggggttcttggaatgtctaagaacatggtggagaattaatcagggatctcctgccctttgcctcccagctacttttgaagcatttcgattggtaaatgctagtttctgaatgcacatatcaaattgccaagtagcgccgatcctgagaggcagatgccttttgttgtttgaggattggtgcagcaagaagctccaactagaagctaagacccagaaaagcagtggtcacagacaatgggatgcagttgttgatgtgatcacagtttaagggctgttgtttgaactggctggcttctgcctgtgcatcccacttcgatacttttctctgacaagaaagaaagcaatcagtaggaatgtgttgatgagatcataaaatttaagatttgagaatgttaaaaggtgttcaattatgccagagtttgaccaaatgcaggctggaatagaaggactgaataatcagaagctatttagtgagtcacatccttttagggagcaaaagtatctaaggaataagatgggtgtgagttgggactaggtattgcttcaggtcacctgggtgccattcagcaattaagcatagccttaatggaagagaagcaaaagtgtagctggcagccacccctcctttcctcttcccagggcatttctctatttcatttaggcaggcactcgatacctcttgcctgtatattgcaacagatagcctcctagctgttcttcagcttcccatgccttccttctctggcctcttctctttccagcatttaacataaagtggtgccaggtacctctttctaaggcttagttctatcagcttcgtcctgtactcagactacgacagctaaggaacagaatctcccctccctagcttcttgtccataggctttccaataaactgagcagcctatgcccctctgttctccttcatgtgcgctcatttccagcagaactagaccccttacctcttgctgaacacaccctgaagttttctgcctctgatatatagcagtttacctaaatgtatttctccttcttgtgattttacttgtcttttgtcagtatcatctattttactaagcttcttttgacaccctaacaccaaatgaaagggatttacttcctcagaactcacattgtctgtgtgattgaacttctctcctggcttaaattcatgtgctcatgacttgtttgtctctctcagtggacagtaagctccttgagggccaggacctgtgccagatgcatgattgtcacattttgcctctgggccctacagaacccatgataaatgttgtagtggccttaccccaccagactccaaagcttgcaaatactttgagatcctgtgggagatgataaactgcattgctccaaattaatattttcctgatcctctccctcctcccaccctctgcttgcagagcttgcaaatactttgagatcctgtgggagatgataaactgcattgctccccttctcaggacttcagctttctggactacaaatcagggggtttgccaagtttgcttttcaaggccttggctagttctaggattctgacccaagtttccaggaagggtttgtgtttgtttgtgctctacttagatcccaaattgttcctctgcagcatgggcttttgttacctttgcttccttctttagacaaagagagagagcaagagatagcctctgctttttttgcatcttgacaccccagttctctcaatatttccagtgcctttctaatttataaccctggaaaccaagaatacactgtacacagtctttttttttttttttttttttttgagacagggtctccctctttcacccaggctggagtacagtgacatgaacatggctcactgaagcctcaacctcccgggctcaaacaatcctgctgcctcacttccccaagcctgctgggactgcagccgtgcactagcacacccggctaatttttgtaatttttgtagagatggggttttgccatgttgccaagactggtcttgaattcctgagctcaagtgatctgccccaccccagcctcccaaagtgttgggattacaggcgtgagccaccacactcggccttagatgcagtctcaatgcacgtttaacagcacacactggggcctatcggagggcagagggtgggaggagggagaggatcaggaaaatattaataactaattggtattaagcttactacctgagtgatgagataatctctacaacaaacccccatgacacaagtttacctatgtaacagacctgaaatgtacccgtgaatttaaaataagagtttgaaaaaaacacattgggtattgcttactacgtaacaggtattaatgcctgttatgtactaagcactccatgagtctttgctatttttgttatcattattaatagtcactttccagtaagacagacctgagttcaaatcctgactttatgatttactagtggtgtgtgactagtgatgtcaggttcttgatctatgggaatctctactggaaacttactttgcagatgcattgttagggttaagcaagttactttatgttaaaacagctgctgtggtcatggtgcttgacacattatagctcaaaaatgtagcttattattagtagtagttttatgtgcatttttatggtataggaacttgataaattcattcaaaagccaattttaagtgcctactgtatcctgggagctatgaaaagcaccttaataataatgttaaaagccaggtgcagcggcttacgcctgtagtctcagttacttgggtggctgaggtgggaggattgcttgaggagaagagttcaaggccgcagtgagttatgattgcaccattgcattccagcctgggtgacagaggtagatcccatcaataataataataatgatggtcacaaagatgatgttactattacctatcagtaacacttattgagcattttctctgccataggcaacttgaagagctctacaagtatcttttctttaaatccttaacaggcctaggagagaagtactattattatcttcattttatagatgatgagagcaaaccatagagaaattgaggaaatttcagatagttgctccaggatttcagttgagatgaagaaactgaggcatataaagctagtcaatggcagataaaaaaaaattgagtccaggtcttctgtctctaaaatccatcctttatatcagcccataaccattgaatgaagttaatcatgtggaggctgacatgggcataaacatgacatctgaagcatagttttcaccccttcataagagtccagttgggtaccacataaatgtggccacaagaaagttatgatacttaaaaatctcataaggataatagtattttttattcaagtcagttattttaaacagtgcaaaggactttagtatgtatgcagtccaggagtttccaactttgatttaccttttgaaataaattagagtctatgagccacctgatttcctgtgtgccaagatttacctggagtacttcagccacctgtcctcagctgcctcattgccttgcttcctcccactttctctccaacacacatgcgtgcacacacacatgcacacatgatttatcataatctgggtaaccacctgtcttagtccatttgggctgctataacaaaataccatacattgagtggtttagaaataacagaaatttgtttctcactgttccagaggctgaaaagtccaagatcaaggcactggaagatttaatgtctggtgagaccccactttctggctcatagatggtgccttctcactgtgtcctcacatggtggaaggattgagggagttctctgtggcctcttttataaggacactaatcctgttcataaggcctccaacctcatgacctaataacttcccaaaagccatgaacttcgaggctaggatttcaacatatgagttttgtggggatgcagacattcagactgtagcctcctcgatggagtgtgttccttgcttgtgtgtcactgtggaaaaaaaaatgtggaaaatcacagcagtcaaccttctcattttatccctgaattggagattgtgagaggggacatatcactggcagtcctttcaaagtttggtctacatctatctatgtatagtggccaaatttagtgtcaatgatcatttgttttgagtttttttttttttttttcttgcaagtaatgctgagtgaatccaactgtagctgactttgttgaatctgcctgggaaaactcttgttcccttgcatcagaagccccaccataaaattggccttggttcaaaattgattatttgcacagattgggatatgttaacaaatagaattccttctcctttctttcctgctcaagttattacttaccaagtcatcaaccgttctctgataggcaagaaacaaactgaactccttaatcttgtttgttctaaagcttaggaagtgattttgaatcactatatagggtttcactgctaagatgtgcaatgggtaaacccccagaggctgggatacagattcaaatcagatcattcgctccaaatgtatcagaactcctaacaatgtcatagctgcccagcatgttttcgaaaacctgccattttgcaggaataacatacttcacgtcagactccaaatggccgcatggatgtgttgcaaagctgaaaattaatgacatgaaacttaacaaggtgttccagaaggtccttgctgcctccctcatgtcaatgctcctctgattccaaataggagagttcactggcaactgtactgttcaactgtggagaaaaatttgaaagccacatgatcataggctttctcagaaattaatctatacaaagatcaagtaaggtataattttcttggctgttgatggaaatatgtttttgtccagcaaataaacaatctagctgggttttggaatcagggcagtgtaaggggcacagacacagaaactgctgtgttaatgatagtgcttttgagacccagataaaacctaggtcttcagctttcccaggaataaagtggtagggccgagaaggtgtggagcattactgagtcaatccaaaacccatcacctgcttctcacaactgaaataactatatcaaacaaggatgactttgctcaatataaccatcaaaacacatggcgtatgtacagtttatcgaaagattttgggttcacaaagcaaattctggaaaatggcatgaaggcagagaatctgatcaaagagtaaatatttatttaaaaaataattcttaaagaggcccagaaaaataaatgaagaaaagactagctgtagattatggtggaaagaatgctgaacagggacacttgaattctaaatctgttattttaacttacttctgtatttaagctttttgttctctcacctaagtttcttattcttttttttttttgacggagttttcactcttgttgcccaggctggaatgcaatggcgcgatctcggctcactgcaacctctgcctcccgggttcaagcgattctcctgcctcagcttcccaagtagctgggattacaggtgtgcaccgccacgcccggctaattttgtatttttactagagacggggtttctccatgttggtcaggctggtctcgaactcccgacttcaggtgatccacccgccttggcctcccaaagtgctgggattacaggcgtgagccactgcgcccagccagtttcttattctttaaaatgaactggctgagctgtttttcagttctgacgttctatgactatgataacaacgtgatgaaatctgcatattggttaataacatacatctctccccagcaaagtgaaaaggcttctgttaaaattttggtctagttgtgcaggtgtttacatgttggccacacaaaaacttaagaggcaaaaattttcacatgaataatcaagttacctgcacttagttggtgacttaatttttatttttttattaaagtgaaattcacgcaacacatattaaacatttttttccatttttaaatttctaattattatggatacataatacttgtattttattaatggggcacatgtgattttgatataagcatgtagtgtgttaatgatcaaatcagagtacttgcggtatccatcatctcaagcatttattattttattgcattgggaatatttcaactcttctagctattttgcaatatataataaaatagtgttaactgtttctaaatgtgcaattcagtggtatttaatacgttaacaatgttgtgcaaccatctgctctatctagttcccagacactttcatcacaccaaaaggaaacttcatacccatttaagtaatcactcctccttgtgctctttcttcctgaatggcataatttttaaaatttatattttgcctttatttatctgacacagtatgtttggggggcagtaggtaggtgcctgcctgtgcttactgggaagctcaaatctccctgaaaccagcacgtcagcctctgaaaccaagttttggctactttgagagacttagagactaagggctagggatgctatctgtcatgatactgaacagatacaagttcattgttttaaacaaattattaaaaacaaaaccctgaaagtttttcaactaagttcaaagaagaagtaaaagtcaactaagttcatgttatccaggcataatcaccatttcctgtaatatctttgggaatcttcctctgcattttaacatatatactatgtatttgcaaaagtaagatcatatggtacacacttattttatttacaaggtaaaaaattgttcaaattaatacaagataggtttataaaatagaaaatagaacatctgtttcccaatcttattttttgatggagagtacatttcagacatatttttgtgtcaataaatatagtttcagagcatcattttaattgctgcctagtagtctattgtatgtagatgttacagtttcctcaactaggcttttttttgacatttaggtaggtaccatttgtcagctatcataatgatgctacagcttgcacctaaatttgtgcctatatctatgattatttcctttgaacaaatttgaatatgtgacctttgctcatgatgataatgatgcaatataatgaaactaaggctaaaatgtagctgctcacattagagtcacctattttgcaaacacactttgggtggctctttttattttacatagcatacccacacccatcatttcatttaatactatcagtggctaatagctaatatttattggacacatatgtgccaggcattgtgctatgtgctttagagaaaggtaccttattcaatgttatttgttatgtactattattatttccattttagagatgaggagagtcaggaggctcagagacattatgtaaattgcccaaagcgcagtaagtggtaaagctaaaattttactttggtcttttgggttctagatccagtattattcctagtgtatgacaagtcctttttttgaattgtaaagtattctgagcctacatttgggcaagggatttagattccgcaccagttatcttggaaagatttaacagtaaggaagcaacatggtgttcgtagactgtgccccctccatttctagtctaggctggcttcctctggggatacctgcctatagttaatttctgtggaactgtaagtgtagttcttgtcatgctggatcctttcccaaagtaagactagagtggctgtggctaagacagcgaggtgtgatttatgaaagttcaaaaggggccaggagcagagattgggagaggcctcatttacattaagagttactgtgaattaggttctggggcaaagtgctcaaatgaatttatcattaaagagccaataaaaagtattaaaggacaaattggctgaatttcattggaccgttttattctgtgcagaggaacaaatgatagcttgtgctatttattttttaggaaaaagaactgtaaaataagatacacatcagcaagcccccaggaccaatgtttttctgggaataaagctggggactatgggaaggcagctaaggttcccattcatggactgaagtaattttggcactgggaatctttgcctgttttcaaggacatctgctaagtccccaaactgtgtcccggttggccttgatgcttcgcggctccactgacccagatcacagagctaaacaggcgaatgcaaagattatggacttaaagaggtcagagttgtgcaggtccttggagagcatctaaggagtgaactcctcaaattgactagtggggaaaccagggcctaggcaaggaaagggacttgtccaaggtgcccaaacaagtgactgccagagtgtcaaaagtttagtggtcacatttgcaatcttctgtatgttatattcaccaatgacatgtaggactaaatgaacgatttctcttccttctcattttctccctcctttccctcttctaccttctccactccttctcctcttccccattttctctttctcctcctcctgttttattttctttttctccattatcatattcataacaacatctctggtatgtatcacgtatgctagctaactaacaagctactgttacctccattatctcatttgatccttcatgtatcatggctgtagtgctcagaaactgaaaatcttaccctgatgcagaatgtgcaagccaacacaccagtcccccatctcggcaccccccgactgaaaaggctgactggcttcctgagcactgtgcagatcctgtatacaagccatggactctctccctgggatactttctttctttcttttttatttatttatttttttatttgagaaggagtctccgtcgccaggctggaatgcagtggcgggatctcggcttactgcaacctctgactccctggttcaagcagttctcctgcctcagcctcccgagtagctggaactacaggcgcatgccaccacgcccagctaatttttgtatttttagtagagacggggtttcaccatgttggccaggagggtctcaaatctcctgacctcctgatctgcctgcctcggcctcccaaagtgctgggattataggcgtgagccactgtgcccggccctccctgggatactttctataggtgtttgagggttaccacattctctggcataatctcagactcagtggcaaaaaaggaaggaagtcaagaagctttcctgtcattggatccaggtcttaaatcaagctttgcttgacaagcatacttcccatatttcctggctggcacttctctgttggaaaggcctcactcatcggcactctttagtcaagaccaggttctatctaaggcatcatcactcacatggaagcccagtttctgagcactggggcacgatacatgaagagtcaaatgagataatggatgtaataatagcttgttaattggatagcatacatggtacataccagagatgttatgaatatgagacgggagaaaaataaaatgaaataggaggaggagaaaaagaaagggaaagcagggaaagggaacatcaacttttaagaacctagactcctggggcattagatttctctccaaaaggtaagagggggaggagagagagagggagggagacagaaagcgagcactataagcatgcaaaacagaatttcacacatagtgagaaattcatgtttttctttccttgttcattttttcattcactcaggtgacattcattgagtgcctaataagtgcccagcactgcttttatctccatgatacagcattatcctcaaacatttatattctagtgagggagacagacagtaaacaaatagacctatattatattatcatgtaattgccataatgccataatgctatgaagaaaaatgaaacaggtgtagtaatttcctaggatggccataacaaattaccacaaattggatggcttaaaataatggaaattttttcgttcatggtactggagattagaaatctgaaatcaaggcatcattagggccatcttccctctcaaagctctcaggaatcctttcttgacttttcctagattctggtagttactggtaatcctttatgttttttcacttttgtctgcatcactctaatccctgtctctgtcttcacatgggcttctctgtgtgtgcctgtacgtcctcctctcgtcttacaaggactccagtcattggatatagagcccactttaatgcagcatgacctcatttaatttgattacctctgaaaagaccctctattttctaaataagatcacattctgatgttctacgtggacatgaagtttgggtggagggaggcattaataaactcactgcagatggggaaagagaagggataattatggttggtctttagatagaatggttaggaaaggcctttctgaagaggggacatttgaggagagaactgagagaagtggagccagccatgcggatatctgagggaacagcactctagacagaggaaaggctaaatgcagtggctgtcaatctgaagtgtgcttgttgtgctagaagagaaacagagatcagcacagctagagtgcggtgtgaaggcatggagtagagtggtagggaatgaggtcagaggaataaccagagatcagatcatacaggaccttaaagatcgggggaagcaatctgggtattatttcaaaggcagaaagaaaccactggaaacttttgagcaggagattgatgtaacctgacttcaatttgaaaatgatcactgtagttgttgtgtggacaacagtcagtcacagagcaagggtagtgtcctaggagcaaatttggagattattatagaaatctaggcaaaagatgatggtgtcttgaagtagtgtagtcatagtagaggtgatgaaaagtagtcagattagttacatcatttgaaaatagagatgaaaggatttagtgcaacacataagagagagagagagagaggaattaagaatggctccaaggtttctggtctgagcacactcagtggcgttacttactgagttggagaaaactgcaaagcgagagggtttgcaggaaaaaatcaagacttcagtttcagatgagtaaagagtgagatgcaaattagaatgcagatgcaggtggcaaataggtaattggatatacaggattggagtacaagggaaagactgggatggagaatataaatctggaagccatccatagagatatgagactggatgagatcataacgaagtgtagatggaaaagtgataaagtctgagcattctgttttgggttactctaacattaaaaggtcaggtgttaagaagaagccaacatagagatgagaaggagtggctgatgggtatagatataaaattaagagagtgagatatcctagaaaccaagaaaatatttcaggggtgaaggagtaatcaactctatgaatgctgcagagagttgtacaatataaaggtaaaaattttctcctagatatcacaacagggaggttggtgatcttggttagagtatttttagtagtgtagtggggatgaaagattgcttggcagggcgtggggggcatttcaaaagagaatgggaggaaacgaattggagcagtaagcatggatggacaactttttcaaagagttgttttctaaagtggaagggaaggataaggtggtggctggaggagggagaatgcgtagtcaaggaataggtttatattttttaaagatgggagttattgtaatgtgatgaggatgatgcagtggtatagacatgagagggagtaattacaggggcaaagtctttgaataattaagaaaggatgggagactgtattgtacagatgctgggtaaatgtggtagtgggaggatgtagaatgtcttttctaattgcttctatttcctcactgaaatcagaagcttggacatcagttgagacaaaggaagagggaaggataattaaaaaagggaaattatgaaataactatccaagagaatagatggcagacagcaccgatggcccacacttggggtatgaggccttcagtttaaatgagaacagacagcatggttgtgtgtttttctagccaaaataagctgcttgggagcaggcatgaagtcatcaaagggttggacttaactcaaatttgggttttgccaaagatacgtgacagaggaagacaggagcctgggaattgaggatgtatacaaacctcttcttggattcatcttcttcagcctcattaatgtctcctccttacctttttgtgccttctcttattttataacatgacagataatacttctacacaagtattgaatgtggagtatgttccacttgttacaaacaggtatggaagagagagtgaggaaatgacacagtcccagaagaagcacatgtatgttaccaagagagattggcatggaagaataaaaatttttgcctaaatgtcacagcaaggaggttggtgatcttggttagagtatttttagtagtgtagtgaggatgaaagatttcttggcagggcatgggggccttgtagaatatttaatattaagaaactttataacatgtattttggggaaaaactcactgtggttctactttgtgtgtgtgcgtgtgtgtgtgtgtgtgtggtaatattttctctattttggtcaatgtaaaaacctgatcatttgatgatgatgatgatgatgatgatggtgatgatgacggtgatgttgatagaagcaactaacatttgctgagtacttaccatgaagaaggcacttcactaagtgccttcatttgattcagtaatttatttaatcctcatgacagtcataagaattcagaaccattactcccattttcagataaggttaggtaatttatccagtgtatgactaacaacattcaaaattagattttgaacccagaacattatgattccatagtccacactcttaaccactcctgcattgcctttcagtgccaaagactttacatgttaaagttggtacacttgtccatctccctatcccttcagtagaactgtcccaatgtccagtctctttgctaagtgattgtgttagttgctagttggggcaaaggtgtgggtgaagttcagccccaaattcttcatcatttttgtgctcatatagggattctgaaagaagctagagggaggatggtgtttgtcctgcaaagctgttccagagacttgtgttctgggctcataatatatattctgaagacaaagcctttggggccattcctcttcttccttcatctctcagacctagttttatcttctgttttttcttgatccatggatattaggcaactgtcttgttctccatattgtgatcccgtctcttgcccctgccctctctataagctctcacctttgtctgagacctgctcctggctcccacttcatcaggcttggcgtgacaaattgccttcttatcatacttaatgccagcctgtaaaatagggtatgctttctgctcacatgctgtcatcatctcctatatccatctagatccaggaggcctatttcatcaacataaaatccacagaagcaacacacgctgcgaatcggtgctccatgtcagagctgatgaggatggattggtgaattctgtagatcacatctgtcctaagcagcaaattagctatgcttgaattcagctactacattttgcctgctgtgaacttgctttactcttctatgaaatgtattttgtagcagtgcagaagaaatacacaagattgattagagttggcacgatttgtgcatacttctgcagttattattgtagtagctgctttaaaagactaaaaagattctttcaccaattttgttcctctgtaaagtttcatttaaacgttagcgggtatatttatgtgtaaatcggatcagcttccaatgatagttccttattgttagcgttttgatgttctgtttgcctgagcagattgatttgccattatgagagaacgtttgaactgaaaaagtcctctgaactttgttcactaatcttatcaaagaaaatagaagcagaggatgtagacagaaacctgcaaattaaatttacttttccaattcaaatgtatttgatctgcatttgttatggaactgggacagtagttgcttcttgattgtgcaatagcactgaagtttagaatatttttcaaagtcttaacaaattcagtgggggaaaatcagcaatgttaactgaaaatagcatctacccttttgtattaagttagtacagcatgtagatcatgtcattgtccttgtactcccatctatcaggcttagtgagcactgtgcaatggtaccataaatggctggaccatctctgctatgaggtgacagattgtttagggcaagccgctggcaacagaagtgttagcatgcttgatttgcagcgaagtgagggcccagtatcttctgcttgattcacatggatgggttatttcacatagctttactcagatttggagaactgtgctaatggcctgagcagtttgcttccttcttccctccccatcactttctctctctctcatttaaatcattccgaatttctgactcaagtaggcatatgaatcagaatcactgtggaaactaaacaaacaaacaaacaaaaatccaccacaagcttaagctctggctctggagatgttgcttgaatagctcaagtaggtgtaagacagtagaaaagtggaggacaaatggactttggtctgactcctgattccatcacttgctagtcgtgtgcccttgggcaatcatttattttctcctagcctcatcacttttttttcatttttcaaatgggtaacacgatagccctgctttcattaggttatgggaggagtgaatgagaaaatgcaaagtgactagtaatcactaaaaaatatacttagtatttgagtgcttcctatgattcactcttatgtggcaatcaggcttctgcattttaagtttacacattatctgcaggtcaatccccactgagaatcactacacttaaaagattcttaaaagctaagtatatgaagcacttgtttcaagtctgtgttcaggggctggttccaattttatgctatggtgccacctcataaaagtatatatgtatgtgtgtagctactggatatttatgctgtgcctggcaccgtgctaggtgctgaggacccagagatcatgaatcattgtccctaaccctaagaatgaaattgcctaataccacattctactctgtaataaagtggcacagtattgcaaatagagtataacaaaaattccctgtgacattcaaaggcgaattttatttcaaacaaacctaagcttctccaaacagaattgtcttagaaactaatcaataacaaacacttcactggtaatctttattttagttatcttccattggcttttcaaatagcgatacattttattaaagcttaactggcatttattgaatgctaccaaggggtctgatggcaagtggagtttactagaaagcagtgacatcaatactgaatcaatgcacttgaacggaagctgtgccctaagtgccattcagcatcacactgtcccattcttttgcagaacactgaattgatccccaaaacagtgcaggtgcagtgatacaggacaaacagccctgcggttccccaaaacccacctcttcaaatctgaagagaacattctttcttttctttgtcatcaaataaacacacctgtactaggtgctggtttctccctggaccgtagtgtagtgggagatagactgaaatacctcctcttatacttctgggcaaacctcagatacataatttgtgcatgggccaaatggccctcaagatattgggttccctaatagagctaccaaaagatcagagaatcataaggtaaggcactgagaaaaaatgaaactttccttctttcccaacgtcaaggtgatagccagattccagcctcagttgagcgatttttttttcagttttccagtgtttagttgtgtgcattattataactcagaaacattatggtagtatagcgttgcattttttcagatttctatttagtattcttatttcactggtcaatgaaatgacagaagagaaaatatcagctcattaaaattaaaaagacaccacccactaatgttgattgctttaaagcaaattaatctctatacatgcagaaggtgctatggttccctgttttgtgtgtgtgtgtgtttgttttttttacctttttagatctggtgaatgcgaaaaccagatactcttgaaagtaagtaagtatccaaataagtgcaaattgcacttccataccagtgtatttactccagtgattgcatggattttatttgaccatgtgataattagagcacattcaaatcacaaattcccattttacactttttgagtttttttaaaccagaatgcactaatggcctacagagtacttcagtgttaggtgatcagagaaaccatttatatgatgttcttgctaatggggaactttaaatgtggggaaggctatcgtcatgcatggaggctctaaatggccagaaaagggaaccagtataatcatcagagagcagttttacatgtgggtgagttgaatgattgttatagattcaagctatataaatgaaggtactttaagaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaatacacatacacagacacacatacacacaatttgctattggtttggtatggacaaattaatgtacagataatatacaggtttaaaaattaaaatacccattctgcactaatggcaaatgggaaaatagacgggaaaagagaggcaggtttagcctgtggacaagttgagagccttctttttctcctccatttctttttatttcagttccttctttcatctgtgcctaagcccactctgagccaggtgaagagaatggactcataaaaatgttgactctgaggtgtggacaaggcaagtgttacctttcccacaataggcttataaggattttgagagggatatatggagacagccattcttattggatggaacaatatcctgatggtgacattttaagcattagcaggtaattgcctcttctgtgtatgaggaaagctctccctggacaaagatcagttgccaatgtgtgtttagatgaaactgagaatagtccccactgagccaccagtgggatcgggtagtgcctgttgtgaggagaccactggccagacaagttggggacaaaggaacagaggagtggagaaaagcagaatgggaagatagagtctgggtaatgggagagaatagggcggggatgaatccctgggttcaaatcctggactactacttaactaacgatcattttgtagcttaatacctagtcaggaagtgagttgttaatcaagttattcatatgttcaccaaatagctattgaacttactatattacaaacatggtaggtgctatgaggaaaaagtacatgtcacgagagacctgatctagtctggggcatcagcgaacttcactgatggagcttcacattctgagacagtgaaactcgagttgaggtataaacaaggaatatgaaaaatgaagagttatttagacaagggtatgtgaagggaaaattcctgaaggaaggaagagcaggcttaagattcctaaggcataacaagagaatacagtatgttctaatgcactgcatgaaagccagcatgtctggagcacagcacataaaagtggagaaagctgaggctgaggagttgagaagggggcggagacttccaggtctacctgtccatggtaaagcacttgaacattagtgtaaggacaatgggaagccattggcaggttttatggaagatggtgttttaaatagatgtttctggaagtgtaaggtggacaatggattaaagtagacaccacactgaaggcatggtgactatttaggcagctgttagcagcagtctggacaaggtatgatggtttcttggactaaggtagaatcaaggagaaaaatgaatggattgtgtgaccttgaacaagtagcttcacctctctgagcctaattaagcttattttctttcaggtttggcctaacatatctaatgaatacactgggttttgcctctcagattatctgctgcgcataacctcccttatacgtgttaactattcaaaaaaaagttttatgtccacacttgatttatgaatgaaacatagaactagcttggagtctttagaatttattcagaattgtattaaattacttcctttaggctgctggtctggatgagttatacatttttgtaataaaaattggctttcaaatgaataaaagaacactgacatgccaccacacatgttattcctctcatcctaaagtactgaacaaaaggaccaatagaagactccccagcattcagcagtaattaaatacagatacacttatttaggaaactggtaacaggaaagagaaatttagcgccagctatctgagaaaagacagcccaaggactacattttgttctgagagttacaaacacttccaaacagaattaaaaagaaagtgcctttcagggctataacatctttccatacaactttgaaacttggcaaacatttcttgccagctcatcacactaaaccctgtaataattttgcacggtgtccaattgtgataggaaactagtagctctgtgagtgaagatttctattctgggtatccaaataacattcccagtggagaggagaaaaacactgaaattagatgcctatgtctttcaaatggttcagttccatttgattgatacgtgttgtggtacatgttctctgggcaagggcttgggctagatatcttcaaagaaggtagtcatggggctgtccaatcacttccttatcccacttgactaagcaagaatccttttgtctaataggaaggctaaagttagaaaccagggatctgtaacacaagaaagagagatataattaccttaacaccttaagaaagggaaaagagtgagtgaaataggggtgattcaaaggctaatgtttattaaaatcttctgtacaccacctactttaacctcattttatcctttgggcttcataacagctcttatgatattattatttttattattatcccttactcacaactgagaaaactggggtttccttagttgtgaagcttaagcgacttgtccaaagtcattccctgctctatctgatttcaaaagatatgctctttgcactgtactgggaagcctaagccaagtgttcgtgagttttgtagagaaaagtatagaaaactcaaattacaaaccccatggggaaatggagggagcaatgtgagacacagaaaaggggggggggaaaaacagctccaaactagaaaaaataaaacaatacaatgaaacgttgagacgattaactagataaaggaaggattagaaatgctaatgagagaaagtatacgatgacaggtagatttgaaaagaaataaatataacttctagaaaaaaatgatgattgaaattttaaaagggaaggtcaaaataatatttgaagaaatcacgcaaaatgcaacacagaaacataaaaagatacaaaagaggttcaaggacatggaagtagaatgaggaggcccagtataaatctaagaaatgttccagaaggaaagaatcaagaaaatcttgaaagtcaatattcaaatagataacagctccaaattttctagaattgaagaaagacttggatactcagttcaaaggagcccattaaatcctaagcagagtaacaaaaacaaataaacctagacatattgtagtgaaactgcaaagccctgaaaaagaaaatcttaaaagtcagagagaaaagagatgacctattagaagattgtaagttagaagacagtggacctgatatcagcaacaataaaattatcttccaataggtgagaaaaaatagttattaacgtagaactttatatccagttaaagtcactgtattagtcttctaaggctgtcataacaaaataccacatcttgggtggcttaaacaacagaaatttattttctcatagttctggaggctagaagtccaagatcaaggtgccatcagagagggtgtctggtaaagtctccctttctgacttgcagaaggcttcctattgctgtgtcttcacatggactttcttccgtgtgtgtgtgtgtgtgtgtgtgtgtgtgtgtagagagagagagagagatatttctgatttctgttctctcttccttttcttataaggacaccagtgctattggattagggccccacttttatgaactcatttaaccttaattacctccccaaagggcctatatccaaaatagttacattacaagttagggcttcagcatatgaattttggggagggggcacaattggttccgaaacatcactgttgaagcaggagagaaaagagaaaaataaaggcttttttttttttttttttttttgagatggaatctcgctctgtggctggagtgcagtggcacaatctcggttcactgcaacctccacctcctgggttcaagtgattctcctgcctcagcctcccgagtagctgagactacaggtgcctgtcactgcgcccagctaatttttgtaattttagtagagatggggtttcaccatgttggccaggatggtcttgatctcttaaccttgtgatctgccagcctcggcctccctaagtgctgggattacaggggtgagccaccgcatccagccaataaaggcattttgagatgaaaaagctggagaaattctatgaataacaggtccttaataaaaagtactattatagggtggactgtaatggaaatttattaaaacaaagaaagtgtgagttgtaagaagcaatggggaccagtgttattgataaagtacataaatcttaataagcatgggctgcataaacaacaataatcattactttaagaaggttgaaataagaaggaataaaactcttggacaacagtaacatggaagatgaagagaggtaataagatttaaaacattctgaatctttgcgttttgtaagaggaagatgaagatattggtcaacttcatgcttttcaaagttaagtattatgtaaaaaacttgtgtgtaccactaaaaggatggtaataaaacataaaacttccaaaccaatagaaggcataaacgaaaaaatgaaaattgtcaataaaatggtagacagagaagtagagacaacacggtaaatacaaaactcaaaattaggtcataggaataatcaggaattataataagtatagataaattacttggtttaaagataaagattctcagtgttggattttcttttttattattattatactttaaattatggggtacatgtgcagaatgagcaggtttgttacataggtatatacgtgccatggtggtttgctgcactcatcaactcgtcatctacattgggtagttctcctaatgctatccctcctccaccccccagtaggcctcagtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgtaaaggacatgaactcatccttttatatggccgcatagtattccatagtgtatatgtgccacattttcttcattttctttatccactctatcattgatgggcatttgtgttggtttcacgtctttcctattgtgaacagtgccacagtaaacatatgtgtgcatgtgtctttatagcagaatgatttgtaatcctttgggtatacacccagtaatgggattggtgggtcaaatagtatttctggttctagatccttgaggaatctccacactgtcttccacaatgattgaactaatttacactcccaccaacagtgtaaaagcattcctatttcttcacatcctctccagcctctgttgtttcctgaatttttaatgatcgccattctaactggcgtgagatggtatctcattgtggttttgatttgcgtttctctaatgaccagtgatgatgagctttttttcatgtttgttggctgcataaatctcttcttttgagaattgtctgttcatatccttcatccactttttgatggggttattcgtttttttcttgtaaatttgtttaaattttttgtagatcctggatgttagccctttgtcagatggatagattgcaaattttttctcccattgtaggttgcctgttcactctgatgatagtttcttttgctgtgcagaagctctttagtttaattagatcccacttgtcaattttggcttttgttgccattgcttttggtgttttagtcatgaagactttgcccatgcctatgtcctgaatggtattgcctaggttttcttctagagtttttatggttttaggtcttatgtttaagtctttaatccattttgagttattttttgtataaggtgtaaggaagggatccagtttcagttttctgcatatggctagccagttttcctaatgccatttattaaatagggaatcctttccccatttcttgttgttgtcaggtttgtcaaagatcagatggttgtagatgtgtgttgttatttctgaggcctctgttctgttccattggtctatatttctgttttcgtgccagtaccatgctgttttggttactgtagccttgtagtatagtgtgaagtcacgtagcgtgatgcctccagctttgttcttttggcttaggattgtcttggctacacaagcactgttttggttccatatgaaatttaaagtagtttttttttttaaattatactttaagttttagggtacatgtgcgcattgagcaggttagttacctatgtatacatgtgccatgctggggcgctgcacccacgaactcgtcatctagcattaggtatatctcccaatgctatccctcccccctccccccaccccccaccagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttccagttctagatccctgaggaattgccacactgacttccacaatggttgaactagttgacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatgatgagcattttttcatgtgttctttggctgcataaaatcaatgtacaaaaatcacaagcattcttatacaccaacaacagacaaacagagagtcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaacatcgtgaaaatggccatactgcccaaggtaatgtacagattcaatgccatccccatcgagctaccaatgcctttcttcacagaattggaaaaaactactttaaagttcatatggaaccaaaaaagagcccgcatcgccaagtcaatcctaagccaaaggaacaaagctggaggcatcacactacctgacttcaaactatactacaaggctacagtaaccaaaacagcatggtactggtaccaaaacagagatatagatccatggaacagaacagagccctcagaaataacgcagcatatctacaactatctgatctttgacaaacctgagaaaaacaagcaacggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcatagcaaaagaaactaccatcagagtgaacaggcaacctacaaaatgggagaaaattttcacagcctactcatctgacaaagggctaatatccagaatctacaatgaactccaacaaatttacaagaaaaaaacaaacaaccccatcaaaaagtgggcaaaggaaatgaacagacacttctctaaagtagttttattcaattctgtgaagaaagtcaatggtagcttgatggggatagcagttaatctataaattactttgggatatatggccattttcacgatatcgattcttcctatccatgagcatggaatgtttttccatttgtttgtgtcctcttttatttcgttgagcagtggtttgtagttctccctgaagaggtccttcttgtcccttgtaagttgtattactaagtattttattcttttagtagcaattgtgaatgggacttcactcatgatttggctctctgtttgtctattattggtgtgtaggaatgtttgtgatttttgcacattgattttgtatcctgacactttgctgaatttgcttatcaacttaaggagattttgggctgagacgatggcattgtctaaatatacaatcatgtcatctgcaaacagggacaatttgacttcctcttttcctaattgaataccctttatttctttctcttgccttattgccctggccagaacttccaatactatgttgaataggagtggtgagagagggcatccttgtcttgtgctggttttcaaagggaatgcttccagtttttgcccattcagtatgacattggctgtgggtttgtcataaatagctcttattattttgcaattatgttccatcagtacctagtttattgagagtttttagcatgaagaggtgttcaattttatcgaaggccttttctgcatctattgagataattgtgtggtttttgtccttggttctgtttatgtgatggattatgtttattgatttgtgtatgttgaaccagccttgcatccgagggatgaagccgacttgatcgtgatggataagctttttgatgtgctgctggatttggtttgccagtattttattgaggattttcgcatggatgttcatcagggatattggcctgaaatttgctttttttttttggttgtgtctctgccaggctttggtatcaggatgatgctggcctcataaaatgatttaggaaggagtccttctttttctatcatttggaatagtttcagaaggaatggtatcagctcctttttgtacctctggtagaattcggctgtgaatccatctggccctcgacgttttggttggtaggctactagttactgcctagacttcagaagttgttactggtctattcagggattcaatatgtgtccaggaatttatccatttcttctagattttctagtttattcgtgtagaggtgtttatagtattctctgatggtagtttgtatttctgtgggatcagtggtgatacccctttatcatttttcgttgtgtctatttgattcttatctctttccttctttattagtctgggtagtggtctatatattttgttgaccttttcaaaaaaccagctcctggattcgtttttttgtgtctctatcgccttcagttctgctctgatcttagttatttcttctcttctgctagcttttgaatgtgtttgctcttccttctctagttcttttaattgtgatcttcggatgttgattttagatccttcctgctttctctcgtgggcatttagtgctacaaatttccttctaaacactgttttaaatgtgtcccagagattctagtatgttgtgtctttgttctcattggtttcaaagaacatctttatttctgtcttcatttcattatttacccagtagtcattcaggagctggttgttcagtttccatgtagttgtgtggttttgggtgagtttcttaatcctgagttttaatttgattgcactgttgtctgagagactgtttgttatgacttccattcttttgcacttcctgaggagtgttttacttccaattatgtgggcaattttagaataagtgcgatgtggtgctgagaagaatgtatattctgttgagttagggtgcagagttctgtagatgtctgttaggtctgcttggttcagagctgaattcaagtcctggatatccttgttaattttctgtctcgttgatctgtctaatattgagtcgggtgttaaagtcccccattattaatgtgtgggagtctcagtctctttgtaggtctctaagaacttgctttatgaatctgggtactcccgttttgggtgcatatgtatttaggatagttagctcttctggttgtattgatccctttaccattatgtaatgcccttctttgtgtcttttgatctttgttggtttaaagtctgttttatgagagatgattgcaacccccctttcttttttctttttcttttttttttttttgctttccgtttgcttggtaaatattcctccatccctttattttgagcctatgtgtgtctttgcacatgagatgggtctcctgagtatagcacatcaatgggtcttgactctttatccaattttccagtgtgtgtcttttaattggggcatttagcccatttacatttaaggttaatattgttatgtgtgaatttgatcctgtcattatgatgttagttggttattttgcccattagttgatgtagtttcttcatagtgtcaatgatctttacagtttggtatgtttttgtagtggctggaactgattgttcctttccatgtttagtgcttccttcaggagctcttgtaaggcaggcctgttggtgataacatctcaatgcaaggaagctaacaaccttgaaaaaaagttagaggaattgctaactagaataaccagtttagagaagaacataaatgacctgatggatctgaaaaacactgcatgagaacttcatgaagcatacacaagtatcaatagccaaattgatcaagaggaagaaaggatatgagagattgaagatcaacttaatgaaataaagtgagaagacaagattagagaaaaaagaatgaaaagaaacgaacaaagcctcaaataaatttgggactatgtgaaaagaccaaatctacatttgattggtgttcctgaaagtgacagggagaatggaaccaagttggaaaacactcttcagcatattatccagaacttccccaacctagtaagacaggccaacattcaaattcaggaaatacagagaacaccacaaagatattccttgagaagagcaaccccaagacacataatcatcagattcaccaaggttgaaatgaaggaaaaaatgttaagatcagccagagagaaaggtcgggttacccacagtgttgtattttataaagaactctgctctatggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaaaaaagaaaaaaaaagaactctgctctatgcttattaaactggacattactaaaacataatgacagagaaatgttgaaagtaaatagatgaaaaaataaacaccagacaaatattaacttaaaaattttggtttaggcaatagttgacaaaatatatattaatgaccaaagcatcattaaaaataaagaaggacattacttaatgatacaatgaataatttcatacacaaaataaccatcctgaacctggttcatctaataacataccttcaaaatatatgcagcagaaattgacagaattataaggagaagttgatgagtacacagtcatactggggaattttaacatactgtactcgtataaactgatagatcaagcaaacaagtattgagggtatggaagatttgaataacaaaatggttaaatctgatccaatggacctgtatacagccctgcacccaacaataaggtaatacaaattcttttctaacaaatagggaacatgttcaaaaatttaccttttactgcatcctgaagaaaatctgtagtaccaaaagccagtattctatagaccagattatttgataaagatgcaatatagtgtgaaatccacaactataaactagattataggagaaaacaaaaccttattgtcaactcagtaggtacataaaacactctataaatttcgaaaaataaacattaagccacctgacaaactggaaatagatccttcacctgataaaggttatctagcaaaatcctatagccaacattatacttgaacttgaaatactagatgtccctttcaagtcaggaagaagactgataagaaaacctctcaccactatttttattgggcattataattgccgtcctaactaattataaggcaaagaaaaatgtaaggtcaaaaatatattgttagttttcacagatggtatgttttctacacagataatgtaagagagcatgtagacagactaacatagagttcaaccagtcttctgggtatgggatcaatatgtaaaaatccatagtcctcctctataatagcaagaaacaagaagaaaatgttataaaaacattttctgacaacagatatggcatccataatcatgcactgctgtctctcatcttacttctgactttctttcaggttttaagttgtttctgcaagatttgttacctccttcttccctgccacaatatgcttgagctatgaggttttctcttattttttccagaccctctaaatagcagttaaccaatttaaagcaaaaaatacaaattaaggtgaacaaggtagttgagaagaacttagagaatatccctcagtcatagttcctctttcaagtatttagtggctttgatttggctactgctatggaaattgaatatcaaagtgaaaatgctgatttttctggtaccggcttaagcaaaattcaacttattcctatctacctaagtaaaggatcccccactagggattgtgtgcccccctcttagtgtattcaagcaagaagtccatctagttactttccctttaaaaaccagtcccattgaggaaattgaaaaaggtaaaaataaatggaaagatacctagtgttcatggactagaagaattaatattaaaaggtccatgctacctaagatgatttacagattcattgcaatccctgtcagagtaccagtggcattcttcactgaagtagaaataacaatcctaaaatttgtgcggaatcatagaagaccccagatagccaaagaaattttgagcaaaaagaaggaagctggaggtatcacactaccttacttcaaaatatactataaagttacagtaatcaaaatagcattgtcctgacacacagactagtgggacagaatagagagcctagaaataaatccatgcatttacaaccaattcatttttgataaaggagccaagaacacacaatgaggaagggacagtctttaataaatgttgttgggaaaactgggtatccacatgcaaaaaaatgaaacaagatctgtagcttacacctatacaaaaacaactcaaaatggattaaagatttaaatgtaatactccaaaccacgaaactactagaggaaaacatgggggaaagctccgtgacattggcctgggaaatgatttttttggataagaccaaaaaagaacagacagcaaaagaaaaactagacaaatggaattacataaaactaaaaagcttctgcacagcaaaagaaacaatagggtgaagagacaaactatatatgggggaaatattttcaaactatacatttattaaggtgtaaatgttcaaaatatataaggagctcagagaacgcaatagcaagaagacaagtaacctgattttaaaatgggcaagggacttgaatagtcatttctcaagtgaagacatacaaacggccaacaggtatatgaaaaaaacactcaacatgactaatcaacagggaaatgcaccttaaaaccacaataagataccacttcataccctttactgtggctattatcaaaaaaacaaaagttaataagagttggcaaggatatgggcaaaagggaacccttgtaccctgttggttgtgcatcttagttcattttctgtttctgtggctgaatacctgagactcagtaatttattttaaaaaaaaataagtttatttattgcaattctggaggctggaaagtccaaggtaggtgggctgcatctaatgagagcctcatgctacatcataatattgtggatggcatcacatggtggagtgcatgtgagagtgggcatgtgcaaaagagacaaaacatgaggagtgacctcgctttataacagcattctctctgggtaactaatgtagtgccataagagtcagaactcactcactcatttgagactgcattaatcccctcatgagggtgaatccctcataacccaaatgccttttgaagctcccactaccccttaacacagttacattgggcatcaatcctcaacatgagttttggtaggagcaaaccatattgaaaccatagcagtgggaatgtaaattagtacagccacccaggaatattggtgaagatttagaaaaagatcatggatgattgtagacataaatatttaggtagctgcagagcctgttggagagtcaattgtagaggacagcagttatcttgaacctgcagattaatgtgatacaaagtttgtgaaaggtagttcttatatattaagttctgaattactaaagaatatgaaactatatctaaaatgaggaaaatggtgaagaagctgcattgtctataaagaagagattttaaaaaatgaaaaatttaatggaaaatagggacagaaggactagaaatatagaatagttggaagggaatacaaatgcaaaacaaagtaaattgtgaaaagaagaagcactttatatagaaaaaaaaacagaaaaagtatgtttgcatgtgcatgtgtgtgtctgtctttgtgtgtaaataatatgttctccaaacccagagccttctaatgagaaaaaagttactttgaacaagtatatacgttaaatgaaaattaagcaccaacacatattctaaagaataaaaagaaaaaacttgcatatatgattaccacaatggagaggagtcatatgcaggaaaagtagaagcttttataggaaaaatatcatttctgaaatatatatattgaagaaacaatgtcaaacaaaccaaaaagcagtctgtgaacacattaggaattgccctactttgttaaatggaatgacaaaattgactaatatttggtgagctcagggtgtctgctgctttcaagagcataagatctgtatcgttagctagttatttaatttatagaaatatactagaattagaatttatttgcaagagaaaatgctaaattgaagatggaaaactcccattcactatagcagcaaaacccatattagatctagaaatatacctcacaaaagatatgcaagatatgtaagtacatattatgagattttattgaagaacataaacaataatataaatataaataatagaagaaatatgccattttagtgatttggaaggctcattgtcataaaggaattaattctccacagattaacatatgatccaaggtccccaagcttactagtaatgagggaaatgtacattaaattcaaaataattcacaaccatcaaattagtatatattaaaaagcagaataataccaagtggtgatatcccaaagatgaaaggaattgggacttttgagggactatcaatttatacacctgccttggacagcatgtggcaacacctagcaaagtcaaagatatgcacaccttattataatcccaactcccacttctagatattttccatggagaaatcctggcatgtgtatacaggagacataaacaagaatgttcatttccacagtataaaattaatgtccaacatatgggaatggattaatactatcaatagcagcatgttttaaaatggaaggctatatggcagtttaaagtagctaatcacatccatatacttctacaaaaatgaatctggaaaatagtgttgagtgtgcaaaagaatttagaaaacattatgttccatacatttatgcaaaaggacaggaaaattggtcatgcctagagggtctctcagggcttttgtgtattgggccccacaaaaccgaggaaagttctctgaggagattgttggaaaagttcagtactgtctcctcgtgcctgacaaacctgaagcagtgaagcagagaggtcctcctggccttttttacttagagaatattctctctctctctctctctctcttttttttttaagaacattcttcactttatcattggagaaaagcctggtgttaagaccatctattattgtggcagtgactcaggtatactgtctggtggctctctgccaaagagagttgaggggtcaaatgactaaggtttctagattaaaaggacgagtttacaagctgaaccagaggaacttaaattgtgtttttttttctctctcttttttacgcatcactgaaaactttttgaaagaaaaagttcttagtggttattctaatcacctagcttttggttggtttttgttaaagattagaacgtcacttctcaaaattcagcacaattttcatgctttgggccataataataatgaaagtgatactaaaagacttttttctttctccacccccttttctttcaatctcagaacacaaaagatgaaggcagttttgaagagttaactttttggttgagtaatccccttgaatgcaatgtaactttaaaagagagaaaaagggaaggctagcagagatcaaatcaggacctcatggctacccaggctcctgtcaccatacgtaggtggtaaagttaggtggtagggttcatgggtcctggggtttgatctgaaatctcctctgcatatacgaaagagcatggctgaattatgtattcatttggaactttttctcttcattccaggaacctgcaactattataatacatttgttgatgtgtaactttgtgctaataaacagttctgatgcaattattgatttacagattttttcatcttactttagtatgttcacacattatgttgagaatcagtgtgtacagatactattttaatattatagagttaatggtcaattctaacaactgatatagaaaattggacctggtcctctgtctaaaaaaggacattttactcatttatatgactaaattgtgactgtggaggtttatgagtcagtatttgttaaataaatggattgatggatgggcagaaggaaggaagaattgaaggaagaaaggaagaacagacagaacagacagatggaaaggagaaatctgcttgaaaatagctttcatgaagaagatattcactttataggaacattgtcttttatatttaaaatatctgtcctcttactttggatacccagagtgccagccacaggatgcttgctatttatgatcttgaaaatgtttgaagcccttccagggagtaagggaagaaaatcacatcaaagctacactgcgccttttccttttctggttttgtgttcaaacatagcattcaagacgatgcaggtatttgattgtgcagagttaatattcccccagaaaatcaaaatagctgaattataaatagcctctttagattttttagtatagttctttaggagaatgacattcacacaaaaaagtgcacagatcctaagtgtatatctcatcaaatcttcacgaattggagaaaccatagtaatcagcacccatataaagaaagataacattaacagcaccccagaatttcttctgtccttttcttctaaaccttatttctcaccaaaaggttaagtgctataacttttaatatcattaatttgatttccctattctggatattcatataaatggcatcaaacaatatgcagctcttgtgactttcttctttcagttagcatatcgttttcaaggctcatccatgttgtgacatgtatcggtaatcattcattcttactgccaaataatatttcattgtatggatataccaaaatatttgtacccattcatcagttgatggagatttcagctttttctactttgtggtggttatgaataattgtgctatgaacatttatgtacaagtttctgtgtggacatatgttttcaattattttgggtacacgttttctctgggtatacattccatttcttttgggtatatacctggtagtggaatttctgggtcatatgcaaaactgttttcaaagtgacggcaccattttaaatttgtattagtaatgtataagtgtttcacttgtttcacatccttgccaacactccgtatggtcagtgtctttaattttagccattctggtggaaaagtttgtttttttttttcttcttgacaggtttttatataatgttgtgatactcagaaaataatactgataccaacttctataaattaactaatcttaagtcatttcctatccagggatttaattggagcgacaagtattttcctgtcatttctaaaatatgtggacaaggccttcaagatttagctcagatgccccttcttatagaatctttgcatccaagttctgggagggcattagaggtcatctacccaatcccatcattttatagatgagacagttgaagctcagggaagggaatggacatgaccaggcaacatgggcctagtgggcaagtctcctgactttagtccatggttctttctgtctccccagacagctttgtctactcatctttgcttctccttcgctgctaatttgaagagattgaaattcatctttgacaggaaaaaagttgtaagtttctagggcttaaattgaacatcaaagaagcagctctcctcccattgaaggctcgcatgctccatcactgaaaactactatcatttaagccagagaaagaaaacttaaagtgacttttcagcaaataccatttttaatacacacataatatcttctgttttatactctgatcatgattaagaatttcaaatagctcaggaagaattaaggagatttacacccacattattactcataaccacttagagcaaagaaggaaatcttttaaaaggatgtttattgctttcataccaaatgagaatctgaattaaaatgattcctagcacagtctttcgagttgaaagtacattcagccgttttcaaaatcccttgtaataacaacaatgcttggtaatttcatggagtttgtattttttcaaaggagattagggtaaatgctgtaaacatgaacttcctaatccttattttgtgatgactgccctgggccggtcttgctatccttggtcctcagatggagatgctaacacagagtggctgtccaggtttcaaggtttgatctcttggctcactgtgaatttacttcaagtgggagaaccttagttcttcagtaattatctaaccctcagttcctgagctgtaaaatatgaggattatatacccatttctgaggattaatttgtgtaaaacacgtagtactagtaggtgttccttatatggttggtacttttagattctttgctggagaaggctgttgtctaggaacaaaagtggcaggctttggggattccccagacacttatattcattcattaatatattgagaaagcaaagattggttgcttcctaaccctgtatgagaggacttcaagaagttcatgaaaaatatgtattataaaaaattgcacatgaatttctatttatttttgcaccaaaataaactcatactaacttggtataacatatctgaacaggacctagttttgaggcactaagaaagataagacattagtttgaaaagagcccttatcacagcaacatgaattctgctagaattgaagcaaaaataaacataaaattcatcttgaagattggtggaaaaatagtgaaatcactgatgctttataaaaagcttatggggcaatgccccaaaggaatcagcagtttacaaatggataacttgtttaagaagggataagacgatgttgaagatgaagcctgaagcggcagaccatccatatcaatttgtgaggaaaaaaatcatcttattcatgccttaactgaagaggactgacgattaacagcagaaactatagctaacaccatagacatctcaatttgttcattttacacaattctgagtgaaaaattaaagttgagcaaactctccactccatgggtgccacacccattgcatccagatcagctgcagataagagcagagctttcaatggaaattttaaacaagtagattcaagattctgaagcatttcttcaaagaagcataacaggagataaaacctggcttgaccagtacaatcttgaagacaaagtacaatcaaagcaatgactacaacataatactgaatggggaaaagttgaaagcattccctctgagaactggaacaagacaaggatgcccactctcaccactcctcttctacatagtactggaattcctagccagagcaatcagacaagagaaagaaataaagggcatccaaattagtaaagaggtagtcagactgtcactgctgacaatatgattgtttacctcgaaaaccctaaagactcctccaaaaagctcctagaactaataaaagaattcagcaaactttccggatacaagattaacatacacaaatcagtagctcttctatacaccaacagcgaccaagcggaggatcaaatcaagaactcaaccccttttacaatagctgcaaaatacaatacaatacaatacaatacaatacaatacaacacaacacaacacaacacaacacaacacaacacaacacttaggaatatacctaaccaaggaggttaaagacctccttgaaggaaaactacaaaggaagactacaaaatgctggaaagaaaactacaaggaaaactacaaaatgctgctgaaagaaatcatagacaacacaaacaaatggaaacacatcccattctcataaatgggtagaatcaatattgtttaaatgaccacactgccaaaagcaatctacaaatttaatgcaattcccattaaaataccaccatcattcttcacagaactagaaaataaacaatcctaaaattcatatgggaccaaaaaaagagtacacatagccaaaacaagactaagcaaatagaacaaatctggaggcatcaggttacctgacttcaaactataccagaaggccatagtcaccaaaacagcatggtactggtataaaaataggcatgtagaccagccgggcgcggtggctcacgcctgtaatcccagcactttgggaggctgaggcgggcggatcacgaggtcaggagatcgagaacatcctggctaacatggtgaaaccccgtctgtactaaaaatacaaaaaaattagctgggcatggtggtgggtgcctgtagtcccagctactcgggaggctgaggcaggagaatggcgtgaacccgggaggcggagtttgcagtgagccgagatcgcgccactgcactcaagactgggcgagagcgagactccatctcaaaaaaaaaaaaaaaaaaaaaaaaaggcacgtagaccaatcgaacagaacagagaacccagaaataaacccaaataccttcagccaattgatctttgaaaagcaaacaaaaacataaggtgtggaaaggacacccttttcaacaaatggtgctgggataattggctggccacatgtaggagaatgtaactggattctcatctctcaccttatacaaaaatcaactcaaaatggattaaggacttaaacctaagacctgaaactataaaaattctagaagatagcattggaaaaacccttccagacattggcttaggcaaggatttcatgaccaagaacccaaaagcaaatgcaataaaaacaaagataaatagttgggacttacttaaactaaagagctttttagacatcaaaaggaacagtcaacagagtaaacagacaacccacagagtgagagaaagtcttcacaatctgtacatcggacaaaggactaatatccagaatctacaaggaactcaaaccaatcagtaagaaaataaccacacagtcccatcaaaaagtgggctaaagacatgaatagacagttcttaaaagaagatatacaaatgtccaacaaacatgaaaaaatgctcaacatcactaatgatcagggaaatgcaaatcaaaaccacgatgcaatacctccttactcctgcaagaatggccataaaaaccaaaaaaaaaaaaaacagtagatgctggcatggatgcagcaatcagggaacacttctacactgctagtgggaatgtaaactagtacagccactatggaaaacagtgtggagattccttaaagaactaaaagtagaactaccgtttgacccagcaatcccactgctggatatgtactcagaggaatgatatatgatatatacacacacacatatctatctatgatggaatactactcagccataaaaaggaatgaattaacggcatttgcagtgacctggatgagattggagacttaagtaaagtaactcaggaatgggaagccaaacatcgtgtgttctcactaatatgtgggagctaaactatgaggacacaaaagcataagaaggataaaatggactttggggacttggggggaagggtgggaggggggcaagggataaaagactacaaatagtgtgcagtgtatacagcttgtgtgatgggtgcaagcaaaatctcacaaatcaccactgaagaccttactcatgtaaccaaataccacctgtacccccaataacttatggaaaaattaaaacaaaagataaaaatcatgaaaataaataaaaataaaataaaatatagaaaattggtgtttcaaaaacaaacaaaaagcaatggctactaagaggtggaagcggtcaaagcaaaagtaggccagtcaagacatgctcaaggcattttgcttgttgactttcgaatggagggccaaagaatgataacatctgcttatgacaggagtgttttgagaaagcaaggcgcagctttagcagaaaaatgcctggaaaagcttcaccagagagtccttctccaccacaacaatactcccactcattcatctcatcaaacaagggcaattttgtaagagtttcaatgggaaattgttatgcatctactttaagtccttatttggctgctgctgacttctttttgtttcctcatcttaaaaagatctgtaaagggcactcatttttctccagttaataatgtaaaaaagactgcagtgacatggttaaatttccaggatgctcagttctttagaggtggactaaatggctgggatcatcacttacaaaactgtcttgaccttgatggagcttacattgaggaataaagtttatattttttatttttatcttttacttccattttttccactaactttttgaaatatcttcatattagtgtaatgagtgtgtgtgtgtgtgtgtggtgtgaaaacaaaattttcacattaaagcatgtcacattctatttttattatttttaacttatgatttttataaataaccattattaccagtgctaggttccaggatactaaaacaaggcaaagttggaaagaatgtttccatacaaaaaccaatatataacataaagatatgaacagatgaatgaactataaagcaacttctgctaaactggtaattgttagaactaaagcttcagagacttgtaatttataccaactcctggatatgggatattccattgttggattgatggcctaaaataagagaaacatcatttttttcagaagaagttttagaacatggctgaaatccgtcataatgcttaaccttgaactctcagatatcagtgctaattcatattttgtagggcaaatataggacaagagaaactgcacaggcagactgctagtgggtggaaaaatgccctttgactgggaatcaggagacttggctttttgttctagatcagtcactgctttatagggtgacctgagcaagtcactttaatgttgtggatcttactttcctcatttgaaaactacttgtttagtcaaaactattaattataaactatgttctgtagtaataggcttccacagaggtgccacagagatcactgcaggagggactctgcgaccttaatccccaactatgacccaagtagttcttttgtccactggtctatatataggggctattcttggggtttcatttgaataaaaggttctaaggtctgagtaaaatggggcactcccaggctaaatgatcctgacttaggatacacaacctgatcaaggttcttcaggttttaaggttctgtgatatctggataaccaaagtaggtgtttgtgacattctgtaacttatctgtctgtgatatgttagccagttctagggctggaatgatgatggtaatagacatgcccagtgatgaatgacctaccatgctacctaggacatcttacaccttgattattgaatttaaaagagcttctgaatcatcagagaaagatcaaatttggcttagttgtcattttactattgtatatttctatctgtgtgtggtatatttagtgaggctttaagtatatttggtgggtctccagtaactagaatgtttcattgacctatatatgccattccccagttatgccaggcagttgaaagtttatcgaatcagactgaagaatttgaagttgaggcaatgcttctcacacctatataaaagatgtcatgaggaagaaccagagaggaggagtgtgtatgaagtattggtcaattttttatacacatatagtaaaggctgatttatttgaggcatagtgttatttcaggcaatctgaattaactatgactaaaaatggctgttctgagctattacatttccaagtgactaaaaaacacgtgcatgaaagcaaaatctagattttgtcagaatacacccaacatctataagaaaataagctggaggcatatagcacattctattttaaaacatagtggcctccctttgagagaaagtggtgctgttagtgtcattttacttgagagagataactttgtggcactagtgatgcttttatgtgcatttatccatttttatcagcctctttattccctattcattcattcatttttgctttttactctatctctgtaggccttaatgcttttgatatttggctgtatttatgtgttcatgcaatccaaagcagacagagcacctcctgattcaaagcaaggctctgcgtttggcactgttggggatatagagatgattagccactcttcttagtatgttattgcattttagaagataatgtcttgaagatagattattgtcttggatgaagcccctgattaagactggagaaagaaagttgattaccatatccaagatggaggctaagggggaagacttgaaggacatggatcctatacctctttttttattgcacctcatctcattgtatcacattgatctgttgacatatgtctcttccctattagagtgccttgagagcaggcttttgactcaatttgaatggctagaacctagcacacttcctacagagttggttatgcacctactcagtgaatgacagacatgagtctgagctataacttgggagggactgttctagaaaagtaaaatgtggtgaatatatgttactatgtagtgttttaaactgtcattgacatctaggaagaagatgttaattgacttggctttggactgtggcaggaaaacatttagatctcgctcaaatgttcatgacagtcttatttaaaaggtagcctacattgttctccttactgcttattacaaaaatgcacatatcccagaaatcaaaaggaatgctatgggattccgaaacttattgccatctgggccatgtgtggctgaactatgaaaagtcattcagtcagcaagatagaaataacatctgcataggcagacaacttagcagactcagaccagctttcctctgaagcccagctgccattgtgactcatggcaagttcccagcttgaaaaagcaaagaactgaaaagcagaggtacctaacccagagtggagaccataaagggcagggaagcacacaagtcagtcttctgacattcctgaacaaatagatttcctttaactcatttatctccatggagtcaggttgactgttgggcagagaagttggagagttggaggggaagagtgacagaaacattttaattacaaagttaggttcgttatagaaatgcaagcctgtctcaacagttggtaatcagtatgatagatctctcagtatgagagatttgaagtaaataggccatatcatcagtagaaacagaaaaaaagctaattctacccaactgtatgtttgtacccattaaccattccctgtctacctccccctgccactacccttctcagcccctggtaaccattattctactctctatctccacgatttcaatttttttagcttccacatatgagtgagaatatgtgatatttggctctctgcacctggataattaaaaattttaaaaattaagaaaataatgccaactcttaaacacgtcgaagtgcatttaccataaaccaatagtaaacatcataataaatagagaaatataaatggcattttcattaaaatcagaaacaagacagggatttccccattgttactactattcaacactgttttagaagtactcgttagtgttgtgtgccatggaaaagaaattagttttataaataggaaaatgacaaaattattattatttgcatacagtaccactatatatctataaaatccaagagattcaactataaaatcatttgaatgaataagaatttaactgggtggcttggtgcaaaatatatattattaaacaattgcttttaattatactgacactaaccagttagaaacaggacaaaatcccattcacaaacaaggtagtaatttaaaaaattacccaggaatagaattaattaggacaatacaattatgacaatacaatctatgtgagattaatcacaacattgtattcaatagaaaaaaaaaaaaaaacaagagctgtagaaggtgagagacataccatgccccctgcatggcaagaattatgttatcttaagcacttaataatattttttaaaacttaagatcatgattctaaagtttctatggaagaacacaggtgctgcaattgttaagggaatcttaggaaaaaagaaaagtgaaggaaaagtgccccgttaggtatgaaatttaatgtaaatgagagtaatattggtccaaatgtggacaagcaaatcagtggaacagaatggagaatacagatccaggtatttgtgggaatctgctgcatgataaaagtattattgaaatcagtagcaaaactgtgactttttcaatatatggtgttagaagaaaataaaaatagaactgcttcttcacaacatgtacaaaggtaaattctagatatattaaaagtaatgtaaaaaagaactactgaagtattagaaaacggtataaaaatatgtatatgtctgtggggtgatgttccttaaacaagacatagatccatgttctttaaagaaaaaaaatctctacagatttaattatataaaattaatctattggaagaaaatatttgcatacatctgatagaagaaagtcttgatgttactaatataaaaatactcctacaaattcataagagaaaagaactacctaatagataaatgaacaaaggatttggataggcaatttaaaggagaaattacaaatttgttgaaacattcatttggaatattattaggttggtgcaaaaataatcgtgcttttgccatttgacagagggagtaaattaacatatatgataaacccactgtatgctaggtactatgaaaagtggaatatatcttctcatttaagcctcaaaactcattttacaggcagttaatgctaatttagccattttacacataaggaaattgaggcttaatgagtttgactaactcttccaaagtcatgcagtccaaaagtggcaaagctagcatattttctggagatgtattgtacagcatggtgactatagttaacattaatgtgctaagagagtatacgagttagtgggtgcagcgcaccagcatggcacatgtatacatatgtaactaacctgcacaatgtgcacatgtaccctaaaacttaaagtataataaaaaaaagaaaaaaaaaaccaaaaaataaatgttctcattctccaaaataataaggatgtgaggtgatatggatatggatgtgttaattagattgatttactcattccacaatgtatacatatatcaaaacatcatgcactatccacagcctgggaaaatgtgctagttggtggcatagttagatgaatttttaggtcattaagaaaatataccccaacattgttgacttagagctgataatgcattcctagttcaaagaggacttcaagtagccagggaattcagtctattgattctggcttgactgctaacacacagggaaatcctcagcaaggctctcagatcccatgaggtagatacataagaggcttgaatgattgaaccaggagaatgctgaatgagggctctgtgtctacattgttccagggttttgaggacagaccagttattttcttaattcttgtattatcaaagcagatactcagcctggcttagtagaccctggagggtgcactgtagtagagggggccatgcaggctcttctctgtctttaaccctttattgttcaacctataaatatcgaatttgaggaacccacaggagccacgctagtcaggtttttcaattttgatgatggagagggtgtatgccaataaatattattccattcattcctttccaagttaaaagttcattgggaaataaaattcaagaggtggagaaatggagacagaatgccagaattattactaataaatccagcagaagaatttggttttagatctatagtgaaaagggttttctgacatttgtactctgtcacatcccccaactctctcaagtccagacatcaggacagcaaacccaagggaaaggttgagcccataggagccactacatttacccagggtgctgcctcttactgattcaaggcagatagtgacagaaaagtgtgaatcctcagtgcctttgaccttttttattgcaaggtgatatagtttggatacttgaccctgtccccaaaatctcatgttgaattataatccccaatgatggaggtggggcgtcgtggaaggtgtttggattatgggggcggatccctcgtggctcagttctgactttgttatagtgagttctcacaagatctagtcatctaaaagtgtgtggcacctccgaccccactctcttgcttgctcctgctcttgccgcatgacgtgtctgttctctctttgctttctgctgtgattgtaagcttcctgaggcccccgtagaagccaagtagatgccagaaccatgcttcctgtaaagcctgcagaaccatgagccaattaagcctgttttctttgtaaattaaccattctcaggtatttctttatagcaaagcaagaatggcctaacacagaaaattggtaccacgagtggggtattgctataaagatgactgagaatgtggaagcaactttggaactgggtaacgagcataggttggaagagtttagagggctcagaagaagacaggtagatgagagaaagtttggaacttcctcgagactggttaaatggttgtgaccaaatgcagatagtgatatggacaataaagtccaggctgctgaggtctcagatggaaatgaggaacttattgggaactggagcaaatgtcacgtgtgttatgcattaacaaagagcttggctgcattctgttcatgccttagggaatctgtggaagtttgaactaaagagtaatgatttagtgcatctggtgaaagaaatttctaagcagcaaagcattcaagagctaccctggcttcttctaatagcctatgctcagatgcaggagcaaaggaatgacttaagttagaacgtatgtttaaaagggaagcagagtgtaaaagtttggaaaccttgcagcctggccctgtggcagagaaagaaaaagctctttagggagaggtattctagcaggccacttgctagaggtatttgcataactaaaagtgaaccaagtgataatatccaaggcaatggggaaaaggcctcaaaggcacttcagagactttcccagcagcctgtcccatcacaggcccagaggcctgggagaatggaatggattcatgggccaggcccagggcttcactgctctgcacaccctcaggacactgcaccccatatcctggtcactccagttccagctgtggctcaaaggggcccaggtacagtttgaggtaccactttggagaatgcaaaccataagccaaggtggttttcatgtggtgttaagcctgtaggtgtgcagaatgcaagagtgaagaatgcttggcagcctccacttagatttcagaggatgtatgaaaaaagcctgggtatccagggagaagcctgctgcaggggcagagcccccacagagaacatctactaggacagtgcacagggaaaatgtggagtcgaaggccccacacagagtccccactggggtgctgcctagtggagctgtgggatgggggccaccgtcctccagacccgagaatgtcaaatccatcagtagcttgcaccctacacctaaagagtagctatgtcggctgtatcctgcaaagccacagagttggagctgctcagggccattggaggcgactcctcacaccagcatgccctagatgagggacgtggagtcaaagagattattttggagctttaagacttaatgacttccttgctggattttgaacttgcataggacacatagcccccttttttttaatgctggaatgagttaagattttgagggactgttcggaaggcatgattgtattttgcaatgtgagaaagacatgaggtttgggaggggccagtggtggaatgatatagtttagataattgtttccacccaaatcttacgttgaattgtaagccctaatgctggagacgggacctggtgggtgtatagatcatgggggcagatgtctcatggactggtgctgtcattgtgatagaattcccttgagatcttgtcatttaaaagtgtgtggcacctcacacctcattctctctcttccttgctcctgcttttgccatgtgatgtgcctgcttccactttggcttctaccatgattgtaagcttcctgagtcttccctagaaactgagaagatgccagcaccatgcttccagtgaaacctgtagaactgtgagccagttaaacctgttttctttgtaaattacccagtcttaggtatttatttatagcaatgcaaaaatggcctaacaaacagtaaaatatacacaacataaaatttaccttttaactattttgaagtatacaattaagtggcattttgtgtattcacaatattgtataaccacaacatctatctagttttaagcatgtttattaccccaaaagaaaacccagtacccacaaaacaattacctccccctgcaactttccttcccctaagatcctggtaagctctaatctattttatctctgtggagaatttgcctattatggaaatttcatatgaatagcatcatgtaatacgttgccttgtgtgtctggctttcaccatttagcaaaatgtttccaagagttcaaccgtgatgtagcatgtgacagaactttcttaatttttaggactgcatagtattccatagtatgcatataccacattttgtttattcatttatctgttgatggacatttaggccgtttccactttttggctattgtgactagtgctgctatgaacttttgttttctagtatttgcttggatacctactctcaattattttgggtagatacctagcagtggaatctctgggtcatatggtaattctatgtttaacttgttgagaaagcaccagactgttttccacacttgtggctttaaaatattgataagcagccaggtgcggtggctcacacctgtaatcccagcactttgggaagccgaggcgggcggattacctgaggttagaagctcgagaccagcctggccaacatgctgaatctccgtctctacaaaaaaatacaaaaattagatgggtgtggtggcagtcgcctgtaatcccagctactcaggagactgaggcaggagaatcacttgaacttgggaggcgggggttgcagtgagccgagattgtaccactgcactccagcctgcatgacagagtgagactccatccccaccccaaaaaatattgattagctttccctaattgaaaagtgtagcccagtggatgtgccccactaattagataacttcctcctccttggggtggggtaagtcacacgtgggtataaagccaggatgttactacacctgaagttccttcacatgtgcacatagggcagggaaaaagagcatgccatcttcaacagatgacatacagctgggagcaataactgacatctagctattaaacacaaacttcttgaagacctataatgtaccaaaaattgtggcaaacattgtggatccagaaacaaggaaaattttcggtcctccataagctcagattctaaaagctgagcactaatttttaatgaaatcgtaatgcactaatcagaatccacgatacatttaaaaatccaattatctgaaatacaaatttaacattatacggggatgtcgctcaatgataagtgacctcactctcacattacgtcagttcataaaatatgtagaggaccatgtccaaaaaattacacataattcagctaagatgagcactgcacaaaattgaataaattacagtggttcatctgtctttaaaataatatttaaattaagaaaccaaactaatcactagctgaacttgattattaaaatcaaattttttttacataaatgcatgttaatagctagacaacatacactgcaataattgcattatatttgtcagtttcgatttacaactgaatttaccatcatcatgtaaaacatgaatctgtccctaaactgagtgcaggcattaccaatgagctgattatatctccacctactccatttaaccatcgtcaggcactacctgaaatattatataccaacacagcactccattcttgggatgattcctggtccaaatgattcatttctcatggatctgcctccacatacccaaaacccatgttccgtatcattggatatcacattagtgtgggccacagagaacacccatctcttgctaagaacaacagcactattctatagacagcatagctctggcttttgaaatggaaagaaacacatgtaaccatgccgtctttattgctctgtgtaacttttatttaagctcttaggtaatttagacatacccattcttctagttaatggctaacagcccagtattgtcaaataccatgatgaaatattctgacaggtctgcagttttacacatgtgattgaatgttcagactactttctctccatgacaggctaccaaataccatacataatttgagtatttttgacagaagaatgcacatcattttctttctagggaataacatgcttttgaggtttattacccgaatttgaacacattcttatagtggattttccatattgttcttccaccaacaatcattaagggttgtgatgttgtgttcaaatgccatcttatacattaaattaaattcaagttggtgtggttaatgttattggaaaatacctattaggcttgcttgaaaaatgttaggaactgtgattgcatttagaacacagaatcagacttatggaagcaactgagttctattaaagtacctgagtttatgtagaagagcaaagctaaaatgtgactaagtgcaatgcttaaaacacactaataccagttaaatggataagtacctgtagtaattaataaaaaaggaaattcatctagaatataattttaggtgtcaataggaggagtccatcctgcagaagagattcagatagaaattctacttctaacctagataaccatgtattagtatcagtgcttttgtatgcacgttataatctcagctaatcctctcaagagtgctatctcattcatttaaatgggttataatagaaaatggatctgctcattctattctacataataggaaattaaaaaaacaacatcctttgttgtttaagcatacatattatattgctctactgaaggttgtctaagcttctattttcttagacaatctttttttttcttcaatttctattttaagttcaggggtacatgtgtagaatgtgcaggtttattacatagatcaatgtgtgccatggtggtttactgtacagatcatcccatcacccagatagtaagcccagcatccattaggtattcttcctgatgctccccacccccacccccacctccgacaggccccagtatgtgttgttcccccgatgtgtccatgtgttcttatcattcaactcccacttacaagtgagaatatgtgatgtttggttttctgttcctgcattggttttctgaggataatggcttgcaacttcatccatatccctgcaaaggacatgatctcgttccttcttacagcttcatagtattccatggtgtatatgtaccacattttctttatccagtctatcattgatgggcatttaggttgattccatgtttttggtattgtgaatggtgcttcaatgaacatacatacgtgtgcatgcatctttataataggataatttatatttctccaggtgtatacctagtaataggattactgtgtcaaatggtatttctgcatctaggtctttgaggaattgccacactgtcttccacaatggttgaactgatttacactcccaccaacagtgtaaaagtgttcctttttctccacaatctcgccagcatctgttgttttttgactttttaataatagtcttaggcaaatcttgatcttctcctacccctcccaggattttggtttttaagtgtcttttgatgttgaagattgaatctatgttctatttctagctgctgtgcatctctgttttcctccatctttaacctcctctccccttacacaggtgatccttcaatgaaacacaattccttattttgtgagtctctcaattcacttttatgactggatattgtttccaaattccttggcaggtttagttactacagtgattagatgaggccatgatgtggccaggcattggaatcagaccagagggcaagttattcaacttctctgtgcttcactttcctcagctgtgaaaacagactaatgatagtacttacctgataggactattgtgaggattaaatgggataaaacacttaaacactttatatagtccctggtaagtgctcaactaatgtaacaaaagacgttggtgaacattagggttcctcatccataagttctctcaggccatactattaaacaaaccactcagaaagtatctcactgatttattttaatttgtttgaaaatggaagtatacaaccttttcaaaacgttttcccatctctagtcttctgacacgtctcatatttttcaccttcccttgcattataaagggtcattcagaaatctgatctgcaggtgttctctttgcctgggatgccatctaaatgtatcaggagacttagttcattcataatatattgatagaatgcctgctatgtgacagttgccgttctagggatatagggtgaaaaaaacaatatccatgacttcatgaagcttcaatcccggtaattagaaatctcttaaatagccaggggttcgtttccaatctctttgcctagctttgtcttccttattccaccccactccattattctgttacaaactaccttagttgtaccttttccaatctttggatcattacctataatgaagaatacataagcaaaacagtagttgaaaatacctgttttccttctcctctggttatagcatgctgttgttcccaagaacaagcctacgaatttctcttttatttttttctggaaaatataaaacacatcctttttaggaaagcctcaccttattctaggctttaatatttctgacactgtgtcaagggcttcagaaaatcttgatgcaaaggaaagggctttgccttcaggctcaactgaacttaaatctaaacttaattgcttcttagcaatgtgtgtgacccctggcaaatcatttacctttctgaggcttagtttcctcatttttaggtaaggataatgaatgccactttgtggggctgtcatgaacattaaaatgaaagaatgtctataaagcactttgtacaagcctagcacaaattaagtgctcaataaacattaactatttttagcaagagccacccagtaaagaaggcttggtttcaaatctctgttccaagcttactagctgattaaccttcagcaagttgctcatcttcactgaatatgggcttccctttctgtaaaatgaaatttaatatctacttatctgaataattgttctaatgattaagtgagaaaaatgtaatgacattgtacagaatatattccttctacttttatgtcttttgctcactaccaaatttttcaaggccttgtatccagccctgggagaataatatagacatgatctcttgcccttttggagaaagacaaattatgtattatatgattagaaatgatgtgaaaattttatgagggaaataagcagtgctgttctagagaataatggttgtttaatttaaatcagaagagaggacttcgttaagagatgacatccaaacagatccaaatgataagaatctagcaattggaagaacatttcagccagagggaacagcatatagaaagatcctgaagtggaaagagcttggcctgttcaatgagctaaaagaagcctgatgtcccgatttttttgagagaatatacctatcctttatttagaaaagtaaggcagagttgttgacattatcaaataaactagaggagtcaagggagtgagggcaggtaggaaggttttaaaaggtggtcatggtaaactttccaaaataatatcaatattttatcagttgggggtcccgacaggaaacaggtggtacatgcaaagtgggtagctagaggataatgtaataaagggatatatacaacgctgtggtcggggtttaaggttaatagttaaagaaagccaacaaaggagaaggaagcatcccaggacaagcaacagcaggggtggattatcaccctgtgtgttgatgaaactaggagtgggggtggttacagagcttggagagggcagcagctgcatggagaaggcctggtaaggtttttggtagaggaacataactgctatcaatctgtagtccagaaccaagggatctggtggtagggacacataccctgcccttctttcactctcttgccagtacctcctattgggcatactcaagtggaagccagagggaaaagggagttggtttgatgtagcctgtagagatcagtcttctggggcacacagaatgtggagaggggtggagtatagatccagagagacaaattcaaactatccatcacaacatctaatatataattgtgctaggctgaataatgccttccccgaagatgtccatagcctaatccctggaacaggtgaatatattaccttaaatggtaaaatggactttgcaaatgtgattaaggattttgagatggggagattattctggaatatttgggcaggccctatgtaattgtaagggttttataaaagggaggcagacaagagaatgagatgtgcccatggatgcagagggcagagtgctgtagagctatgagccaaggaatgcaaacaacctcttcaagctggaaaaggtgagaaaatagattctcccctagagcttccaggagaaacacagactgctaacgccttgattgtagcccagagacctgttttggaattctgacctccagaactgcaagaataaatttgtgttgttttcagatactaaatttatggtaatcttttttttttttacagcaccaataggaaactaataaaatagctttctaattctatactgttttttactactgtcaagcatgctcatgaacattacctctttcaatattcacagcaattctgtgaggaaggaattattttctttagtatatggagagagaaagtgagggtcagagatttgaaaagtcttgcctatagttatcacatgatgcagctagagatgaaactcagcttttttgactccaaatgcagtgtccttttccctcaatacactaaatttttttctgcagagaagcagcagaagaaagcgaggcttcagggagatgtgggacaaataggtggttcagtgtattgtggtagaagagttgtctccattggagctaacagattctattgcttgatctgacctaccttcagattcagagtatcaatgctcactgaaacccgtgtgatatggtttggctgtgtccccactcagatctcatcttgaattataactcccacaattcccacgtgctgtgggagggacccagtgggaggtacttgaataatgggggtgggttttcctcatgatagctaataagtctcatgagatctgatggttttaaaaagagttcccctgcacaagttctctctctttgtctgctgccatccatgtaagatgtgtcttgctcctccttgccttctgctatgattgtgccacctccccagccatgtggaactgtaagtccattaaacttctttcttttgtaaattgcccagtctcgggtatgtctttatcagcagtgtgaaaatggactaatacactatgcttgatgcaaggcagtggttttcaaacccatgtttggagcaagccccagaaacctagggcttttgaggaaaaggatgtggggtgatggggttctttcaaccagagaagctctatgctcatctattttttaactaattgactttgatgtaggccacatttcaatttacaaaaacaattctggggctaaaaagaagtttgaacataatggtggacattctgcagactttcactgtagatgataagaagaagtagaaacgtagaaactccagggtgattttcagtaaactccatagaaaggaggatgaggtagagcagaattcttggagacccccaagcacaagctggctgtgagaagcagcagaatatcatatatatgacagcatctgggctcttgtttgatttttaaagtagattataacatttggaactccatatcctatgaggcttaaacacatttgtgatggcgggatgtttctgttgcattggcaaaggtcaaaatcaatagaattcgcaaatgttcccctatgtcataggtcaggtgcactattattccatagatcactagtgactttctctgtgatctttaagcatttgtttgacataaaaatgacttttaaggtttacttactggtcccttggcaaactaagaacacttcctatctctaatgctttaaataaatcatctgaaattattgcacattgagctgttactttgactggctgctgagaaatgtgcttgtgttttaaaggacttctcttttggaggtgggtgagtgggtgaagaacctctttttttgtctgctcctctagaaatggtctttctgaatgaaatgagcacatcagagagctatgtccctgaaatgctcctcaaccctcctaagcccaccttctctgaattgtacttcagtattaggtgctggacctccaatagagaacactccaaaaattcttcatcacagacttgtcgttgtctttatggtaggggtggtattgggagcattgtccagaatgtcccaaatacactttagaagaacccgtgaaaggaaagaagttctctcagacctcattgccaggaaaagctgtgtttctcttcagcaactagtgtgtttttacgcttatgagtatttggaattttgttattcagtcagtggccagacccactgaataacaaaaccatagctgcatattagatatgcatgaatgcatggccccactctcaggaacttaatttttcaaatggtgaggctaattttgcaaaaatgctcctcctgattctaatatgtagctaacgttgaagatcactattataacaaaatagtccctgtgatttagtcactggaaaactcaaaatcaagcctggggcatttttgaacagttatacagtaccggatgtgcctttctgagtgtggttctgatctgggcttgatcatagtgacatgttctgatttactcttcctcctaatttctttacctattttttaaatcaatttttcattatatatttattagatctgcttcaaatgattttgaagtgaggcaatagatagattggtagatggagagatgatagaaagatagatcattgccaagcgatgtttatactgcgtctagttactgctagggcatttttctaacgattagatacagcaaattgaatgatatgggccaatcctgctgcagaaattatagaaaacattgtcttttgtgttgttattatgaaaacattcccacagttctttcatgttttaataaaaaatgaagaattattaccaatagctttggaaagtaaagaaaaaggaaatttaaaaagtaattcctaactccaattccccaacatcacaaaacctttgattttttcagagcattcatctatccttagaagacttctatttaagaaaataaataggagtagaaaaatcaacaagtgaagtatttaagaaaaataagcccagtcttcaagatgcttggaatccgcatttgctacttgcaagtcacataagaagaacaagccacttattttagtgacttcctgctgggctccagacaccatagcctatgagatctctaaaactgggcccctatttactttttcaactttcgagccattcaccacttcccctcccctccattcccacatacaactctagtcaggataaacatattttagtttctagaacatggtctttcttctgggtcttcatacatgttgttacctctggatcacattatctccccacttcccccattcacccagctaactcactccccttcattctttctatgttttgccttagatgccatttcctactggagcttctttgagttttcagacttgcttccctgctgtaggtacttttcctattaagccacttgttccaatgaatggtgattacttagtgaacatccgtctcttctgttagactataggctgtggacgctggttttgtcactgtatttccagcacctagcacagtgcctgggacagagtaagtactcaaagcatatattttgctgttgttattataaggtttatgtttttcatgtttgaaaggcacttgtaatatgtcaataattctgatagaagtcatttttagagaaggacgccataatcattcagtgagagaacacagaatgctcagacagtatgtggaccctgtagctggacattacttttccctgctgatggttttctcttcagatattatgttagagattataataagacatgtagcaatggagagaaatcagctcatcccaaactgattttcacttttagttaacacttgctctatgcaagaaaaggtcatattagttggtagcttgaatgcttccaagaccattgcctatttcaatgcttcaaagcttcagaagctctgccctgtgctgcagtcatttggtgtagaagtggaaggtgcctgaaataagacagttaggggttagaagcacagaggcgggtgttataaaatgtcacgtatgtttacatggcttttttctcagtacaattttgattattgccttgtaagcaagaccctgtagtatattgaaaatagctctgaatttgtagtaaaaactttttcatctttctacttcctaacagtgttactttggacaggccaatacatcactctgagctttgatttccttatctctaaaatgggggcagtgacataagcttcatactaacctggtgaaaattctcttgtacctaagtcagtgatcgataaaggtctattaaatccaaatgtcaaggaaagacttacctcattggatggaataagtgtgaactttctggctttcctcttttgcaaagtttgtgaatgcatttaatcatttttattagtagtagtattacttatttacccctctgcaaatcagttatgaaaagaaaaatgtcaaatgtaacttacctttccaaagaaaattgatttgttaaagcaatagttgccagaaactccaattttgctctgatttgatatgatccagtacaagctaggagtttcctcacagagctgaggggaaaaggaagagccaaaaaatctctccaaattagcccatgaatgtgagctgtagttttttttttttttttttttttttttttggataatcagatattctgactttggtcttctaattattttaccaggccaggaaaggagagctgacaaataagcctgattcttccttggcaccaaaaaattcaaagaagaaccgaaagtccattgaagttcttgtttcctttgaaatgcttgtgatctgcctcctgagactgcaaggttattaacttgcatcaggaaggtggtagagaactgaataaagaaatatccatccatctcagttgtcgtggttcttctgtcattcagaccccagcagagcaggaagcagtgagctggaaagtgcatacattggtttttccttgcttctactgaaggatcaaaactccttaggccactcagtgacttggttgatgccttccttcttcctacctttgcctttcaatatctaagcaaagttgccctttgtttatgtctctggggttttttctctttccttctcagaatgtcttttcctcatttactcttattcccaaacaactctttgtgtaatctagctgggaacacattgtatgactacttaggtataatacagaggcatagtgctagaagtatagagataaatgggttctcagtgaccatcctaacagttatacttggtggttttcaaactgtgcttcaaaagaaccctataggtatattctgaaggaatcccaaaggttttataaaaaggaagttggtggaagatgcgtggtttggtgtccaaggaaagctaaacagaaagggctatgggcaagccatcatcacttccaccaaagaagttccgctttaatctgtatcttatatttggcattagcaaatgtttagataaagagttctgtggccaaaacaattagtggggaaagcatctgcttagccctgttacttatctgtagaggggtaaggacctaagtaatgttaataatgttaacatttagtgttaatattattttgtatctgctgtggttgcatagatgcatcttctgtttgctcaactggaacgtgaacccatgaagatcacggcctaggtttgctgtctttatgaatagacacctggtctgttcttattgggcataactctgtcttatggattggctgctgttaaagtttttggagctgtctttttttaataatctaaccagagttgtagaaccactgttataaaatacatctgtagacagcacaatttacatattatttcaaggagttctggtgtcactgaagtcaaactatgcactttgagcataagaaacctggcaggagaggcttcttgatttaccatacaaacttctggagcatgtttgtttggttttttttttttttgaccccgatctttagaactgcccaatattggaattggaatgggctacttcatgacagactcaatgcttgattcctttgcatcaacccagaacatattttagattctattgtttccaatttctacatatgtttccttgggcaaatcacttaatttatcagagtctcagttttcttatctgtaaaatgggagtaatgatattgcctactttataatgacctcataaagttgttgggaggagttaattaggtgggcacagagtaggtggtaaaaatgtcagttccctaaaattccttataatttattacagaaaatacaatctgccttgtgtggaaaattgaattagatgctcttgggtcccttataatgctgagattctctgttggttcatcctttctgctttgttttgtcaaataatccagaagctgttgcctttttgctttggatttaccttcaaatgggttttaggtatagaatcttgggaaattattattatttttttgcctcaaaatccagcttaaaaatgttttacaaatatcttcagctgctttgaagggattttacatctttattgtaaagtggctctgagtttccctgaggaagatgagatttttgactaaattgctgacatgttgcactttgtagccaaattgtctagggagatacacatttatagtagatagtgtacgcttagagtttgtgatgtactttggcttcaggcttttaaataagtccgccaaggcctgttccaaaaaccagatctttaaaacgtataccttttaacatgcctctggtggactatgcttccctggattcaagcccttccttttaacctgggctagcatttgactaattgaatgtggcagaagtgacaatgcacaactttgtaggctaaatcataagaagacttgcaacttcagtctgtgttttttggaatgtttattctgggagaagctgggaaccaggtaagaagtctgactgtgtactccaccatgttggagaaacttaaataggaagaggccacatggagggagagagatgtctgaccagcccttagctgctctagtcgtcccagctgaggtgccagaaacttgagtaaaatagccattttagacatgcagccctggtggctgcaattgcagaagagatctatctaagaacctcttagtttggcccagttaacccacagaactgtgaggtaatatagtaaaatgttgttttgaattactagttctgggtggtttttacacagcagtagataactgaaacagatgcctaaattacacatcgtttgcaggcacacataaatacaaatactggtgaattatttgaagctaccaccacagtgtctggtaggattgttagaggtcctggagcttcctagtaattaggccagctttcgttgccatttactcaagtcgttaaggcttagctgctcagatcaagaaaatcatttgttattaggttcaaggccactgagacaaaaatccagcttttatctttcccattggactctttggcatcaaaattttcactttatttcttattcttaagttatatggaggatttttgccatggttctcccaaattacttgccaggctaactctgtctaactttgaaaactaggggttggcaaagtagggcctgcagacagtccacatgtttttgtaagtaaagttttattggcgcatgcttatttgtttacataggtctatttctggatttgcactataattgcagagttgaatagttgtgagaaagatggtatggtgtacaaaactaaaattatttactatctaacctttacagaaaatttgccaaaccctggtcttgactattgaactaactggttaatgatatttgagattctgtgcagtatcatagagtcagtctgagatcttgacttcatgataatgttcttctaatttcatctttgctggggatcaccaagcaggtaaattgagcctcatataacgtatgttaagtacctactatgcaatagttactgtaggagagccagagatcacatcacctccagccctacttttagctcttagtgggctcttcagctggatctagaaactaaattgacaccaggcagattaacaagataaaaacagacacattttattagttttacatgtacaggggatcttcataagagagtgaagtctaaacaagtggccaaagcaagatgcttatacattttctgacaaagagcaataaatctgaaaagaaatggtaggactaagaagatctggatagggcagtaaaatttcctagaggagtcactagaagatatattacgggtgtaaaacaggtggaagatatgagttacttcattaggtatgtttattcatgtccatggcagccatcaattccaagtgtctggtaataaggacggttttctcaccctggtttagagagggtacaccttccagaggaatcttcttggctttcacggcttgctgaatgcaggaagagccaggtttctgaaactacaatttctccagtgttttcaattcgaaataatcactttacttatctggcatattttggagtggcactccttcagtaccatgatatatgctttcttttatgccattcattgctacatataataatcctgtgagattgatatttctgtctccatttaacagtaaggaaatttgagactttgagagaaaaaaatgatttccttaaggtcatacagctactgacatggctaggctaggacatgaacccagtccatgggcccagtattgggttctttattctatactagtgctttaaaaaattttatctcattattttattgtatgtatgtatttatgtaagaatttatgtatttggcagtgggcatcttattttacttaaaaaaagctaccaacgattctatccaatgtgtataaaacagattaaagcagaacttatttgattaaagtgctcctgtgatcatacacctcttctttgcaacacacacacacacgctctctctctctctcacacacacacacacacacactgtctttcacacacactctctctttctctctctctctcacacacacacacacactctctctctctctctctcacacacacacacacacacacacacacacacacacgctctctctccctctctcttctgccttaactgaaacatatggtggaccttttcaggacctataacaaaagatagaatgacatgaggtttggaccatcatcattcagtctttattttcctcatagcacaaacacctgattgctctattgcctcaattccaggaatttccaaggcattccatacaattgaaataagaaatcaaggattactctatttgtttgtgtgaggtgtggctgctttaatcacttccaagctccagattttcccatcaaatccaaggtagtctcaataccattgttttcacaaacttatttttagcttggcacttccatgtggatggagttttatatacaaatactaaaaaatatgtttataaagatatttagtgaaatcagaaatctttttagtgcaatgctgataaaagagctctgtatatactgcagtctcagctttccctgcatgatgtatttaagtggagaagtatgtgttagcttacttactcctagacaagtacaattggaggaacctgtgcttaaataccgttagtgatctctgggtggaggggttctgtgtgactgacactgtctgccttagaactttttgtattgtccattcttttgaaagcatgtagaaatgatttgccaaaaataagtatctgtgtatacttgtgacactttgtgatattgtttcaaaaatttgagacgaaatggctggcttgagagaacaggcatatcttcgtcccagaattccttctctctgagtctagaaatttcctttcatttttttttggtctgcctgaatttttctgtttctttatttgcagtgacattaaagagagagcacaaaaggcctttgaccttttatttagcgtgtttacagatgtatctctacttacagcttatcagtattgaatgaaaacttgactggaaacacacctctctgtgttttgaacaaaagaagaacagatgttaatccatgttacatgttttaaatgtcactgtcagtgtatacatttggatgtaaataaactgaatccatgtggtaacttcaaagtatgaatgagattatatttagggagacaaatggcttgagaattttaaaacttacaaatgagtccttatactcaggaaagaaaataggtgacatgctgtattacttttcactgaaagtttcctatatgataaagtttattaactgcacagataagtttttgaacatttatgttttggggaaaatgtagaatgaaaacttgcatgccattctggaaaaaaggttatgcattaatgccacttccaaattcaaaaagatcagtgtcacattatgtaaacatctttgtatcagttatattgcaagtgacagtacattttataaggtctaaggaagcttacataagaacaaatattttctcaatacaatcaaatgccactttgaataaggggcacagtagaggagatgcaatggatatgtgtaatgtgtgctaaatttgtgattgccttgggcactactaaagccacactgagtaatttcatttgacagccaaaaaagaggagttaaaggaatgtggcagtttcacctcctatgtctattcacaaactcccatggtgacctcattaatcttggggaggagaattactcaaagactggatgcataatgccaaaatgactgcttgtaaaagttagtatccagtccatctgccactggttttctttatgctggcgtttggcagttttataaaggagtgtgccaaggtgtgctgggtcacagtttggggaagagaatgctgaatgaacactggttggagcagcaacaaaggtttcccttgcatactgtgcctgccagccatgggagctcaggctcaagtcctcccacctctttattgctactggtttgtcaccattctgctggcgagaatggtagtgagcagcagggaggaagccacagggtttcccaccagagaaactggactgtcccggcatgatttgcatactttggcacaaacaccagaggatactgaccttgggccttgatgtcactacaccagacaattggttgaactgatatgctttacttgccttgactaacattgtgttttgccaattggccaattgtttagtggccaaggagactcactgactttagatttgaattcagtaaacattttttatgtgatttactttgtgccagacagtattctggtcactctggcactttttatctcatttaataatcataatattttagaaataagttgatatttttattttaaaattattaaaccaaggccctctatttcatgctgtggctctcctgaattcaaggagaaatatgttaacgttaaaaaaaataaaattgtatcacataatgtgacataaagatgagggcatcatcttttaatagatatatattattgttaaaaatgttaattaggtattgaaaattataacaaggacatttcaccagtgaagtggtgtaagggcagggaagttggggcaatgggaattggaatataatgagccacattaagcatacacatgtcaagtctagttctgaatcctgtggcaggccttacaagagagtccatgagtcagagaggtgcaaatagaaccaggaatttgcattgttgtggatgcaaaggaggaggaagtgttcaacattgtcagatgtagaagagaggtctagaatgataaagactgaaaatagccataggactttgcagatgggaggtcaatgctgaccttaccaagagccccttccatgaaattgaaagggcaacaaacagaaatgcagaatgagggatgagtaggaagggaaggaagagagaagattgttagtgaatagtccagtccttccaaaggttgtgctgggaagaagagtggtttctagagggaacacatctgtaaggaagaggtatttcttcaagtttaaggaaatggagcatctctagcataactactggagtctgaaagaaaagggagagaatggtttgagatataggaagggacttgaagaccaatgccacagaaggaacagaaagatgtggggcagggcacagagggaactgattgaccttcaactggatgagagaccccactgtcctcactcttgaatgcttatattgtgaggtggaaagttaaagaaaatcatagctgatggcttcaattgtcttgatgaagcagagaggccagcaaaatattgaaattggaaggaatggggattgatctaaggacttttgagcaagggagtaaagactgaacagggtcattgagcagaatagaaaatggactgaagaaaagtataaaagagtgtagctgaaaatccagcaaaggttggaatttgtaatgatgccaaacttccagatttgcatgtctttctcttgctgtgtaaatcagaaagggtggattgtaaaattagaccagggtttgggatttagggttttggcagaaggacagtggtgaaaagacactgaggggactggaggacaagtggtttttaatcatagccatcatatccaggcagggcaggaaagaaagtgaagataggaggcatttattaggctgggaggagatgcagagacctatggatggcaggactctttgagagtgatgacaggatggggtagaagaagcagtaaactatgccccaggatcatcctgaatgtggaagaattattaggaggcctagagaggtatatagttgagaaacaaacatttcaagagaccagaggtctttagattaatgatccgggaataatgatcataatgttgggtaggaaacaacagggccagatcaccaatactctgatcctgcaatggcaggagtagatgaaagactaagcagtcttcacttgaaatcccttcagggaaagcagtgtcatcagagaagagccaggttccattaaaggtttgagttggagaagcattctgtcaagtttaggaagtatatgaattaatctactatgatcttaaggatccagaacacacaacgagaatgtttatggacaagggcagcaatacaatcttgaggcagagagaagcagcacaatggggtgagaatgagactgtagatgacaaagggacttatattcagggcaaggaccaaggatgacaagtatgggatagaggaatattgagatttgctggcctcatgttggtgcataaggccaatgggaagccctatggagcttccttgcaattctatgagttgtataaaagcgagtcatgggtgagagctcttggagtccagagctcgagtttgtataaggatcctaaatttacatagtactttatgtcagtttttcttaccaagctgggagcttgcttagatacagctttcaagttatttacattgcaacagactttttaaaaaaatggcttacaggggagacttttggtcaaaaatatgtttggggcactatgtgtggatttcattgattcctgctttccatgcacctgctagttgtctgtaggttcactgcccctgtgaacagaagacccagcccttctggaaaaaaaaattgttttaatggacctaagccaaaaatgctttaagcccggagaaacatttagtaattcttcagaaattttatagcactactgactggtgtggagcaggtagaagttgaaattttttcctgattatgaaagtaagatatatgcattgtaaaatatattaaaaatatagaaaaagataaaagaaaaaatcacattaaatctcaccagctgcagatatccactgttaacatttggatgcatattgttcaatattttgtgtctttgaatatgctttttagctaaaatgagatcatagcaacatattttatattttcttgattgtcttatgaacatgatgacgtcatcaataatcttctaccgcatgatattcagtatagtatttcatcgacttactgtatatacttaaccaatcttctcatgctgttcatctgggttattttcacctttgtagaattatgaatcaccctggtatgaactttcttaaagagaaattaatcttgcatacatttatgattacttaagatgcattcttagaaatgtaatgactggatcacagtgttttcttctctctctctctctcttcccttctctctctttgcttctttttctcttcctgctttcttgtctgcttttctttttttgctacaatttacacttgaaaccaattttatcctacaagctaagaatacattttagatttttaaatggctgaaaaattctaaagaagaatgatattctgtgatatgtgaaaattatataaaattatatgaaatttttatttcaggatccattaatacagtttgttgtacagccatgcccatttggttatatactatctatagctgctttcacactactatggaagagttgagtagttgcaacagagactatatgacccacaatgcctaaaatatctagtatttggttctttacaggaaatgattgatgagtcctgatttaaacctgaggagtttacaaagttattatagataatgtaaatcctttaacttgattccagaacaattttcttgtatgccatatactaatattgtgaatcagaaccccagtttccttgtctgtagtatgggtctaataatagtgataatttcaaatggtttttgtgaagggtgaatgaaatacatttcaagcatttgaatagtgcttggctcagaactgaaaagtaacatcactagaggacatgcagctgcttgcaaagtgtcccattggaagagtgtgctattcatttcaaaggaaggaagacagagcttgcttcttttggagaacctcatactgtatatgtttgacccacatctgccttttaaaatgattgcagaggctctttcatgtggctggggtgggaattggtctccctgataaagtagcaactttgggttgctatccttggtgggtacatcttagatgcttctggtggtcgaatgtggttgaatatatttcacttgctctacaaagtcactgtcagcagcacatggattgcaaatacacgtggaacaaacaatttcaccaaaggaaagataaaaactgggttggataaagaagatataaagaaagaaaaaagggacttgacggagtagagggaagccaacggaagaaaaaatattggatgtgattactgctttttaactttaaataaatgtaggaaaattatttttacaatgccctgtgtattgtgtgcctaaaaataatacagaaaacataggattttaagtgcattaatataaatgacttgagtaccccaatgctgctatgtaaccgaaggttggagttattgccccttttatgtaacttaagtcttttctgtgcttctttccatatacatcccttttttcttcctctctcatcttagaagaaaataatccctcttttcctacaaagactagtccattagtcctacttccccttcctcctcttgctcctgtcccatccttacctggcaaatctcccaccttgcttcatcaattatcctttccatctcacttactcctcaaccattccaagtgatactttctctagaaattttatcaaagaattctctctggtatttggagtaacacaaagaaagaatctaatatggataaaagagtctggtcactgacgtctcttaacataatcaattctcaatcatctagtccgatcgaatgtgaagtcgatgtggtggctatttatttaagtattcacttttaaagtatttaccatgcatactttgttcaaaatatttgaaaatccatcttcagcctataaattatttagattatattttcagtttctgaacacacaggctggtaggtctctttctctttcccttccttcctgtctttcataataatttattattggatcttgggattttggaaagagcttgtgttctttattaaagcaattctttggaattttggggagttcctttacaaccagtgtgtggtcagattttctaatgttctgcatgtgcttgaaagaaatgtgtattctctaattactgggtgcagggttctatatggtttaattagattaagcttgttaattatgtagttcaaatctatgattgtattaaattttgcatggttggtctggcagtttttgacaggtgtgtgttaaaactgctgctgcaattgtggatttattatttttccttataagtatgccattttgtgtcacttatttttagactgtagtgctactttattaatatttttacatttaatctttatataataaacctgtttattactggtaaaattgataaaagataaaaccttaaacaagtacttacctcttagaaatgttacaagatttaggggatggcagcccaaaatttacctccaaaagcatatctcttaattttgttaacttgtaaatgtaattaactgttcattgtgggaatttgaattattggcttcttttatttatacatacattttaattatttttggttgctggccttagtggagaacgtcttagatgcttctggcaattgaatgtggttgaatatatttcacttgtactaaaaaggaagtgaaatatattttacaatatatttcatcacccggtcataatcactgccaacatttcatcatacagccttccattcttccttctctacattttttttctggttgaggttattatccaattcaatattttatcttgatttgttttaactttcgttatagcttaaacattttctcatgtcattactaactcttttatacatcctacttctccacccctaacaaccaagagaattacagtgaaccttgggatgcaataaaatacacctaaaatagtgaatagtacagaactaaattgggaagaacagaaactaaagaatgtgacttgaccattaatcacattatttgcaccacagtttagaaacttgaattatcgagtgtctacaatggttgcagttcttggggaaagctttatagcaaaggtggaatttaagctgatcattgatctcttcgtcaatgctaagccaactccatttagcaaaggtactagggcaggtatgaaccaggccccataatacggagtgggtgatggaaagtagattagacagcagtaatgtagtaggaagacccgtcagctttactcttgagaggggcaggtatacaatttaccaagcagcatgggaccaaattctggaggacctagactgtcaaaaaagttgctgctctctgtgcaaaagagatgcttctagctgtgttgctgccacattgataagctggtagtttgagatgaggaaagaggaatttttatgtccccatgggttatgcagtctcaactacaaatttctgtctgtgaagaagggaaggacaaagcagaactgctttaagaaaggaaagcgaaaaacattaggctgattttgctggtgaatttgtaaccctaagttagcatagatcatcattttttgtccttcttataaaagtatgagaaagtataattatcctgatattaaataggaaggaaccagatctcaagggggttgagtaatttcatatgaccaacaccacaagctagatcttagggcagctagtttgacaggttttctattactttgtactgcttcttcagggctcaatgtgatactatttaatgatgataacagtggttgctagccttttttttttcacacctttgaggtctgtaaggtcttaatttttcctagcaaaattctgcaatactaaatatcagaaggaaaaaatttccagagaagtccagcattatagttactgtttattaagccctttttttttctagactggttcattgtgggattttatgcacacacacatagacatgaacactcacacacatatacacatcatatttatctaggtgtggatctcttcattgtttttgcctggaatttgagggactcattttatcaatatcctcagctttctcctcagctcagaaaagttatcctcagttatacttttaataattgtttttctgtcaccttcatcgaaatgcctgtgatggctaagtcagttcagcccttcatatctatagtcttttctctcttcttttccatgttttagtttttgacttttgtactctggagaccttcagaatgtgaggattttgttttattttctgtagtgttagtttggcttttacttaatgtgcctctcttgacctacctttccctccttttttcccatatttcaataaatggaaccttcatccacccaattgctcaagccaggagctctctgtgtctgaattcttacagacaaaaccatgccgtatcttttctaacatacatccaaagtatacgttgaatcatttcatttcacaaagcaaaatagtggctaaggtagggctggaacccaggttttctagaacaccctggtttatatcctggctccaccactttctacctgtgtatccatggggaaattacttgacttctctgagtgctcatttttaaaataagacatgaagatagctacatttcagagatacatttacaacattctatgacttcatttctatgaaatgtacagcttaggcaaatctatagagacagaaaatagatcagtggttgcctagtgataagagggtctaggagggaaatgtggggagcattgactgctaaagggtatggggtttctttttggggtagtgaaaatgttctaaaattgattgtggtgatagtttgacaattctgtgaagatactaaaaaccatttaattgttagctttaaagggtgagttatatggcatatgaactatatttcaattaagctgtttacaaagaaaaaaaaaaagagtaaaggagggaaatttcctgagatggccaacgatggagtcccttctgcctcaaaggcccagatgaaccttttcccatgttctagtttggccatccaggtttgtagcccaatgaaactctcataagtatgtggtcttggacctggacagagtctcctcagctgcatcacagtgaccattttaacaggcttgcctccctttagaaacacagcttggaaacctctatccctttgtggattttggaagctacatttggcagcttcctaaggtaagcacagagcaaaaataatttgccacctggggctttatggcagatggaacttagtcgcctcttaatatcctcagctgaagagttgagacatacctcgggcctcaattttttcaaaggtctgatccatttgtctttaatgcaagctgcactggcctgatagtcctggtaattccaatgctgaattacttgagacattttatagagttaagggcatatgttttaaggaatctgctttaatcgtcctcactgagaaatatcctccaatgtggattactcagtgcaggtttactggagacatttgatacaatctggaagatttaagagttgaagacatgccctgggtctccattttataagaggttccatgcatcagtcttcacaacaaaccattcttgcctttcaccttccactgagccaatccacattaaaaggaagctgaaagaaatgacacaacttgcactttgattttataagaagttggatctatttatccccattggaaccattctagaattactcccaacaacatagatttattctgaactttcaatgcaatctatataacagagttggggacataacttggacctaaattttgtaagaagttggatcttcccatctccacaaaaacaaccctggcctgtctctctcccatgctgaattactccagtttttcaataacttctggaatatataagagttgatgatacacctcaggctgcaattttgtaagaagttgctcctacttatctctattacaaagaatcctgaattaacaccgcccagagtgaaatcacttcatgcagatttactgcaggcattctctgtggtcaggcattttactggagacattctgtatgataagggaacctgaagagtgaatacgtccagttggtctgacagactaacctggtgccatcttttcccacttcaagaattcctttgaaggttcaactagataatatagttatagtacttggcacacagcagtctcttaaccaatgtttgttctcactgcctctgaacccatttctattgtctccattcatacaaccacatgggtatatttatcatgtgtatttacacacactcgtgtatgtattcatatctattacatatataggagtgtacatatacatttgtgtgtgtgtgtgtgtatatatatatatacatacatgtatatgtaatacatatatacacatctattcatcgccattggaaccatcctagaattactcccaacaacatagatttattctggactttcaatgcaatctatataacagagttggggacataacttgggcctaaattttgtaagaagtttgatccccccatctccacacaaaccatcctggcctggatgttttgatatatatgtatgcgtatatgcattacatatatgtgtgtgtgtatatatatatatacacacatgtatatgtgtatgtttgtatatacatatattctggagtaaaatgggtagttatttaagtcatttgaaggaatgctgaagctatttaccacagagatctgttttgagtattcggtgtgaaggaaggatatgaatattttagaaagacaaaaataaaatattactttgactgaaagagatcagtgcatttccatctttctttaaaaacacagaaaataaattaggaaatgagtctatttgtgtggtatgggggaaagcaactgtccctcaagtggcccatttgttcttggatctccatgcaaaaggcaaactggagaccagggaggctggagcaacctagataggacatcagtagggaggccatgtgattggccctgaggcacctcacagactgtcatctcaagtactgttgtggagccaaatgctgaagtgaataaaatatgttctagttatgcttgggagacctcccgagtccagctgccttactttcctcctccctttgctttattttgccaagattatgctagaaggaaaaggcgagaggagaggagagtgctgggacaactccatcactaaattatatatgttacacttttacttgcacttagaaaatcttggattgcctatcagccctgtgtttacttcagattgggagagaactaggaagagcgctagaagatttgatctttcactgactttgggaaaatttctttgatatcctgagcatcaacttcactatttgcaaaaatagcaatagagataatagtactttcccccctcttttcacatattgcttgttatcaacatataaagcgcaaacagatattattttgaactccttcctagtttcacataattcacatttaaatgagactaaaatgtttagctaaactcaaagaagaaaaaaattggcagaagtgaaatattttctacatattaaaatagcagagattaaaaaataatgacatgtattggtaagagtacaaggagatgggcagtttcatattcttctagtgaaggttgaaattttggtatatggtgagagataggcatctagtttcattcttttgcatatggatatccagttttccagcaccattgattgaagagactgtcctttccccaatgtatgtgtctgatactttggtcaaaaatgagttcgctgtagatgtgtggatttgtctttgggttctccattctgttctgctgatttatgtttctgtttttatgccagtaccatgctgttttgattactatagctctgtagtataatttaatgtaaggaaatgtgattcttctagttttgttatttttgcccaggatttatttggatattctgagtctgtagtggttccatatagattttaggattttttttctatttctgtgaataatatcatttgtattttgatagagattgcattgagtctgtagattgctttgggtaggatggacattttaacaatattgattcttctaatccatgtacatggaatatctttacattttttggtgtccacttcaatttcttgcattaatgttttatagttttcattatagagatcttttacttctttggttattcttagggttttttttgtagctattgtaaatgggattactttcttgaaattttttttctgattgtttgctgttggcatatagaaatgctactgatttttgtatgttgactttgtatcctgcaactttactgaatttatgtatcatttctaacaatttttttcatgaagtctttagtaggtttttccaaatgtaagattataccatctgaaaacaaggataatttgactccttccttttcaacttggatgccctttatttctttctctcgtctgattgctctagctaggacttccactactatgttgaataactggtgaaagtggacacccttatcatgtacctgatcgtgaaagaaaagctatcagttttttccccattcattacaatattagctatgtgttggtcatatatggtttttattatgttgagatatgttccttctatgtccagttttttgagggtttttgtcatgaagagatgatgaattttatcaaatcctttttctgcatcaattgaaatgatcatatgatttttgtctttcattctgttgatatgatgtatcacaataattgattttgtatgttcaaccatccttgcatgcctgagataaatcccagttggtcatgatgaatgatctttttaatatattgttgaatttggtttgctaatattttgttgaggatttttgcatcaatattcatcagcaatagtggcctatagttttcattttttgatgtatctttgtctggctttggtatcaggataataccagccttgtaaaatgagtttggaattattctgttattctctattttttagaatagtttgggtaggataggtgttagtttttgaaatctttggtagaattcaacagtgaattctaccaaattcacttttcaatatggcttaaatctctttacctgttatttgtctgtacaagttttggatctcttcatggtttaatcttaataggttgtatgtttctaggaattgattcatttattctagattttccaatttattggaatatagttgctcatagtagtaattaatgtggtaccatttgtaacatctcttttttcatctctgattttcattcagctattttcgcttttttccttggttaatctggctaaaggtttgtcagttttgtctgtcttttcaaaacaccaacttttagttttgtttatcttttgtattgtttccttcatttcagattcatttatttctgctcttgctgtttattatttcgtttattccactagttttgtgtttggtttgtgcttgcttttcaagttctttaagatgcatcattaggttattttaagttttttatttcttttttgatgtaggcacttatagctataaacttccctcttagtactgcttttgctgtatcccataagatttagcatattgtatttcaatttccatttgtttcaatacattttctaaattttttcttaattttttcattaacctactggtcattcaggagcatattgtttaatttctgtgtatttgcacagtttccacagttccttgtgctattgatttctagttgtattctgttgtgttcagagaagatgcttgatttaaaaaatattttttttatttcagtaggtctttggggaacaggtggtgtttggttacacgaataagttctttagttgtgatttctgagattttggtgcacccatcacccgagcagtgtacactgtacccaatgaatagtcttttatcccttgctacccccaccctttcccaagtccccaaagtccaatatgtcatttgtatacctttgcgtcctcatagcttagctcccacatatgagtgagaatacacagtgtttggttttccatttctgagttacttcacttagaataatagtctccaattccatcaaggttgctgtgaatgccaatatttcattcctttttatggctgaatagtatttcattttatatatatatatatatatatatatatatatatatatatatatatatatataaaattttctttatccattcattgattgatgagcatttgggctggtttcatatttttgcaattgcaaatcatgctgctgcaaacatgtgtgtgcaagtatctttttcatataatgacttcctttcctctgggtagatacctagtagtgggattgctggatcaaatggtagatctacttttagttctttaaggaattttcacactgttttccatagtggttgtactagtttacattccctccaacggtgtaattgtgttccctatttgccacattccagccaacatctattactttttgattttttgattatggccattcttgcaggagtgaggtgttattgcattttgattttgatttgcatttctttgatcatcagtgatgttcagcattttccatatgcttgttgaccatttgtatatcttcttttgagaactgtcttttcatgttcttagcccactttttgatgggattgtttgttttttccttgctgatttgagtttttgtacattctgaatagtagttgtttgttggatgtgtaaattgtgaagattttctcccactctgtgggttgtctgttaactctgctgattatttcttttgctgtgcagaagctttttagtttaattaagttccatctgtttatctttgtttttgttgcatttgcttttgcattcttggtcatgaaatctttgcctaagccaatgtctagaagagttttttcaatgttatattctaaaatctttatggcttcagtcttaaatttaagtttttgatccatcttgagttgatttttgtatagggtaggagatgaggatccagtttcatttgtctatatgtggcttgacaataatcccagcatcatttgttgaacagggtgtcctttccccactttatgtttttctttgctttgttgaaaatcagttggctgtaagtatttgggtttatttctgggttctcttttctgttcaattggtctagatgcctatttttataccagtgccatgctgttttggtgacgatggccttatagtatagtttgaagtcaggtaatctgatacctccagatttgttctatttgcttagtcttgctttggctatgtgggctctttttttggtcccatctgaattttaggattgtttattttctagttctgtgaagaatgacggtgatattttaatgggaattgcattaaatttgtagattgcttttggtggtatggtcatttaaacaatattgattctacccatttatgagaatgggatgtgtttctatttgtttgtgtcatctataatttatttcagcagtattttgtagtttttcttgtagaggtctttcacctccttggttaggtatattcctaagtattttattttatttttttcagctattgtgaaaggagttgagttcttgagttgattctcagcttggccactgttgctgtatagcagagctactgatttgtgtacattaattttgtatcctgaaactttgttgaatccatttaccagttctaggagctttttggatgagtctttaggattttctaggtatacgatcatatcatcagcaaacagcaatagtttgccttcctctttttacctctttggatgccctttatttctttctcttgtctgactgctctggcttggtcttccaatactatgttgaatagaagtggtgagaatgagcatctttttattgttccaattctcaggggaaaatgctttcaacttttgcccgttcggtataatgttggctgtgagtttgttttagatggcttttatttgttaaggtatgttgcttctatgccgattttgctgagggttttaatcataaacggatgctgggttttgtcaaatgctttttctgcatctattgaaataatcatgtgatttttgttttaaattctgtttatgtggtgtgtaacatctgttgacttacgtatgttaaactatccctgcatcccaagtatgaaacctacttgatcatggtggattgtctttttgatatgctgttgtattaggtttgctagtattttgttgaggatttttgcatctattttcatcagggatattggtctgtagttttcttcttcttctttttttttttttttttttgtttgtttgtttgttaggtccttccctggtttttggtattagggtgatactggcatcatagaatgatttagggaggatttcctctttctctgtcttgtgtaatagtgtcaataggattggtaccaattcttctttgaatgtctgatagaattcagctgtgagtccatctaatcctggacattattttgctgacaatttttaaattaccatttcaacctcactgcttgctattggtctgttcagagattctgtatcttcctggtttaatctaggagagttgtatatttccaggaatgtatccatctcctctaagttttatagtttatgtgcataaaggggttcacagtagtgttgaataatcttttgtatttccttggtatcagtggtaatatctcccgtttcttttgtaattgagtttatttggatcttctctcttctttacttggttaatctcactaattgtctatcaattttacttatattttccaagaaccagctttttgtttcattatcttttgtattttttttttgtttcaatttcatttagttctgctctgatcttcattatttcttttcttctgcggggtttgggtttggattgttcttgttgctccacttctgtgcggtgtgaccttagattgtctgtttgtgccctttcagactttttggtgaaggcatttaatgctatgaactttcctcttagcaccgcatttgctgtttcccagaggttttgagaggttgtgtcactattatatttcaattcaaagaattttttaatagccatcttgatttcattgttgacccaaccatcattcaggagcagattatttaatttccatgttatttgcatggttttgagggttccttttagatatgatttccaattttattccactgaggtctgagagaatacttgatataaatttggttttcttaaatttactgagatttgttttgtggcctatcatatggtccattttggagaacgtttcatgtccttatgaatggaatgtatattctacagttgttgggtagaatgtcctgcaagtatctgttgagtccatttgttataggctatagtttaagtccatcattcctttgttgactttttgtattgatgacctatctagtgctctcagtggattactgaagtcacccactattattgtgttgccatctatctcatttttaggtctagtagtaattgttttataaatttggaagctccagtgttaggcacatatatatttaggactgatattttcctcttgcactagtccttttatcattatataatgttcctctttatcttttaagattgctgttgctttaaagtttgtttagtctgatataagaataactactcctgctggttttggtgtgcatttacatggagtatctttttccactcctttaccttaagtttatgtgggtccttacgtgttaggtgagtctcctgaagacagcagaaacttggttggtaaattattatccattctgacattctgtgttttttaagtggagtatttaggcccattacattcaatgttagtattgagatatgaggtggtattctattcaacatgctatttgttgcctaaataccttgttttctttcattgtgttattgttatataggtcctgtgagatttatgctttaatgaggttctattttggggttttttgaggatttgtttcaagatttagacctccttttagcatttcttgtagtgctggcttggtagtggcaaattattttaacatttgtttgtctggaaaagagtgtatctatccttcatttatgaagcttagttttgctggatacaaaatttttggctgataattattttgtttaaggaagctaaaaataaggccccagtccctttgagcttgtagggtttctgctgagaaatctgcgttcatctgataagtttttcttcataggttagctgatgcttttgcctgatagctcttaagattctttcctttgtcttgactttagataacctgatgactgtgtgcctaggtgatgatctttttatgatgaatttcccaggtgttctttgagcttcttgtattttgatttctagatctctagcaaggtcagggaagttttccttgattattccttccaatatgttttccaaactgtgagatttctcttcttcctcaggaacaccaattattgttaggtttaccatagtcccaaacttcttggaggctttgttaattttttaaaattcttttttctttgtctttgatggatttggttctgcttgttcgattctattgctgagattttccagtgaatttgcatttctctaagtgtgtccttgattaccagaagttgtgattctgcttttagttattctatttcactgaagaattttcctttcattttctggatcatgtttttgattcctttaagctggacttcacctttctctggtgcctccttgattagcttaataattgaccttctgaattctttttctggcaattcagagatttttatcttggcttgggttcattgctggttagctggtatgatgttttgggggtgttaaagaaccttgttttgtcatattaccagaattgtttttctggttcattctcatttgtgtagactatgtcaggggaagatctgggattcaaaggctgctgttcacattcttttgtcccatggggtggtcccttgatatggtgttctcccccttcccctaggaatggggcttcctgagagctgaactgtagtgattgtttttgcctttctgggtctagccacccagtggagctaccaggctccgggttggtactggggagtgtctgcaaagagtcccgtgatgtgatctgtcttcaggtcttgcagctgtagataacagcacctgctccggtgaaggtagaggtagcagggaagtgaagtggactctgtgatggtccttggttgtttttgtttagtgtgctggttttgtgtttgttggcctccagccaggaggtgacgctttcaagagtgcatcagctgcagtcctataggaaggatgcaaacttgccctagggtcacctggttaaatattcaggtttctcaggtggtgggcagggccatagagctccagagagattatgatctttgtctttggtaccagggtgggtggagaaaaaccaccaggtgggggcagggataggcatatctgagctcagattctctttgggcagggcttcctgtggctgcctttgggaagggggtgtggttcccagtccattggagttatattccctgggtgattatagctgcatctgctcggtcatacagttcaccagagaagtgggggaaagacaggagtcacaggcctcatcccgctgccttgcagcctgcagtcctaaaggccagtctcactcccactatgcccccacaacagcactgagtctatttccagatagccagtgaccagcactgagaacttaccccagatcacaaacctccccattgagaaagcaagcagacacagtttttcggtgtttcacggagcctgcagtggtgatccagttccttcaaagggtctgtggattcctttggctttcctagtattttcctgcagttgttcttggagcaaaagttcacgatgtgagtctctacacactgctttgtcagtccaaggaggagctgcaagcttgtcctgtttcctatctgccaccttaatctctatagaccaccacaatgcttgatattatttcaattttttgaatgttttataactgttttgtgacctaacatatggtttatccttgagaaagatctaagtgatgaggaaaagaatgtgtgttctgtagctgttggatgaaatgttctgtaaatatctattaggcccatttggtctatagttcagattaagtccaatgtttgtttgttgattttctgtctggaatatttgtccagtgctgaatgtagggcattgaagcctcccagctattattgtattggggtctgtctccctttagctctgataatatttgctttatatatctgggtggtccagtgttctatatgtatatatttataattattgtatcctcttgccaaattgacctctttatcattatacagtgactttctttttgtctttttctagtttttgtcttgaaatccattttgtctcatataagcatagctactactgctctttttttggtttccattggcgtggaatatctttttctgtcctttcattttcagtctatgtgtatttctataggttaaatatgtttcttgtaagcaaaagatctttttttctgttttttaaaatccattcagccagtctatgtcttttaattggagagtttagttcatttacattcaatgttattattgataactaaggacttactcctggcatttggttatttgttttctggttgttttgtagtgtttgcttctttctttcctttttgtcttccttttagggaagatgattttctctagtaatatgacttaatttcttgctttttaattttcatggatttgtttcatgttttttgatttggggttaccatgcggcttgtcaatactgtctttaacccattatttttacttgataataaattaacactgtttgcataaacaaagaaacaagcaaaaagaaaagtaacaacaattctacacgtcaatttcatccccccactttttaactttttgatgttttgatttatattttattgtaatgtctatgtcttggaaagttgttatagttattatctttgattgattcatcatttaatttttctatttagtataaaattagtttacacaccacacttacagtgttatgatattttgtgtctctctgtatacttactattagtagtgagttttgtaccttcagttgatttcttattgctcattaacattcttttcttttttactgaagttctctctttagcatttcttgtgggacaggtctaatgttgatgaaaacccacagcttttgtttgtctgggaaagtttttatttctccttcatgtttgaaggatattttcaccagatatactactctggggtaaaggtttgttttcttcagcacttcaaatatgctatgcctctctctcctggcctgtatgtttttcactgaaaagtctgctgccagacgtattggagctccattttatgttgtttcttttctcatgctgcttttagggttctttctttatccttcacctttgggagtctgattattaaatgccttgagatagtcttctttgggttaaatctgctttgtgttctataacttttttgtagttggatattgacatctatctctaaatttgggaagttctctgtttttatccctttgaataaactttctactcctatttctttctctacttcctctttaaggccagtaactcttagctttgccctttagagactattttctacatcttataggtatgcttcattgtcttttattcttttatcttttgtctcctctgaccatgtattttcaaatagctgtcttcaagttcactaattttgtcttctgcttgatccattctgctattagactctgcatttttcactatgtcaactccatttttaaactttagaatttctggtttttttttgtttatttcaatatttttaatttatctgatagcattctgaattccttctctgtgttttcttgaatttctttgagttttctcaaagcagctattttgaattctctttctgaaagaaggtcacatatctctttcttcaggcttggcctctggtgccttattgagttcatttagtgaggtcatgtttttcaggatggtgttgatgcttgtggaaatccacctgtatctgatctgggtgttggaaagttagatatttactagtctttatagtctgggcttgtttgtatgcatcctccttgagaagcctttcctggtattcaaaaggacttaagtattaggatctaagccttgtctgcattaggaggcaccccaagccaagtaacactgtagttcttgccaacttctagaagtacaactgtgatgatcttggattatatccagaataattccttggattattaaacaaaaacttttgttctcttcccttatttcttccaaagaaatggagtctgtctgtctgttctgtaccacctggagctggggggggggggggggcagtgacacaagcaaccctgtggtcaacgccagtgggcttctcctgagttagacctaaagccagcacagccctggatcttgctgaaggcccactgtaaccactacctgtcttccatctatgtttgttcagggccctggggctctacaatcagcaggtgcttaagcctgccaggcttgcgtccttcccttcagggcagtgacctcccctaggccctggtcaggtccagaggtgctgtctgggatctagagcctggagtcaaaacactctagaagtctacctggtgttctgttgtactgcagctgagctggcactcaaactgtgagatgtggtccttcccacgctttcctccccattccacaggcagagaagcctcaccctgttgccaccactacaggcccacagagggtagccaatgtcccctaaagctcaagagctctttagttggtttgtggtgaattctgcctagtctgggactcacccttcatggtagtgggctcctctctggcccagggcacatccagaaatgtcattgaagagccaaggcctggaattgagtacctcaaaagcgctcttggtgttctgtccctttgtggctgagctggtgagacgtgacagcgtgctggcagtcctcagagccctcgcttgctctcggcacctcctctgcctgggctcccactttggcggcatttgaggagcccttcagcccaccactgcactgtgggagccgctttctgggctggccaaggctggagcccactccctcagcttgcagggaggtgtggagggagaggcgcgagcaggaaccagggctgcgtgcggcgcttgccggccagctggagttccgggtgggcgtgggcttggcgggccccgcactcagaacagccggccggccctgctggctccgggcaatgagggacttatcacccgggccagtggctgcggagggtgtactgggtcccccagcagtgccagcccaccggcgctgcgctcgatttctcaccgagccttagctgccttcctgcggggcagggctcgggacctgcagcccgccatgcctgagtctcccacccactccatgggctcctgtgctgcccaagcctccccgacgagcaccaccccctgctccacagcgcccagtcccatctaccacccaagggccaaggaatgcgagtgcacggcgcagtactggcaggcagctccacctgcagccccggtgcaggatccactcggtgaagccacctgggctcctgagtctggtggggacgtggagagtctttatgtctagctcagggattgtaaacacaccaatcagcaccctgtgtttagctcaaggtttgtgagtgcaccaatcgacattctgtatctagctgctctggtggggccttggagaacgtttatgtctagctcagggattgtaaatacaccaatcggcactctgtatctagctcaaggtttgtaaacacaccaatcagcaccctgtgtctagctcagggtttgtgaatgcaccaatcgacactctgtatctagctgctctggtgaggccttggagaacctgtgtgtggaaactctgtatctaactaatctgatggggacttggagaacctttttatctagctcagggattgtaaacacaccaatcagcgccctgttaaaacaggccactcagctctaccaatcagcaggatgtgggtggggccagataagagaataaaagcaggctgcccgagccagcattggcaacacgttcgggtccccttccacactgtagaggctttgttctttcgctctttgcaataaatcttactactgctcactctttgggtccacgctgcttttatgagctgtaacactcacggcgaagatctgcagcttcactcctgagcccagcgagaccacaagcccaccgggaggaacgaacaactccagacgcgctgccttaagagctgtaacactcaccgcgaaggtctgcagcttcactcctgagccagcgagaccacgaacccaccagaaggaagaaactgcgaacacatatgaacatcagaagggacagactccagacgcgccatcttaagagctgtaacactcaccgcgagggtccgcggcttcattcttgaagtcagtgagaccaagaacccaccaattccggacacactggtacctaaagtgcaagacaaagtcccttttgcttgtccctccacttttcccaaacagaaggagtctcttctcatagccagcacagctgggaatttgctgtatattacctgaagtcaataagtcttagagtctcacgcaaggcctatagtatacttcctgggtatcactactggttattcagggcccaagggctctttagtcagcacatggtaagtcctggcaggactgggtttttcacttcaaggcaatggatttccttctggcccagggtgtgtctagaaatgtcattcaggatctagggcctggaaatgagaactcacaactctgattggtgtcctattttactgtgactgagctggtatccgtgatgcaagacagagatgtctttactctcccctctcctctcttcaagtggaaggaagggatttattttggaactgcaagctgtacagcttggggttgggggacaagtggtacaagcatttccttagcttccccagctggagtctcagtagctcacatatccccctgagtctactggctcttagccaagtttagcactaggacttgccttgaatttgcagtccttgtggcccagactgcttttctatttttttgacggcaatattagatttattaaagttccatatttaaaaacgcaatacatctttaagcttttgtgttcatcttttttttaaaattatactttaagttctgggatatatgtgtacaacgtgcatgtttgtttacataggtatacatgtgacatgtgagtttgctacacccatcaacttgtcatttacattaggtatttctcctaatgctatccctccccaagccccctacccccaacaggccctggcatgtgatgttcccctccctgtgtccatgtgttctcattgctcatctcccacttatgagtgagaacatgtggtgtttggtcttctcttcttgtgttgctttgctgagaatgatggtttccagtttcatccatgtccctgcaaaggacatgaactcatcctttttttatggctgcatagtattccttggtgcatttgtgccacattttctttatccagtctatcattgatgggcatttgggttggttccaagactttgctattgtgaacagtgctgcaataaacatatgtgtgcatgtgtctttacagtagaatgatttataatcctttgggtatatactcagtaatggggttgctgggtcaaatgatatttctagttctagatccttgaggaattgccacactgtcttccacaatggttgaactaatttacactcccaccaacagtgtaaaagcattcctatttctccacatcctctccagcatctgttgtttcctgactttttgatgatcaccattctaactggtgtgagatggtatctcattgtggatttgatttgtattttccaatgaccagtgatgatgagaattttttcctaactttgttggctacataaatgtcttcttttgagaagagtctgttcatatccttcactcatttttttttcaaggggttgtttgtttttttcttgtaaatttgtttaagttctttgtagattctggatattagccctttgtcagatggacagattgcaaaaattttctcctattctgtaggttgccttttcagtccgatgatagtttcttttgctatgcaaaagctctttagtttaattagatcccacttgtcaattttggcttttcttgccattgtttttggtgttttagtcatgaagtctttgcacatccctaagtcctgaatggtattgcctaggttttcttctagggtttttatggtttttaggtcttacagttaagtctttaatccatctggtgttaatttttgtataaggtgtaaggaagggaaacagtttcagctttctgcatatggctagccagttttcccagcaccatttattaaacagggaaccctttccccattgcttgtttttatcagatttgtcaaagatcagatggttgtagatttgtgatgttatttctgagggctctgttctgttccattgatctatatctctgttttggtaccagtaccatgctgttttggttgctgtagccttgtagtatagtttgaagtcaggtagtgtgatgcctccagctttgttcttttggcttaggattgtcttggctatgtgggctctttttggttccatatgaaatttaaagttgtttttttccaattctgtgaagaaagtcattggtagcttgatggtgatggcattgaatctgtaaattaccttgggcagtatggccatttttacaatattgattcttcctatccatgagcatggaatgttgttccatttatttgtgccctcttatttccttgagcagtggtttgtagttctccttgaagaggtccttcacatcccttgtaagttggattcctaggtattttattctctttgtagcaattgtgcattggagttcactggtgattttgctctctgtttgtctgttattggtgtataggaatgcttgtgatttttgcacattgattttgtatcctgagactttgctgaagttgcttatcagattaaggatatttggggctgaaatgatgaggttatctaaatatacaatcataccatctgcaaacagaaacaatttgatttcctcttttcctgtttgaataccctttatctctttctcttgccttattgctctgaccagaacttacaatactatgttgaataggagtggtgacagagggcatccttgtcttgtgctggttttcaaaggaaatgcttccagtttttacccattccatatgatattggctgtgggtttgtcataaataggtcttattattttgagatacattccaaaaataactagtttattgagagtttttagcatgaagggctgttgaattttatagaaggccttttatgcatctattgagataatcatgtggtttttgttgttggttctgtttatgtgatagattatgtttattgatttgtgtatgttgaaccagccttgcatcccaggaatgaagcctacttgatcgtggtggataagctttttgatgtgctgctggattcagtttgccggtattttattgagaattttgcatcgatgttcatcgtggatattggcctacaattttctttttttgttgtgtctctgccaggttttgttatcaggatcatgctggcctcataaaatgagttagggaagattccctctttttctattgattggaatagtttcagaaggaatggtaccagctcctctttctacctctggtggaattcggttgtgaatgtgtctggtcctggactttttttggttggtaggctattaattactgcctcaatttcaaaacctattattggtctattcagagatttgacttcttcctgatttagtcttgggagggtgtatgtgtccaggaatttatccatttcttctagtttttctagtttatttgtgtagaggtgtttatattattatctgatggtagtttgtatttctgtgggattggtgatgatatcccctttatcattttttattgcgtctacttgattcttctctcttttcttctttatttgtatagctagtggtccatttattttgttgatcttttccaaaaaccagctcctggattcattgattttttgaagggtttttcgtgtctctatctccttcagttctgctctgatcttaggtatttattatctgctgctagcttttgaatgtgtttgctcttctttctctagttcttttaattgtgatgtgagagtatcaattttagatctttcctgctttttcttgtggacatttagtgctataaatttccctctacacattgctttaaatgtgtcccagagattctgatacattttgtctttgttctcattggtttcaaagaacatctttacttctgtcttcattttgttatttacccagtagtcattcaggagcaggttgttcagtttccatgtagttgtgcagtttttagtctgtttcttaatcctgagttctaatttgattgcactgtggtctgagaaacagtttgttgtgatgtctcttcttttacatttgctgaggaatgctttacttccaactatgtgatcaattttggaataagtgcaatgtggtgctgagaagaatgtatattctgttgatttggggtggagagttctgtagatttctattagatctgcttggtccagaactgagttcaagtcctggatatccttgttaattttctgtctcgttgatctgtctaatgttgacagtggggtgttaaagtctcccattattattgtgtgggagtctaagtctctttgtaggtctctaaggatttgccttatgaatctgggtgttcctgtattgggtgcatatatatttaggatagttagctcttcttattgcattgattcctttaccattaggtaatgcctttctttgtttcttttgacctttgttggcttaaagtctgttttatcagagaccagaattgcaacccctgcttttttttttttctttccatttgcttggtaaatcatcctccatgcctttattttgagcctatgtgtgtctttgcacgtgagatgagtctactgaatacagcacaccaactgatcttgactctttatccagtttgccttctgtgtcttttaattggggcattttaattgggacatttcaagttaatattgttatgtgtgaatttgatcctgtcattatgatgctaactggttatttttcctgttagttgatgcagtttcttcatagcgtcgatggtcctcacaatttggcatgtttttgcagtggctggtactggtcgttcctttccatatttagtgcttccttcaggagctcttgtaaggcaggcctggtggtgacaaaatctctcagcatttgcttgtctgtaaatgattttatttcttcttcacttatgaagcttagtttggctggatactaaattctgggttgaaaattcttttctttaagaatgttgaatattggccccccctcttctggcttgtagggtttctgcagagaggtctgctgttagtccaatgggcttccctttgtgggtaacccgacctttctctctggctgcccttaacattttttccttcatttcaactttggtgaaaatctgatggttatgtgtctttgggttgctcttctcgaggaatatctttgtggtattctctgtgtttcctgaatttgaatgttggcctgccttgctaggttggggaagttctcttggataatatcctgaagagtgttttccaatttggttccattctccttgtcactttcaggtataccaatcaaacatatatttggtcttttcacatagtcccatatttcctggaggctttgtttatttctttttactcttttttctctagtcttgtcttctcgctttatttcattcatttgatcttcaatcactgataccctttcttccacttgatcgattcgaccattgaaacttgtgtatggttctcgaagttctcgtgctgcgtttttcagcttcatcagttcttttatgttcttctctatactggttattctcattagcattttgtctaaccttttttcaagttcttagcttccttgcgttgggttagaagatgcttatttagctcagaggagtttgatattacccaccttctgaagcgtacttctctcagttcatcaaaatcattctccgtccagttttgttcccttgctggcgaagggttgtgatcctttgtaggagaagaggcggtcttgttttgggaattttcagcctttctgcgctggttcctccccatctttgtggtttcatctacctttggtgtttgatgttggtatcctacaagatggggttttggtgtggatgtcctttttgttgatttgatgctattcctttctgtttgttagttttccttctaacagtcaggctcctcagctgcaggtctattgcagtttgctggaggtccactcccaaccctgtttgcctgggtatcaccagcagaggctgcagaacagcaactattgctgcctgatacttcctctggaagttttgtcccagagaggcacccgccagatgccagccaaagctcttctgtattaggtttctgttggcccctactgggaggtgtatcccagtcaggctacatgtgggtcagggacccacttgaggaggcagtctgtctgttatcagagctcgaacgctgtgctgggagaaccactgctctcttcagagctgtcaggcagggatgtttaagtctgctgaagctgcgcccacagcggccccttcccccaggtgctctgtcccagggagatgggggttttatctataagtccctgactggggctgctgccttttgttcagagatgccctgaacatctagaggtagaatctagagaggcagtcggccttgctgagctgtggtgggctccacccagtttgaacttcccagcagctttgtttacactgtgagcataaaactgcctactcaagcctaagcaatggtggacgcccctccccccaccaagcttgagcaccccaggtcgatttcagactgctgcgctagcagcgaggatttcacaccaatggatcttggcttgctgggctccgtgggagtgggacatgccgagccaggcactggagggaatctcctggtctgctggttgcaaagaccgtgggaaaagcgcagtatctgggcaggagtgtaccgttcctcctggaagtctctcacggcttcccttgggtaggaaagggaaatcccccaactgcttgcacttcccgggtgaggtgatgccgtgccctgcatcggcttgccctctgtgggttgcgcccactgtccaaccagtcccagtgagatgagccaggttcctcaattggaaatgcagaaattacctgccttctgtgggtatctcactgggagcagcagaccagagctcttcctatttggccatcttgccagaccctctccagactgcttttcaagtttatttggggtacctgtacactttagcttaccctggtgaggcttgccagaactgatgttccaactgctgggatgggcgattcccctctaactaggggtggtttaaatactccctccaagtgtaaattagttcatccattgtggaaagcagtatggtgatttctcaaaaagctaaaagcagaactaccattcgacccagcaatcccattactgggtgcatatgcagaggaatataaagcattttaccataaagacacatgcacacagatgttcattgcagcactattcacaataccaaagacatggaattaacctacatgcccatcaatgacagattggataaagaaaatgtggtagatatacaccatggactactatgcagccataaaaaatgcgatcatgtcttttgtgggaacatggatggagctggaggctatcatacttagcaaactaaagcaggaacagaaaaccaaacactgtatgttctcatttgtttgtgggaactaaatggtaagaagatatgaatacaaagaacaaacaacagacactagttgggggagggctgttgggaagagagaaaggagcagaaaatataactattggatactgggtttagtacctgggtgatgaaataatacctacaacaaacccctgtgacacgtgtttacttatgtaacaaaccttcacgtgtactcctaaacgtaaaataaaaattaaaaaataaataaaaatcaaaattaaaaaataaataaaataagtactcaatccacaggtgggcatcagctgaaattatcccagttttactttctgctgagtcagggcagcaccgaggtcaatgcaatgtttcacaattgctgtactcttcctctcccaagtgcacagattctctctccatgccatgtgaccattgctaggggatgggggaggggtaatgctggcaatttaagactgtctttcctgccctcttcattgcctctttcagtgatacaatgttaacacgaggtactgtgagtgtttacctgactgaagatgcttttttttttttttttttggttacatagttgttgaattggtgtccttgagttggggtgggacaagcagtggagccttctgtttggccttgtagctacacccctctctgaatgcagttgttaaaaagaatattatgaaagaatatttattggcatagataaatgctctcaaaagtgtagatgcttgtttacatgcttttcaacacgtaacattgtttataagaataatattgggtgaagcaaaccataaaatatcaaatgatagaggattaattagtactataatacatactctgattaaatataaagcatggttaaaaatcatgaatttggggtgttttctaagcctgtatgaatattgatgcaaatgctaaatgaaaacacacactatatgttcagtataatttataatatctgtaacctatatgtataggaaaatataagggattatatcctgaaataataattagtcaacttttatagtaggggaattatttgtttaaaatgtatttatttttaaatttgaaattaagtctaccaagtaaaatgactatcaacaaaattatggactagatgtttgcccacaaaattcatattgaagccctaacccccaacatgatgatattcggaggtaaggcttttaagagacacttaggtatagatgagttcataaggttggggcacctgtgatgtgattagtgccctcataagaagaggaagagagaccagagcttcctctctctgttgtcagaggatacagcaagtaggtggttatctgcaaccaggaagggagccctcaccagaacctgactatgctggtaccttgagcttggactttcaggctccagactatgagaaataaatgtctctgttaagccactcagaatatggtgttttgttatagcagtctgatcagactaaaacaaaatgacaacagcaaaactggaggctttctatttcaaggatccagtagtctctagtactatacaggaggtaaaatatatatctctaatgaccagaaattgttccagtaattttaaaagcatagatcccaagaggaaaggttggatcaattagcatgataataaaattgatggaaagagtagttactacttggtgtctactaggtttttgacactgtaagaggcacttttacaccttaactcatttaatctttatgacaacacagtgtgtcacttaatttttattatgcttcatgggaaggtggggattatctcaatttcacagatatggaaagtacatctctaagagattaaggcacttaagatcatatagctatcatgtgcagaaagcagcgagaatttcgtttgtctggttcctatgtatctgttattttgatgatcactatgccaactgggtgtaatgagggaagagtttttagaagggatggtattcagctatgatagttaaccaatagctagagtttaggtttgagtactctgttgtcttagagatacgttttcattaagcattgatgatgaaagctgctttagttcttacactgttcactttggatgaaataggttggattgcaaaaagggacatttttaactttttattttgaaataattttagacttactgaaaaatggcaacatcagtacagattttctgcatacttagtttcccctcattttaacttcttctattcccatagtataattattgaaactaggagacactcattgatacaatactattaactgcactacagattttatttagatttcaccagttattccactaatgttcctttcctggtcaaggatctcatccagtatctcatgtttcaattagttgccattctccttagtctcttctagtctgtgacagttctgtcttttcttgtctttcatgaccttgacatttttgaggtatactggtaagatatttttcagtatgtttctcaatgtgagtttttctgaagtttcctcatggttaaattcagattaggaatttttggtggggataacacagaagtgtgtctttcccagtgcatgatatcaagaggtacataatttctctatgtctccttactggtgatgttaaccttgatcacttaggaaatgtggtgtcaccaggtcattccattataaggatgatacagttttccctttgtattaattagtattttattaggaaatactttgagattatgtaaataccatgaatacctgtttattcatcatatgttttgctcactaattttagcactcatcaacatttcttaactacaataatcacttttgtggtgtttgcccaatagcaatgttctatctatatcattcattctacatttattaatttgaattctactgtaaaaagatctgcccttcttctccatttatttatttattcaattatttatttttattagtatatactccaaggtatttattttattatatggattgggctctattattatcatcatttaattatccctatatctcatgctatataaaataatgaactccaaaaggaacagctaaataagtgtaaaaatgaaaccacagaaatgctagaagaaaatatgggtgatttcctcttaaggtttgttgtttaaggctttccaactacaacttttcaatttacatgaaattccatatgcaaaaataactaaatacataaaatattgataaattagactacatgaaactaaaacaattgcactataaaacacgataaacaaaattgaaagacaactgataaacaggaagaaaatgtttgcaccatatcacaaaagactaatatcccccaaatataaagaactcctaaatcgacagctaaatgactaaaaacctgatagaaaagggaaaaaaagacatgaacaggaaattcacccacacacttacacacaaacacacacacacacatgtatatatatgtgtatatgtaaagatgtcccataaatataggaaaaatgcctaagctcacttataattagagaaatgcacattaaaacaatagcaagatgctgttttcttcctatgaaactggtgaaaatttaaaaatatgacaacatattcttttggcaaggctgtggggaattactcctccttattgctgatgggaatgcaaaccagtgcaaaaggggactttttcaactatctagcacagatgttatacagatgaaacagaaatgtatttattttctggtgatatttgggagaaggctgcgttacgatgatgtttctggaggtcactggtaatgtaagttatattacataagattatacaactgacatttatagctacttgaaatactttcccaaactttcccttattgattgtctttaaggaaatatagtcatgttcagggagtgtcaaaatgccagccatctccattgttactgaaactatttctgcttccctcctactctccacctgattcagagatctgacttactttctacaagaaaatagagctatagagtcatataactcagagctgaaaagacctttagagatgatctagcccatgcctgaatgatttagaggagtaaatgaggcccagagaggggcaatgacttgtccagggtcacacactgagccaagactggaagaaaagggtcctgaccagaatgctccatatctcttgcaagatatgtgtaaattaccagacacacagtaggcatgcaatatatgagagcaataacaaccatttatttcaaagggtgcaagggttcccaatttcattccatgagaggaatttgtgttttaagtatcaaattgaggaaagcatacactctatttctgtaatcattaataatatttctcccagggttctcaagtagcaggcatccattagcacttaacagctataacatcatgagaaggcatcaacggagtagtgactactaaatttcagtccagctctattatcttttcctcttgatagtttgacttcgagctttagtaactgtgggcctgcactgggcctggagcctccatttcaaaggaggcttgtggttgcacagtgcacaaggatgcataccgagggaggtaatgggagctagaatccagcgtatgatctgctaactaaacctggagcccttgcttgggactgtcttttcccaaggaagggggactttgttctcccaaaggctgtctacatgtgcctacagagttgtgtctaccttgaggggagagcttattaattcacacagaggtgctgtataaggtaatggaggctgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactgtgagtcctattaaacctctttcttttgtaagttgcccagtctcgggtatgtctttatcaacagcatgaaaatggactaatacaggggctctggttagaattaaaaaccaagtctgtctaaatataaagcctgtgtttctccatctttactcagaaagctatgtttttatttattatttttattttttaataatttaatttttatgggtacataggtgtaagggctgtatttttaaatcttaacccaggaagctagaagattttatagaatatctgctccaaatcttaccctttatagactataattttggccccttatgattaagtgccctgcacataatcccacagtacatataccttgctctgaaggtatcattcagtgtatttctggaaaaaaaggaagtctttaatttttcaaatattaggaagtctctaggccttgagacatactgttcaggcaggattcttttaagatgccaaaaacatactttcagcattcctttgtttttataaagcctttaaaaatatctgcctggaaatttatactaagtcttcacttaattcaaggcagtggatattatagcttatttggggactccaaacttgaattttggggttttaatgtgacacaatagtgtgaacacggtttgggtatggatgaatcttggttatttcctggtgctttttcgaagtagttttataactctgggctggccatttaactccacaaagatgtattacctatttttttttttcagttaatagtaaattatgattgtttttccatgtcattatcgtgttatataattatttttatgtctgcatagtatcattgtgtggctcaactatcaaaagtaatcaatctcctattatggttagatgtctgtgctatttcccataactgtgataatttctcttatagctttatctctgcaaggcctctaattctgagtgttatttttcagatgaaatctgcctactctagatatctatgacaataccaagaaatttatttagctcgggaatttctaaatatggaaaaattagtaacaatagttactgtttattgagtatctaccaggcgctggatcccttctaaatgaatattttgggttaggaaatgtttcaagatgggcctcaccagctgttcacttcaactgtagggaaatccagtaggaagtgtggttgtgatcgccatagcctcctggtattctggccagtacaactcagcagtaacataaaatcccaggataccaaatcagtttcaaaatggagttcttcttctagggagggtagttttcattttgatccagtttgtaaagagtcctttctggtagttaaatgcacatgccgtttctctcttagtttcttcttttcattgttcctggttgcagatattaaaaacatatcattagcataagagaagaaacgtatttcccaactcactgtggcatatattttactcatctataagtggtagccgacagccaaggatacattttaagagtataaaaaccttagccctcatccttctaaaatgaatacttagtcattcttaatttctgttctcagcaatcttcaggatatttgtatatatttcctagtgttgagaaaatgaagtataaaaatttattaagagatgagccacaataaggaagatgccagcaagcatgctcagaatggtgcaatggtgtgcatttgtctcttccactctacttaaacctcaaaactctatgctagtttcagctcctgctttctttgattgtattttaaaatgaggcagctaggtagattgactgtcccattcacctaagtagtaaatgatgtttgtgtgttccagagctagaggaagtttgggctttctgtgtgatgcacatgttgcaatcatatatactaatgcctgcatactccctctgcatactaatggcagagaaaagctattttgaatgagaatatttacattcagaacctggagccttttagaaaaatagtaacaaattttgataaattttcaatctgtgggctttcctacatttttatagaacatgatttagagatcccagctgaggagcctatgataatagctcatcattatatagcatagattgcattcagttattcatttgttcattcaacaaatatttatgaaacacatggtatatgccttttcacctgtaataaaaattagaaatcggattttctgacttaagtgccaaatgcatttgctacagaaaataaggtgattagagagagatgttagcatatggctagttggagccagggagcagatgatattcacagcaggagtgagtatagagaaagaagaggaaggtgttaacaaaggagattttggaagaccaagatttaggcaaggagtgtagatgtaaaagagtccaccaaggaaactgtgaaagataatatagtgagttaggtggaaaatgattctgcttgttgttggaaactagggaacaggtgaaaaccagagagagcataactaagctgtacaaatcaaactattatttttatgtgtaacaataaaacaatgggctgtttttattattgtaatgataaaattcattcctatcctccaaggtattgtaggttacaaaggaagtcatatagattatgtttttgtcccctcatcaacattgagaatgaactcacaaatgaatagcgtgttttatatatgcttagtttatcatcaaaatgtacatgtattttatagccaaaagctgcataatagccgttaagaaaacaaatgttaacttcaccatgatccctaagaaatttccaatatgagttcaataattcactgattttccctgatatatctgactaacattatcatcagctaattttccagtgttaacattttttatacatcatttggatcagaactttatctactatctgagtcattaagaagtcattttggtcagtattaagattattcaacaaaatgaacatcagccaaagctttactttagctgaaaattatccaattttgaattttaaaatttaattaaatgaatttaagccatgaattccctctgtggaactgcacatctggagctacttgcaggatttgcaccttccattttgctgcttatgctggttgcagcagttctggcagagtattcagaataacccagaggcttattagtagagtaggaacagagtctaagagtgaatactataaggaaagggaaaggatggggcagagcaaacagtgacccagggagatcggaatacttaaaataattagatttctagaaaaactgaatgcttactctcacatctgccaacactgctgctacctttatggatgtgacacaacatttgtgctatacttcagagaaatcttagagacattttctgtctcttgccagtatctccagttcttcagtatgtagaggaactgaagtgtggctgggccatttaactccatacatgccttcagaatgattcatacatttacaaagctatgtcagtcttctttcttctgaaggtttttcaggttttgtttattttaaatatttgttgcacaagcaacattataacagtattaaatatttggtatgaagagatggtgaggtaatagatgattattaagaatgttctatttctgttaaatttctgtttccttcctatgactattttgatataatttttataatatcatgtgacaagataatctaataacacatttctatttttaaaatggattcaatgggaaaatcaggttgctttatagaaatttattctagagcaaatttatttagttggtatgtcagcctactctttaaaaaatgtttccagctggatgcagtgctgtgcccctgaactcccagctacctgtgaggctgaggcaaaaggattgcttgagcccaggagttcaaattcagcctaggcaacatagtaagaccccgtctttaaaacaatttttaaaatgttgccattttgtgggaaaatgtaccctccttcctcccatgttggggtaatacatgctgctgctgaagcccagtagagggcaagtgcatagtgtagtggaagaaattcaggctggggaagtgtgaggtaatggcacatagtttcaattcctggctctgctattcactcattgttcgatcttagacctggcttagtcctcagtgttctcatgagcaaaatgaaagaaattgtgatagatgagttcaaagtgctgctttagtcgtaattaccatgatcagacatggagatggagctgaactccattgctcttatagggcaaaaaattaaaaacaaacaatcctaccattggtacatttccaggcacatagacataggagctagtctatttgggtttgagttttatctctatcatttacaaactatgtgaccttagttggctttgttaacttccctatgccccagttcttcatctgtcaaatgagtgtaataataatgccaagttgtctggttgtaaaaataaaatgaagtaatgcatgtaaaaccgtcagattcaacagtcgattataaacagtgtgctgtttgctgtttttttcttcaagtagccaagttatatgatatttatatagaccacatatgccagcagtcttttcacctttcaaggcatcttgtagaaaaaaagtcacgtttaattttattaccagatggcttttatttatcaaaaatgatagtctctcctaataaaattattccaatgctaggcattctgctgagaaaataatatttttatttactatttacttattttctaacaacaatagtttgagtaataacccatttctttaagactaagtgataagacacttaggcaaattaggaaccacattcagtaatcactcatatttgttaggtaaccattgtcttggggtttgagaatagtccagtgtgaccttgtgcaaaacctggaagcactttcaggctcttccagcctgttggactactgatatatctcatcttctcaattgtactcacagaggttggtagggtatttagattaaggatcacttttatttttaatctctgtaataaacaagaatgattgaagaggtgttgtcacaggagactccatcctgtttaacaggaatattaggtaggcaggggcatggtggaaagccatagatagagacagctgacttgaatcctcttcccatctctgccactattcactgtcctctcctctctgtgtgtttctgtaaaactctgtgattctatgaaccttgttaacttagctggttaaaaacaaacagaaaccaaaaccaaaatccaggacatcagttcctttctgtaaatctgcgaaacatttagttgcttgtcacaacatattcagtgtgatctagacacagcctaaacttttccttccacataggcctaatggaggatgttgatgttttgtttccttacttcacagaggtgtcatgaggacaagcatgaaaaaagtagggatgcatcatttgagttcttcaggaggaagctactacctaagtaagagacattagtatgattaagtgtgatgtcattaatattcccccaaactgcctttatcctatttgtactgtaggtaatttttgtgactggggaacatccccagttgtattttcattttaatgagaaatgatgacagtgttgcctcattgctcttaaaaaatacaaaaattaaaacacacacacacacacacacacacacagaactgacataggacctcagtacatttttacctttaccttgctgctgctgcttttctcctccttctcctcctcctccttctcttcttcttgttctcctcctccttctcttcttcttcttctcctccttcttcttctccttcaccttctcctccttctccttcttcttcttctcctcctcctcctcctcctcttcctcatcctcctcctcctcctcctcctcctccttcttcttcttcttcttcttcttcttcttcttcttcttcttcttcttcttcttcttcttcttcttcctcttcttcttcctcttcttctccttctccttctccttcttctccttctccttcttctccttctcctctttctcctccttattcttcttctttcttcttcttcctttgtttgacagagtctcactctgccgcccaggctggaggctggagtgcagtggtgcaatctcggttcactacaacctccgcctcccgggttcaagcgattcttctgcctcaaactcctgagtactttgtactacaggcatgtgccaccatgcccggctaatttttgtatttttagtaaagatgaggttttgccatgttggccagactgatctcaaactcctgggctcaagtgatctgcccgccttggcctgccaaagtcctgtgattacaggtgtgagccactgtgcccaccctaccttgcttcttcttaaaaaacaaagcaaaacaaaaccataaacaaaatgctgaggtttcttctagcactggtctttattgctcactagtcaaagctcctcattttttgcaattttggtaagaatacttaccatgagacctttctttttaaacacattttaagtgcattctactgtattgataactataggcaaaatgtcgtataactataggcaaaatgttaaacagatctctagaacttaatcatctttcataactgaaactttataccagtcgaatgctgaacactatcccattgtacgtctacaccaagttttctgtattcattcatttatcaatgggcattttggttgtttccatatcttggctgttgtgaataatactataatgaacatgtgaatccaaatatcttttcaagatcctgattttaattcttttgtgtaaatactcaaaaatggtattgctagatcatatggtagttctatttttaattttctaaggaacctcaatactgatttccatagcagctgccccattttacgttcctaccaacagtgtatataggttccaatttctcagcattctcactaacacctggtagtttttgttttgttttgatagtagccatcctaacaggtatgggatgatctctcactgtggtcttgatttacatttccccagaaataaactcatatatatatatatatataagatcaacttatctttgataagggtgccaagaatacacaatggggaaagaatagcctcttctatgaatggtgctggaaatactggatagccacatgcaaaagaataaaattagaccccgtctcccaccacttgcaaaaatcaactacaaaaagagtcttaaatgtaaaatatgaaactgtaaaactcccagaagataacatggggaaaatgcctcttgacattgatcttggcaatgatttcttagatattacactaaaagtacaggctacaaaagcagaaataaacaagtgggattgcatcgaagtaaaaagcatctgtacagcaaaggaaataatagagtgaaaaggcaacgtacagaatgagagaaaatatttgcaaactatatatctgatacgaggttaatatccaaaatatgtagagaactcctacaactgaatagcaaaaaacaaatattgccatttaaaaattggtaaattgcttaaatagacatttctccaaagaaaaagacatacgaatggccaacaggcatatgaaaagatgttcaccatcactaatcaacagggaaaggcaaatcaaatcccattttagagatggagaaattgagggtcaaagaagaatgttatttgcccaaagactctaaactatctggtggcagagcctggatgagaaccttggccttctgattccttgggcgtacttttcccactccagtttgtgctgatgactgctctgccactaaatcatgtgtattaaagtttctcttctaccagtctgtgagggcatggattctatcatatttagctgaaatgattatttcttcagcctttcttgtgcaacttcctctatgaatccctgagtctgcatgcagaaatgcgttactgaaatgcagaagccgttttcccccactagtaataatctgttcctcattcaaatacacaccttctgagctggggttttgtcctcttttgttttctttaacatagatgtgtcctgactatgtggagggactggaaaaggaaaataacgtttcacaggagaagggctgagaatattgttaaagcacagacaatggtggagcttgaaatcagagaaaaaaaatacagtataatggctccctgtcccttgtagcattccatctttcagctctcaccatattccaagcacaactacgtcccttaacaaaatcatatccctgaatcctgatgatacccaacaactcagataaatttcccagacctgttcccaacctctctctggtcacacctgcattcctgaccttaacgaccttctcccaaccttgattatatccttcaaccataaaaagccacttgagctgaggccattctaccacattaatcatgtcctccgctgttagttatacttctatcctcatgctcgctaaagtggccacacagcaatagtatttaacacaccctttctgactcttcttccaagccttgtcaaactgcttggctctgatcagatgtccagtgtgatccttgattctgaacaccaactggtgactgattctgggagccagattaaggcaggcggtaagagcaaaggaattggatgaaccaagagatatgtgggagagagagagaaataagatgtgagaaaaagggtaaggggactgagtatgagaagggcttcatggcatggccaccaagtctagaattaaatgtcttttgcttgtgggtgggtattgagaatgagtttaataaggtaggctggttcccaatttttacctctctgtgaactgtggtccaaatgggctgggctgttggactgtatcacctgagcctgatggagcaggctgattgagcattttctggaacgctgtgtgggtgaatgatgatgtacagaatatgtcctatccatcctcatttcttcccattcactcctagcatgttggtatatacctgacatatcatggttgctcaaaataggatcatttcttcagaataattcttgcattccttagtatggcatatagagccctgattctcaactgcctcatttctcatcaggataaccctcctcccttgtgttcgcatgtgtgtgtgtgtgtgtgtgtgtgtgtgtgtgtgtgtgtaagcacacaattttgttccagctgtgtttatccaacggggccaagttctttcacatcctgttgccattgtacctgttgtttctctacctagagtacccttttcctctattttttgctcagtcttccagtcttatcacaagcactactttgtccaaaaagcttttcttattggccctagaatctcctcagatgtcccttttctgtgttctcatagcattccactcttaaggcatcattgccataagaatgaaataaacaaaacttgacagttttgtttctgatttcatcccatattgaaccatgagcttgtagagggcagggactgcatcttatttgtatttttctactcctagtgcttaacccaaggccttgtacatattaggatttcaatgtatgtttcctaatatgtgaatggaaaccttcctcctatttatcttctctgttctatttgacttttttgttcactttcatttttttgtctgtaaactgaatacatacattaagaagtcaccaaaatgaatgggcatctacaagcaaaccctattcattcttatcatccagaaaacaacctgtatttctcctaaacacaaatttcttctatgctttccttgccattaatgcaaaaaaaaaaaaaaaaaaaaaaccacacttctggaagcatccatagtgatgacgatcattactattctctgtattctctgaagattattagaatttatcaagcagctgtttcatgggaagagtgttagcaattgtattgcattttgtagctaattgcaggaacaaagtgtcaactaatgcaaaatttggtttttaaaagaaaacattctctccctaatcaagtcctcatggtaaagacaacatgaaattattattgatcatcactcatgagccaggagagagatgaagtagtatattctttttgatttctacttaagaatttgaaaggtaggatgctacatgtttcaaggagatttgcagaatccagtaatacaaattctgaagactgaaaatcaggtaaggtttggctcggggattaaaaggaatgggtaaaaagtgcttctgaacattagagaagcccagactgatagagatggacagacttttcagaatatctattttggtgatcctcaatttctctttttgcttatatcccctctaaaaggaaaaaaaacattttgaaaaactacataactgttcatacatctttatattgagatatatgtatatacattttaatcatgagtttaaatggttatgaaggaaataactttcagcatattgcatattgattatacattttaagtacatttttatcacagccttggcattactcaattaactcattcagtttatgggaaatgtctgccatgtaacctcaatagtgaaaccagtcctcattgtcaaaccagcctgccaactcagactggctttctgtttgaaagagtctgatttcattatattcccctgtgacaagcatctcgctactgaattctaacataaagataggtagctaaggtacagagccttgccatggtttgtcacttggatgagataaaggcactgcctcatcaatatttcttacccaaacactctgctttgctctccagggactctttttcaggagtctctgtgtccttgaatcccttctttgttgtttggtaccccagaggatcttgccctctggtacaatgctccatactaaaattcaggatgagaagtatgtctgtctctcttttgtcaaatgggaaaaaggtcattgtggaaattgaaatggaaaaaaaaaggaatatacaaatggtaggaagatataccaggctactcactctttggaaagtcagataaccaaatttgcctgcacattgtttacatgtaccctaaaacttaaagtataataataatataaaaaaaaaaagaaaatctctgatcttatctactcctcccttattttgttgttgggccaactgatacctcgaaaaaagaatggactaatcccaggtaccaatgcttgttaaccagtggcaaagccagtactggaatataggtattttcatttcccaactaatgtgcttcctgcctcatggtgtctccttaatctgtcctatattcaaacgattgtaatttctttatccagtcacagtggggtttttctcatagaagaggtctgacctttacatttctttacagggaggtgtgtgtacatagagaatgccaagatggtagttgtttgtttgtatgttctcttacattacttgcagttgaagcaggtaaggtgactacttaacaagtcttcattcaaaaacctgtaatttgagaagcttgctccatattagtggaaaatgcacttttcatcatggggcctaaatctcttgatgcttatcattttttttggaatagtttactatttacttaattttgctatttttgtagatttagttgtaaggtctcaaagtacataactctgttttttactccattatctcaaaatcctgtaaaacattcagtaatttggtcaaactgcctcagttcagatattgatctgccacctgctagcagtatgactttggaggcagtgttaacctcttgttacttcagtttccccctctgtaaaatgagttgtgatgattgaatatattatataaatctaatgctttgaagtacctggtacaaacataataagtcttcagtaaatgttaactattgttatcatcattgttgattgaaaccatcaagtaatctaacattaagaacaccaggggccgggcgcggtggctcgcgcctgtaatcccagcactttgggaggccgcggcgggcggatcacgaggtcaggagatcgagaccatcttggctaacacggtgaaaccccgtctctactaaaaatacaaaaaattagccaggcgtggtggagggcgcctgtgatcccagctactcgggaggctgaggcaggagaatggcgtgaacccgggaggtggagcttgcagtgagccgagatcgcgccactgcactccagcctgggcgacagagcgagactccatctcaaaaaaaaaaaaaaccagggcagctagcccatagagattaaacaggttggaaagtagattaaatttacacagaggcaagttatgaggcagagagaacagacctgcagaaggaagtggcctggcagtgttatggacggtccatcaagtcatgtctgaaataatggtttagaacaatgctgtccactggagctttctacaatgatagaaatgttctacatccacactttctgctatgatagctgctatttgatatgatagccagttgtcacatatggctcttgagcacttgaaatccggctaatctgaataaaaaatggagtttttcatcgtatttgatattaattaatgtacagttaaatttatatgacgacatatagttagtggctaacattttggccagcacagatccaagacttcagctttgcttttgtcaattaccttaaatctttgaatagtaaaccagcttaaataattcatgagaacagtgacggtaagactgtctcttccagctctgtccatctctttgttactccttcatctctttttctctagctctgctcccatttctcacacttcatctgtggtatcctccttcattactccatgtttctttaaagccaggctcctcagccaaatatattttgatacctgtgcatgtataggtatgttcttaccaattaaggtcagatattcatgagcaagtatatgaagacacttatggtgcaaaggccaatttcttaggaatggaatgtgattgtgaggaagttgcaagctgtggcaaaaagaaaccttttcccacattattttcatgtgaggaattactgtccatcaagttagtattgattccactcacctattaagtagtagatcataggcaagatcatttaagattttgtagactgatggcaaaagctcccactatttaccagagctatataaagatgacatttcaatgccttcctcatgttataacacactatattttgaaagcttaaatagtcctttaagggaaagagaaacacttaatatacgtcaagaaaacgaattgcatttaatgtgaagaagtaccggccagaccacatgaagtgagcatcactcatgttgctatccaggcactgctttgggccagtgttcatcatgtgaacaaagtttctggaccttccaaaactacccttctctacattcctaatattcagattcaaagagttcattgttagtattttgattatcttaaatgtgcactgagtcatagttaatatcttaaatgacttgaacatttgctattctaacagaggctagtttatagagcactgtaaaacctctttttatttatggaatgcatccatattaaaattataacttcagcagctttctgtggagaaaatggtgactctgaccttttattccatctgaccactgagaaaaggactataatttcaacaatcaaatctcaaatgtgttattgtgcctattttctttttgtaaaatgtcattccatctatcatgctaacagctcaccttaatccattttcaatgggcttttttgcagaaaatttgcacaaatattttaaaatttctctatttcaatagcttttggggtacaaatggtttttggttacatgggtgaattttatagtggtgaagtctgaaactttagtgcccccatcacctgagtagtgtacattgtacccaatatatcattttttatctcttgtcccccttttaccatcccccttctgagtctttatagctcattatattgctctgtatgcctttgtatgctcataacttagttttaacttataagcaagaacatatggtatttggttttccattcctgagttacttcacttagaataatggcctccagctccatccaagttgctgccaaagacattattctgttccttttttatggctgagtagtattccatggtgtatatatactacattttctttatccactcattggttgatggacacgtaggtttgttgtatgtctttgcaattcacaatttttaaaaaatattctttaaaatagagctgttgaaagctctcacatgtttccagcgtaaacgtatttattaacaatgatttatttgaaaggtcagaggaatgtgagccttgtttccggtggtcacaaggggccaggagcattcccgagtccagcgcataacaaaagtaatgcagtgtcagaagaccagactgaaaacagcagttgtcaatgaatggacactaatgcaattcagatttttaatttgtttttctattaagagaaagtgagaagtgtccaatgaacagtggctcaaaatctaatacgcttggtcttaggcaactccctcaagctccatttcctatataggccaaactgccaccttcccagtatattcacattgctgccagcttaggcttcctaaaacacaacatagtgaccttgaactctgataatctcaaaccttccatattcatcaaagtccttcacaatttgctcttaccctcattctcaacattgcttttattttgttcccctgcagccccagtgaactgctctcagtcctgatgtcattccccacacttttttgccatcttttgctcacaccattcttcctccaaggccctttctttcctctggatctgtgacaaaagaactacccattcttctaattgaagttcaaatcctatctactccaaggaaccttcttagagcccccagtaatactgaaggcctttcttcttcttttttttttttattatactttaagttctagggtacatgtgcacaacgtgcaggtttgttacatatgtatacatgttccaaatgtccatcaatgatagactggattaaggcctttcttctttacagttctctggttctctaacactctggtgtagtagaagagctgggaatcagaaatcctgagtttggattccagttctgccattttctatgtacatgatcttggacaagatagtcaacctcactttctgagcctgtgccatcaactggaaaatggagataataatgcctttcctgcacatgtcacaggcttgctgtgaaactcaaaggagataatgcatgtgaaagctttctatatacagtgaagtgccatgcacatggggagtattattgctttcattattgtttttccattgaaaaatcagccaaggctgcttgaagcaatttgcttgaatggcacagaaggatgaagtttgtcagtcagtccctgagcacaaccatcaaagtgtcccagaaacttcagtatttcagcctccaaactttactctccagactgcctctggcaccacaaaagaaattgaaatcctcagtctcactatgtgttctgatttagggtttaaaaattagggtgcctgtaattacagcacttgattgcactagatatgagtttcatgaaaacaggtaccgcatatgattcatctctgtgtcttctccattgcttagcaccatgctgatgccaatccatagaatatgctaattctcacagtctcctttactgagctgtgatgaatgtaagtatctacggatgtaatatatgtaactgaaatcctagttgttagattacaaaacacgtattgtgcccatttgatatgctgttagactttttctctttcctttcttttcctatggagttgaattctcctaactttctttaaatattcaagaatagaagacttagaaccagaaagaggagataatgattcagtgaaaaggctgttgaaaggtaacaatcaggtcacatagtagctacttggctgaactgtagagatgagtcttctgcagggtggcagtcttgcctgagcccttgtttccagggtcaggggatccttgtaggctgtattataaaatgaataaaatcacaccagccagagagctccactatatttcctgcttatatccttttaatcaactcctcatgtaccaagcacccaatagtgaagagtcacaggtaacccagttctgttaacattatagtttccttagtttcctttattttccccaaatttgctctgttccttattatccaattctgcattcacctgactcctggcctctgaccccttgtcttattttgttttctgctgctataacagaatgctgcagactgggtaatttataaacaatagcaatatatttattagagttttctgtgctgggaagtccaagggcatggttatgtcatttggtaagggcctttttggtgtatcacaacatggcagaggacattacatgttgagaggtcaagagtgcttcaactcagatctctcttcttcttataaagctaccagtcatatcatgggggctccaccctgatgaccttatctaatcctaattgcctcccaactatatactgcctacaagagactcaagttcgcctgtaagaacatgcgtagactgaaagtaaaggaaggagaaaagatattttttgcaaatagaaaacaaaatagaacatgagtagctaaactcatatgatacaagataaactttaagtcaaaaactgtgaaaagagaccaggaaggcaattatataatgataaaggggaatacagaaagaagatacaataattgcaaatatacatgcacccaacatcagagcatcaaactgtatcaagcaaaaattaatagacctaaaagggaagatagactgcaatataatagtaagggacttaaacacctcactttcagcgatggatagatcatctagacagaaaatcaacaaacaaacattagagttaaaccacattccagattaaatggacctaacagacatttacagaacattctatttaacagcaccagaatatacattcttaacagcacagggaacattctccaggataggtcatatattaggctgccaagcaagttttaaaaatattttaaaaaaccaaaatcatattaactatattttctgaccacaatggaatgaaattagaaatcaataacaggagaagctctggaaattgtacaaatacatagaaattaaacaacatattcctgaacaaccaatgagtcaatgaagaaatttaaatatttcttgagacaaatgaaaatggaaacacaacatacaaaagcctatggaatacagcaaaggcagctccaagagagaattttatagcaataaatgcttgcattaaaaagtagaaatatttgaagtaaacagcctaacattacacctcaaggagctagagaaacaaaagcaaactaaacccaaaatgagtagaagaaaagaaatactaaatatcaaagcaaaactaacaaaaaggtcctaaataaattataaagctcaacaaaattaagagctttttgaaaaactaaacaaaactgacaaggcttctacctagaaaaaaaaaataatgaagtaaattattcaggatctataagaaactcaactcaatagcaaaaataaaacttgatttaaaaagtggacaaaagatctaaatagactttctcaaaagaagacatacaagtggctagcaggcatttaaaaaaatgctcgatatcgctaatcatcacgtaaatgcaaatcaaaactacaatgaaatatcatctcacgcccattaaaatggctattatgaaaaagacaaaaaataaaaaatgatggtgagggcccggcacggtggctcacacctgtaatcccagcactttgggaggctgaggcaggtggattgcgaggtcaggagatcgagaccatcctggctaacatggtgaaaccccgtgtgtactaaaaatacgaaaaaattagccgggcatggtggccggcgcctgtagtcccagctactcggaaggctgaggcaggagaatggcgtgaacccgggaggcagagcttgtagtgagccgaggtcgcgccactgcactccagcctgggcgacaaagcaagactctgattcaaaaaaaaaaaaaaaaaattctggtgaagatgtgtagaaagggaaatccttataaactattggtcgtaatgtaaattagtataagtcaacagtatggaaacttctcaaaaaaaaaaaaatagaactaccatatgatccaacaatcccatgactaggtatatatccaaaggaattgaaataagcacgttgaagagatatctgcactcccatgttcattgcagcactattcacaatagacaagatatggaatccacttaaatgtccatcaatggatgaatagagaaaaatgtgatatacacacacacacacacacacacaatagaatactagtgagccataaaaagataaaattctgtcatttatgacatggatgaacctagaggacattatgttaagtgaaataagccaggcgcagaagggcaaatatgatgtgatctcacttacatgtggaatctaaaaaaattgatctcatagaagtagagagtacaacagtggttaccaagacttgggtaaccactactggggagaggttgatcgatgggtatgaagttacagttagaagtaataaaatgtttgtgttctattgcgcagcagagtgctcagtgaacaataatgtattgtatacttcaaaatagcggattttgagttcataccacaaagaaatcacctgtttgaggtgatgaacatactattgaccctgatttgacttttacacaatatatatgtatgtatcaaagcatcacactgtacccaatacacatgtacaattattatatgacaaataaaaagaaaatataccttaaaaataaaacaaaagtaaaaagaaatcccacacaatgaaaaaagtatatttgtttaccatatgtctgacaagggacttatgaaaaactattacaactcaattaaaaaagacaaccaaatttttaaattggagaatctgtagacagttttacataaatatgtgcaattattatttgtccgttaaaaacaaaataaaactgaaaaacaaaaaccctagcaattattagcacttactatgtacatgatactgagttaactgctttacatgtaacattatatttaattctaacagtattcctttgaggtagatactgttcccatttaacagaggaaactgagatctagaaaggatagttaacttgccaaaagccatacagctaataggtagaggagccaggaattcaatctatttttgactccaggcccctggcaataccctgtcctatttctcaccagggaacccttggtgttgtgggccactttggtcagtgctccccagatttgcatatattctttttcataacttagaaacactcaacttctgaagtttaggaaatacagttcatcatgaacccacttaatctttgttaactgcggagaccaggtttttgaattttactcttaactcaagttgccaatgagtttgctgaaagattaaaagactaagtgctaccgttgtgtggttatttgaattaagcatcgaagtgtaacatttatctataaattctcaactctagtgcctaaaatcattttatttcttgtcatattcgaaaataggatttggttgctgaaaaaagtatggagaataagtgggaatttaggagaatctgcaaggcttgttggaaactcaagcagacgaagaccagtttggaagtgatgtattaactcctaaatgcattttttgttagtcactagcaaatatcgtgggtccccctggtgctttgtgagaagataaatttctcctgtaggtgaattaggtataattggaaacaattggactagaagcatcctgacgcgctctgggtcaaaagcttttcagcaaggctgtttttaggagcgtctgaattgatactgtttctgtagcctaccaatctccaaacagagtgacatattgtttttcttctttctccccctcctatgtcattgtggagaacaatatggcagtgcagacatagcatagagtctgagaacaaagtgcatatcagtcccagctatgtcccttagtagctgcgtgactcactgtaaaataggtcttgatgcccgccctcctcttcctccgcttaattatttttaaaaatacttattgagtgccaaccatgtgccagacattgtgttaggcactgtagctgcaatggcgaataaaacagacatcattcatgcactcctgaaactaaaaatttaatagattatatctgccttctgatcagtaagcctaccatgaggaataaataggcgtggtggatgtaaagtgcccaaaacatatttactgtgttcacaaagtgtgaatttcctttccttttcttcattttggcattataacgttagctgtagatggcatgtacatgcagcatagcatccggggtgtgtacatgcacacacacagacacgcacactcaattctctatagcttcacttattttagtctaagattgttgccattttcatgcacagctattatggtaggtgagtcagccaatcaaaaacagatttgattgatttgctttgagctacttgcctgccaacaaacgacaatggctgtatggatatagtcattgagtcaggtggctttatggatttccattggtgttagacttttaaatttagtttcttgctgcctgttatacacgggaggcaatgacaagctctcaactctctaatttgctgtagtggtgtgctaattaaaacacattcctaatacattccgttttggattcagagccagtgttcttataaaactataacactagtaagaaaaatgcaccatactatcttatgagaaatttcataaatgtgacaccccacaaccttattttatttttcagacattatacaagctatattgcaattttatgtcctattcgattcttctccacaaactgctttgccctgtgtattccaaatttttgtaagtgataccaccagataaatccaaaacctagaaaccagcctagatgtttcattctctgtcacccatctctctagatatgtcctatcccaaagttcccttgagtttgctccataaatgtatccccatccccactgccactacctcagttcatgctccagttatctcaaggttacagcaataacttaacagaattccttacctccaatcaatccctctcctccatctttcctactacctatactacagaataagtcttctgacacacagttgactgtgtcacttttctgtttttcgagtttttcagtcactctccattgtctgtgcagaataaagcccaaactcctgtgcgtgacatacaaaggtcagcctaatttgcccctctccctccagtttcaactctcatcaactgtatttattttctagtaatccaaaatatgtatagctccagaataaggcatttactcattcagtggatatttatgtgccaggtacttgtttagatactgggtatattgctgtgagcaatacagacaaaaggccctttcttcatagactttacattctgtgagagaaacaaactaaatggatacattatttctacaacttttttgtctttacatatgccatttcctctgcctgaagtaattttctcactccccatttctctaaaaattgcctagtcctctttcagaaaatcagcttgcaagtatgacatctaagagagatttcagcctgctttcatcttttctctgtatcttttcagagtttcactatagcttctgctttgctgttgtttctcattatttgcatgtcagaaccctccctcgtggcattctctatttaacaggactatatcttttctactctgtcttcacagtacttggcactgttgtagcacttagtcaggaaacagaaaagatgtttgagtccatgaaagcctggaaggcagggaagaagaaaggaggaagacagaaaaaaggaaataaaaaggagagagggatggggagaagaagggagaaagtgagggagggagaaaagtcaatttagtttcatttctccttggtttggaaaaggtataactagttttgtattatgacccagtaggattgcatagtcaagaaagtgccactaaattttgcaacttatatttccttaaaagtatgggagaaatgaatatttccctttgcggtttggtttattaatcattatcctacaagttaatattaaactaacaaattaaatgaaatctccatcacacacaggtgaattaatctttgccttcatatcttcttgctatgtaataattgtcagaacttgcaagaggtatatttttatgttattttaatcatgttcctgaggggcatcaaggtgaaatagaaagagcagagttaggagatatgaagtcgagtttgggttctgcaacctagtagctggccgaattaggggaagcattttcactgtggggagctttagttttgtcgtctggaaaaggaaggaaccagaatgactgctcactgtactgtttccagtttgcctcttctcattttagtttcctgcttgcaggaaactttacaaacatactaattgagtgatgatcagttatagactgccttagtttccatttcatctcctccacaaggtacagccttgtattctcctgtggctataaataaatcccatcatagccttatattctgtttactgtattttgtcttgacctttaccaagggatagattctgaaggcattatgcagttggatcaaatggcttgtattcaaaattgtggcttgagtctctccacccagatgtcatggatgttgatttccctggtgtcttaatccaccctccccgcaggactttccatcttctttaggcctctttccctttatccactgcctttctttgctgtagcctccttgtccagttttactttacttccctaaggtttctgtaacattggaagacctgccacctgtgacttctgtgtcacaaaacattgttttttcttaatggctctcctttttagaagatgagaaatttacgtttaaattgtgtgcattgagcttagtgtgcaatgattttttgtaagccaagaaaatcaggaagaaccgcaaagggtaagggatggagtcttcaacaaatggtattcgttaattttctgcccattaagggacataatctaattaaattcttatcctacaacatagacaaagtgaattcctgctgtattaaagagttaaatataaaagaaaatgaaatagtaaatatcagaataatgtggaatatttaacaattttggggggcagggagcaattttggggggttgtattagtctgttctcaggctgctataaggacatacccaagactggataatttataaagaaaagaggtttaattgactcacagttccacgtgcctggggagacctcaggaaacttaaaatcatggtggaaggcacctcttcacagggcaacaggagagagaatgatgactgctgagcaaagggggaagccccttataaaaatgtcagatctcatgagaacttggctatcacaagagtagtatgggggaaaccaccccccatgattcagttatctccactttgtccctcccttgacagaagaagattattacaattcaaggtgagatttgggtgggagcacagagccaaaccatatcatttcacccctggccactcccagatctcatgtcctcacatttcaaaacacaatcatgcccttccaacagtcccccagagtcgtaatccattctagcattaaccaaaactccaagtccaaagtcttatctgagacaaggcaagtcctttctgcctatgagcctgtaaaatcaaaagcaagttacttacttccagttacaatgggcatacaggcattgggtaaatacaccccttccaaatgggagaaattggccaaaacaaagggcctacaggctccacacaagttcgaaatccagtggggcagtcaaatcttaaagctctgaaatgatctccttagtctctcatctcacatccaggttatgctgatacaagaggtgggctcctacatccttgggcagctctgtccctgtggctttgcagggtacagccccctgccctggctgctttcacagctggcattgagtgtctgtggcttttccacgtgcacagtacaagctgtctgtggatctaccattctggggtctgaaggacagtagccctcttctcacagctcccctaggcaataccccagtgggaactctgtgggggtggggggaggctccgaccccacatttcccttctgcactgccctagaagagattctccatgagtgggtctgcttctcccagtccactcactcaaatgttaatctcctttagcaacaccctcatggacacacccaggaacaatactttgcatcctttaatccaatgaagttgacactcagtattaacgatcacaggggcatttaaagccaaagcagaaatcacaaagaaaatgactgatagatttgatatatcaaaatgtaaaacaaaaataaaaaccaaagctttcattcatcaaaacatcaaaaataaaaacattttctttaccactccctttcatgggctatagatatcaaagggacttctggattttattcagggccagcatcatgggtgtttggcctgtgtagtcgcacaggccaccacacatggaaggatcctgtgattggttcaatgctctgttgtatccatcttgacattcataattttggaacaagggacatttcatttttttattttgtactgggccccacaaattgtgtagccagtcctgagtctcttgaatcattctggaacctccctgctcatagtgaaatttttaatgacaggcccatttgaatgatgcttggtgaaagaatgcaagaaaccacttgctcaataacattggacttaaatgagaatatagacgggcacctggatgttcattaccttgtcagtgtaccagataccctgatatccattcacttattccttcattaatttagcaaacatttttcaagtccatcctttgtgtcaagcactgtgctaagcattggggatacagtggtgcacaagatggattcagtcagtgctctaaaggaggcaaggttgtaggtgaatagatggcaataccacatgatagaaagtgtaggagcccagagcaggggcccctaacacagcctgagagatgagtaagggagttgacatctaaacgaactgaaggggtaaaggaagtggaggtgagaggcatatcctggggaggccatttaggccaaggaaacagcatgtcctccttttgttctttcatcattctttcatcagcagggcaaggatcttaacctgccctgggaattcatcaggttaagggtcaggtgtgtatggaacagctggctggcctcttctcgggaagtttatgcccattccaagctacctattgtacttgtctcctggaataggtggtgatgtagtttggatgtttgttccctccaaatctcatgttgaaatgtgatcctcagtgttggaggcgaggcctggtgggacatgtttgggccatgggagtggatctctcatgaatggctttgtggtaccccccagccccataaattagtgagttctcactctattagctacctgcaagagctggttgttgaaaggagcctggcacccctcccgtctctctggctccctctcttaccatgtgatacaccagcttcccttcaccttccaccatgagtggaaacttcctgcagtccttgccagaatcagatgctggcactacgcttcttgtacagctgcagaactgtgagccaaataaacctattttctttacaaattacccagctttgggtattcctttatagcagcacaagtcgactaagacagctggaattacatactgtttgatgtctgaaatgtcctatggaagaagaaaggataaatatccactgtgccccttatctctaagacacctgatcaccccctctggatattttaaaaatcctagatttcaaatagacttttactctaccaaaatttctgtgatccctggaagacctagccactatttttagcttgcaggacatagaaaaatagtggggggtcagatttgtaccataagccattgtttgctgatttctgatttagaattaagttgcctcaggccacagatcctttatttgcattggctttccctctgcttggaaaactctccctcaacctgtttctgttgtaggcctcttctctcagtgaatccttctttctctacagacttgcctaaactgatttttctgctgctgtatgtctctgtagtatccttgggactttcttatcaactcctacattgtttgcttaatgtttaagtctctttatacactgaagacttaatggaagaaaaatttacagttgcctattatttgaacagttcaagtcagtctcctagcccactgcctggctgagtgtagctgctcaacaagtatttgttaagtgtacatatgagtgcagtattactgtccccatttttcagatgatgaaactgaggcatagctagctgattgggaccacactaaaagctattagatagtagaatagaaataattttccagttaactacactgcttttttaaacattcaaataggatgcttagaaataggacaaagaagacaaattaaataggactttcagtaagcaaaacactaaccatgaagattatattttgctactcagtaggctgaggcggaagtacttcttgagcccaggaattcaagactagcctgggcaacatagtgagactgtctaaaaccgaaaaagattgtgtttggtttatgttctccttgctctcatggcatatgcaatataataggggaggtcagataactgcatagcaaataagtctgacagcccaagttagtaggtggcaagtaccaagaaggtttatgtggggcatgtgttgctgtggcaaggtggggtcaaagagaaagtcagaggcaagtcctaagccaagccaggggagtcacataggccacatcccttcaggattcacttctgtggacattggctagtcaatgcaaagcaaacagtaacctctagagcaggtgtgaagggacactcatgaactttttcccaggtgatatgttcctcaaactgctgcaactgcagaatgctgagagctgtccacctgtgggaatggtcagagggtcttgccaggagtggcgttctaacagatgctcaagaagttagataagggtttttctgactcatgagaaaagactctaggaacctgaaagagtttaattttcctaccagtgggtgatttgggacagtctcctaatccatcagcaagtgtttcttgaggtccttactatgtaccaagaaagtcaaatggggattctatttctgatggctgcacttttttttttcttttttgttttttattatactttaagttcttgggtacatgtgcacaacgtgcaggtttgttacgtatgtatacatgtgccatgttggtgtgctgcacccattaactcatcatttacactaggtatttctcctaatgctatccctccccgtcccacaaccccatcacaggccccggtgtgtgatgttccccaccctgtgtccaagtgttctcattgttcaattcccacctatgagtgaaaacatggcggtgtttggttttctgtccttgagatagtttgctcagaatgatggtttccagcttcatccatgtccctacaaatgacatgaactcatccgtttttatggctgcatagtattccttggtgtatatgtgccacattttcttaatccagtctatcattgttggacatttggcttggttccaagtctttgctattgtgaatagtgctgcagtaaacatatgtgtgcatgtgtctttatgatagcatgatttataatcctttggatatatacccagtaatgggatggctgggtcaaatggtgtttctagttctagatccttgaggaatcgccacactgattcccacaatggttgaaccagtttacagttccaccaacagtgtaaaagtgttcctatttctccacatcctctccagcacctgttgtttcctgactttttaatgatcaccattctaactggtgtaagctggtatctcactgtagttttgatttgcatttctctgaggaccagtgatgatgagcattttttcatgtgtctgttggctgcataaatgtcttcttttgagaagagtctgttcatatccttcgcccactttttgatggggttgtttgttttattcttgtaaatttgtttaagttctttgtagattctgcatattaaccctttttcaaatgggtagattgcaaacattttctcccattctgttggttgcctattcactctgatggtagtttcttttgctgtgcagaagctctttagtttaattagatcccatttgtcaattttggcttgtgttgccattgcttttggtgttttagacatgaagtccttgcccatgcctatgtcctgaatggtaatgcctaggttttcttctagggtttttatggtttttaggtctgacatttaagtctttaatccatcttgaattaatttttgtataaggtgtaaggaagggatccagtttcagctttctacctgtggctagccagttttcccagaaccatttattaaatagggaatcatttccccatttcttgtttttgtcaggtttttcaaggatcagatgtttgtagacgtgtggtattatttctgagggctctgttctgttccattggtctatatctctgttttggtaccagtaccatgctgttttgcttactgtagccttgtagtatatggcagggcatagctgaacaaaaggcggcagaaacttctgcagactttaacgtccctgtctgacagctttgaagagagcagtggttctccaagcacagagtttgagatcagagaagagacagactgcctcctcaagtgggtccttgacccccgagtagcctaactgagagacacctcccagtaggtgcccctcagagacaaagctaccagaggaaggatcgtgttctgcagtatttgctgttctgcagcctccgctggtgatacctaggcaaacagggtctggagtggacctccagcaaactccaacagacctacagctgagggtcctgactgttagaaggaaaactaacaaacagaaaggaatagcattaacatcaacaaaaagtacatccacaccaaaaccccatctgtaggtcaccatcatcaaagaccaaaggtagataaaaccacagagatggggagaaaccagagcagaaaagctgaaaattctaaaaaccgagcacctcttctcatccaaaggattgcagctcctcaccagcaatggaacagagctgcacggagaatgaccttgacgagttgacagaagtaggcttcagaagatcggtaataacaaacttctccgagctaaaggaggatgttcgaactcatcgccaggaagctaaaaaccttgaaaaaaggttagacaaatggctaactagaataaacagcatagagaagaccttaaatgacctgatggagttgaaaactatggcacgagaactatttgatgcatgcacaagcttcagtagctgattcgattaagtggaagaaagggtatcagtgattgaagatcaaatgaatgaaatgaagtgagaagagaagtttagagaaaaaagagtaaaacgaaacaaacaaagcctccaagaaatatgggactatcgaaaataccaaatctacgtttgattggtgtacctgaaagtgacggggagaatggaacgaagttggaaaacactcttcaggatattatccaagagaacttccccaacctagcaaggcaggccaacattcaaattcaggaaatacaaagatactcttcaagaagagcaaccccaagacacataactgtcagcttcaccaaggttgaaatgaaggaaaaaatgttaagggcagccagagagaaaggttgggttacccacaaagggaagcccatcagactaacagcgggtctctcagcagaaactctcaagacagaagagagtgggggccaatattcaacattcttaaagaaaagaattttcaacccagaatttcatatccagccaaactaagtttcataagtgatggagaaataaaatcctttacagacaagcaaatgctgagagattttgtcaccaccaggcctgccttacaagagctcctgaaggaagcactaaacatggaaaggaacaaccagtaccagccactgcaaaaacatgccgaattgtaaagaccattgaagctaggaagaaactgcatcaactaacgagcaaaataagcagctaacatcaaaatgacaggatcaaattcacacataacaatattaaccttaaatgtaaatgggctaaatgccccaattaaaagacacagactggcaaattggataaagaatcaagactcatcagtgtgctgtattcaggagacccatttcatgtgcagagacacacataggctcaaaataaaaggatggaggaagatctaccaagcaaatggaaaacaaaaaaaagcaggggttgcaattctagtctctgataaaacagactttaaaccaacaaagatcaaaagagacaaagaaggccattacataatagtaaagggatcaattcaacaagaagagctaactatcctaaatatatatgcacccaatataggagcacccagattcataaagcaagtccttagagacttacaaagagacttagactcccacacaataataatgggagactttaacaccccactgtcaacattagacacatcacagagacagaagattaacaagaatatccaggacgtgaactcagctctgcaccaaccagacctaatagacagctatagaactctccaccccaaatcaacagaatatacattgttctcagcaccacatcacatttattccaaaattgaccacatagttagaagtaaagcactcctcagcaaatgtaaaagaacacaaataataacaaactgtctctcagatcctagtgcaatcaaattagaactcagaattaagaaactcactcaaaaccgcacaactacgtggaatctgaacaacctgctcctgaatgactcctgggtacataacgaaatgaaggcagaaataaagatgtgcttcgaaccagtgagaacaaggacacaacatgccagaatctctgggacacatttaaaacagtgtgtagagggaaatttagagcactaaatgcccacaagagaaagcaggaaagatctaaaatcgacaccctaacatcacaattaaaagagctagagaagcaagagcaaacacatttaaaagctagcagaaggcaagaaattactaagatcagagcagaactgaaggagatagagacacaaaaatcctttcaaaaaatcagtgaatccaggagctgggtttttgaaaagatcaacaaaacggatagatcactagcaagactaataaagaggaaaagagagaagaatcaaatagtcgcaataaaaaatgataaaggggatatcaccaccgatcccacagaaatacaaactaccatcagagaatactataaacacctctacacaaataaactagaaaatctagaagaaatggataaattcctggacacatacaccctcccaagactaaaccaggaagaagttgaatccttgaatagaccaataacaggctctgaaattgaggcactaattaatagcctaccaactaaaaaaagtccaggaccagacggattcacagctgaattctaccagaggtacatggaggagctgataccattccttctgaaactattccaatcaatagaaaaagaaggaatcctccctaactctttttatgaggccagcataatcctgataccaaagcctggcagagacacaacaaagagaatttaaaccaatatccctgatgaacatcgatgcaaaaatcctcaataaaatcctggcaaactgaatccagcagcacatcaaaaagctcatccaccacaatcaagttggcttcatccctgggatgcaaggctggttcaacatacccaaatcaataaacgtagtccatcatataaacagaaccaaagacaaaaaccacatgattatctcaatcgatgcagaaaaggcctttgacaaaattcaacagcccttcctgctaaaaactctcaataaactaggtatcaatgggacgtatctcaaaataataagagctatttatgacaaacccacagccaatatcatactgaatgggcaaaaactggaagcattccctttgaaaactggcacaaggcagggaggccttctctcaccactcctattcaacatagtgttggaagttctggccagggcaatcaggcaggagaaagaaataaagcatattcagttaggaaaagaggaagtcaaattgtccctgtttgcagatgacatgattggatatttagaaaaccccatcgtctcagcacaaaatctccttaagctgataagcaacttcagcaaagtctcagaatacaaaatcaatgtgcaaacatcacaagcattcttatacacacacaagcattcttataacagacagagagccaaatcatgagtgaactcctattcacaattgcttcaaagagaataaaatacctaggaatcctatttacaagggatgtgaaggacctcttcaaggagaactacaaacccctgctcaatgaaataaaagaagacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactaaagttcgtatggaaccaaaaaagagcctgcattgccaagacaatcctaagccaaaagaacaaagctggaggcatcacgctacctggcttctgatgtctgaacttttaactcccatctgctttcttcatcttgatttgcacatatgtctgatttggagatgaaaagtaaatatattcctgtgtctcttcattcttcatccatcttttcacaaaatgcacccagcagctgtgccaagcttctctgaataccatgaaatcatttatatgttttgatactgtgtcatggatatattaattgtttcttctcactacaacatggtctaattagcttggacaatacttccagtctcctgtttgaagagactgtgtgtggcttttgatgatttctctaattctgatttgataggttagatgtgggctgatctttctctcgctcttttttccttttcctttcttctcttctttccccgtaggcatatactaatgtcctaacgtgtactgaatcttgattacagtgtaattgatttagagcatatggggacttttgaaatcccttttaggagggatcattgactcttgataatctgacgaaagctatgaacacttcttccagaaatgtgtacttttacatatataatttatcatccagttacaggagtctcaagggtttagccaagtcttggatgcatgtccatagtatgtgaagaccacagaatttcagtgcttggacaaccctacagatcatcgaattcactggtttttgaaaactattttaaccagagaatccctggttgaaaagggtgggtaaaaagaagggagagactgagtcatgcacacccctacgtcgctcagagtggttcctgaggaggttctgaggaacacagtttgaaagctcatgatctaggtctaattcctgtatttctttatatgagaaaattgatccaaaaagagcagagttgactaactcaaggccatgcatccagtcagtgcacagctgagactggaacccatgcccttgatccctaggacagagtctcagccaaccctcacttctcttctaattgtaaacctcctacattcataccacagtaacttctcaaagatcctggacaaatgtaatttaaacccacaattataaataatcacccccatttgagcaacaggcaaaggaaatacagctgatttgtgttttgtcactccgtcaaggccttccttctttctgtcttatttctgctggttctcgtgtctttgtgaactgtttccattttacaacatgtattttattcaaatatacatcatagtcaaaagcatcctctttttcctcgacaaagtgccatcctgttggcctcccacagacacactctctgcccctaattcttaaagaagcagtatctggtgctcgccctggtatggtgcttgtttggcttcaggccactggcaaaacgacctaagctattattgggcttgtctccatcccagtcttccaaccttctttgtaattgtcaagaaacccaactgagcctcagctgaagtatctacctgttattgacctgactatgggcgagccaagcctagtctttcctggtctctctttcttgtgtattggtgcaggatgaggacattgcttcagagtaccaaagtggagaggaagaaacaaaccaacaaactcaagaaagtagaaaggcagtgcacagacccctttcttagggttagaggcaaggtggtctttagacttcctgagttgaagactgatgtttctttgggtggaatttctctgtgctacctcagaaacaaagatagttcatctgacaaaccagagacctacttagagataacttcagcctatccagggaactaaaaactaattaaaaattgccaggccagagtttcaaaccaggagagtggtgtggtgttgtggttaagagcacacactttgtatcctgtcggacatgaatttgaatcatggctctgccacttactacctgtgtaaccttggtcgagttaacttattcttgttgggcctccatgctttcatcaatcaaattggagaaaataatacccacattaggagagtcttttgaggactaaaagagagactaccaaacgtttgctattttgcctatcttcatcaggaccccacagaagactctgtattctgaatgttgtattcaccaccaattatctgtatccctgttgaacggagggaacacaggaaacatggcagggaatgggttaaggagcattggtttagccgataactgttgtgtgaaacatgatttagttccctcccgtctctatggactaattttccccactaggcaatgaagagtttgtgcttgagcacgtgttctttatgctgactcaggacctgagtgtgtcaaaattatcttaaaagttattttttaagtgtagatgtgcagttgcaattcccagacagtctgattgaggagatctaggggatagtcacaggatctatactatatgtccagtcgcccaggtgattctgatcagcagtcaagtgtgggaaccactgatgcagggagttgtaaagattctccctttcctccctgctttcagtcttggaacttcttatagtttgaaagtgtctttccattaatgaggcctatgacttcctacatcattcaaacatggtgattttcacacagagaaaataagaaaacgttgctagtggtcctcaaagacggtatttttccccacagaaaattcattttgttttgctttagtggcttgatatcagatccacaaggcatgtaatacagaatagggtgaacgttgagggatctgcttttaattagtttccccagctgatctctcagatcattttaaaaaatgcattctctctattttatgattgaattctaagtaatgaagtttagcaatatatgtaataaagtagaattatctcacaatagatcacaataatagatactgagtaacttctcagtgtcagttgctacctatatttccataatccttatgacaatatttgaaacaggcattaatattttccctaattttaaaacaaagaagataaaacttaaagagataaagtgacttacctaaggccacacaactggtaagggatttttttagtgttgaacagggatgaaaatggtatttaaaaaatgcaacttgaatcactttctgtcttaaaaattttcagtgacttattcattatgcttaaaaaattatctaaacaactttgtgtgggcagtaatacttgtccgttttggtcagtgctgtatcctcagcaataagaacagcgtttgtcatacaacagagactcagtaaataaatattcatggaataaattaagtgatgaagcctggattcaacccaagtctgtttgattttaaagcttgctcttcagtaatttgtatgctctctcctctctctctctctctctctctctctcgttaaatttacatactatgaaatgcaccaatatttggtgtaaaattttatgaactttgacaaatgtttataactgtataacacacatcacatccctaacaagataaagatatttccttcatcctagaaagtttctctttgtttctttaagtcaactgcctcaccctttccagagacaaaggcttttctatgtttatttattttttttttaccacatgttggttagttttgtcttttttagaatttcatataagtggaattatatactatgaactcctttgtatctagctgtttttcattcagatggtgatttaagatctgtccatagtgttatgtgtatcagtggtttctttttattgctaagtagtgttgcaatgtatgaatatatcataatttgcttatcattctactgttgatgggcatgtgaattgttttcagtttttggctattatatataaagttgccgtggttgtttgttttcaggtatttttgcagacagatgttttctttttttattattattatactttaagttttagggtacatgtgcacaacgtgcaggattgttacatatgtatacatgtgccagtggtatgctgcacccatcaactcgtcatttaacattaggtatatctcctaatgctatccctcccccctccacccaccccaccacaggccccggggtgtgatgttccctgccctgtgtccaagtgttctcattgttcaattcccacctatgggtcagaacaggcggtgtttggttttctgtccttgcgatagtttgctcagaatgatgatttccagcttcatccatgtccctgcacaggacatgaactcatccctttttatggctgcatagtattccatggtgtctatgtgccacattttcttaatccagtctatcattgttggacatttgggttggttccaagtctttgctattgtgaatagtgccgcaataaacatacgtgtgcatgtgtctttatagcagcatgatttataatcctttgggtatataccccgtaatgggattgctgagtcaaatggtatttctagttctagatccctgaggaatcaccacaatgacttccacaatggttgaactagttgacagtcccaccaatagtgtaaaagtgttcctatttctccacgtcctctccagcacctgttgtttcctgactttttaatgatcaccattctaactggtgtgaggtggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgtttatgttcaatgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttgtgttgccattgcttttggtgttttagacatgaagtccttgcccatgcctatgtcctgaatggtattgcctaggttttcttctagagtttttatagtttcaggtctaacatttaagtctttaatccatcttgaattaatttttgtataaggtgtaaggaagggatccagtttcagctttctatatatgctagccagttttcccagcaccatttattaaatagggaatcatttccccatttcttgtttttgtcaggtttgtcaaagatcagatggttgtagatatgtggcattatttctgagggctctgttctgctccgttggtgtatatctctgttttggtaccagtaccatgctgttttggttgctgtagccctgtagtatagtttgaagtcaggtagcatgatgcctctagctttgttcttttggcttaggattgacttggcaatgcgggctcttttttggttccatatggactttaaagtagttttttccaattctgtgaagaaagtcattggtagcttgatgggggttgcattgaatctataaattaccttgggcagtatggccattttcacaatattgattcttcctacctatgagcatggaatgttcttccatttgtttgtatcctcttttatttcattgagcagtggtttgtcatttctcttgtttatttacctagatgtggatttcctgggtgataatggaaaaagtatgtttaccatttcaaggaactacaaagcatatttctaaacaggctatacctaacagggtactagcaatatatgagagttgtgtatgcaccacatctttgccagccttgatatatgtagttttttaaattttagccattctagcgggtatgttgctgtattattgtggttttaatgtgtatttcctgatatttccatggtaagtattgtttcatgtcctattggccactcatatatcttgctttgtgaagcatctgttcaagtcttttacctattttttaaattgggttgtttgtattcttattgtatcataggagttatgaatataagttctttgtctggtatattttttttgaatattttttcctgactgtggcttacttaatctttttctgttcttttgatgtacagaatatttcaattttgatgatgcctaatttatcaatgttttattgtttatactatatcctgtctaagaaatatttgccaactccaaggtcatgaagatattcttctttgttttcttcgagagcctacattttaacgactacagcatgcatctggctttgccttacttgttatagaggatgcattagtccatgagataattgttatcagagtaagctgatgggaggcggagtactatagaattcaacaagacagctttgaagttcaacagatctttgttcaatttctgactccagtcccagcagcgtgaccttaggcaagtcacttgatctttctgtgtatcaattctctcatttgtgtaaaggagataataacaccaacttatgtcacaggatcattattaaataagcaagtatatgatcacttcttaacacagggcatagcacatagtaagccctcaacgagtggtgtctgttgtacttacaatacttttcattcatattataccagtttcaccaagagtttttagtgccagaagcaaatataggaagggttaccttttcttcccctactagacttcaaacagaaccattgaaatagagatgacccattaagaaggggtaggctatagttacaaacagttctttctgtatgtctaaaatcgcatctttattattttgagtaatactaataactgaatctccaagcacagacatgacagatatgattataaaactccctggcataaaggacaattttatcattgaaaactgaaattatatgaaggaatacatgtaatgcttttccagaaacacaatgtgctcattaaatgtgggtaaatgcagatgttgaagaggtttttaagtcagtgtacagtgaaaagagcagggactttgacataaaacaaacatagaacttgaatacaaggacatatgacttgattgctgtgaggctcactcctatcatctatcgaaagaggtttacataaatattggagaatatgagtgcttcaaagaatatgaacgcactagctaacatcataggcactcaaaatggtacttattggttaacctcatatttgtaatgacatatatgtaatagtaaactaaagtgagatatccaatttcaaatgagttacatccttaaaaaggtgaaagatagttttgtgggtttattttttgatagatttctcttctgtgttcaggaatggtactcacagaatatatctgtttgatatgtgaggtcattttgcagctcactcattgattcaatgcatttctgaatcatagaggaggatccctggctatttgtcatgtctgaatgatggaaacacatatttgaatgattctagtaatagagaagaatgtggaacttgctccatacatttccatttttaacatccttctgttgtaggggatggggagggagaggattgtgtatgtaagttgttttctgctaatgctaccactgctgttttcagagtcaatacatggacagaagcacaaaaaactgagtattccttttgccttatgcatcaaagtctctaaccaagtgtttagaactacatctactggtgttctcccaatgcaaattattctaggccctttgtgctctggtctcaacctgattatatacccttacctcttttcttgccacagcaaaccatttactatttttcaaataattccaatgttttactgtttctgcctctttattcatgctgttccatttattctgttatcttgagaagcctttcctcccatatctgtctgctaaacatatatccatctttactgagttgaagtgattccccctaaattcacatccgcttggaacaccagcatgtgatcttatttggaaatagggtctttgcagatgtaattagttaacatgagaacatactgtattagaatgggctgtaatccaatgactggattatataagacttataagaagtcacgtgaaataacagagacacgggcacacaggtgagaaggccatgtagtgatggaggcagagattgaagtgatgcagcaacaagccaagaacaccaaggattgttggcaaccaccagaagctaagaagaggcaaggaaggattcttctctagagccttcagaggaagaatggccaaaacaacagcttgattttaaatgtctagcctactgtactgtaagagaacaaatttctgttgttttatgttacccagtttctggtaatttgttatggcagccttaggaatgttttttacatccttcttcaaggtcaagctcaaatataatgtcttttccagatttcttcaactagatgtaatttctcttcttcacctctgtagcaatgctgtagcagaaaaaaagatcacaaactttggtgccagagaatttttggctgtaatcctggcccagctactgactggatttcttcacctgtacaatggaaataataatacctacctaatagagttgttgtgtcaataaatatgactgttccttacctctctaattcacccattctgcctcagattgcaataattttgtaataagacaatatagttctgtttttttccagttcagaggctggagggagcatagataggtaagcaatcagctttgtacacaataaaacaaaatgtgctatctaacaagggtagagacaagtattgttcacattgacagtctcaggaattcagttgtctacactaggagttccaactataagctaggaaactgatttataaaattgaaatggagaagcctccttttagtccctgaattccagaattgtaatatccaaggtagattttgtcttaatgcctaaaaatggagcaaaaattctggaaatgttagagccctctactgatttcacagctcctgtatatgacactggaacatgcttatacttggctgcacattttgataaagccaaaagttcaccacatggcattctggtctctcttcctctagggcatcttcccaaaggcctcagctctagaggaaatctgttttttcactcttgcagcctacactgcctggccaaaagtagggatttagcatgtgctctttatccttcctgagttttctttgtctgaatccccaggctctatgcccaccaatctttttaaaaaaggtcaacaagtaacatcatccccttatgttcatcatcttcttttccaggcatatcatcagaatcatctgagaccctttttatcaaagcatactggagggtttataggtgttgacctctaccctggataacgtggggaaggtagtaagcacaacacacctgccccttctgtgtgggtaagcccttgtattagtttgcatgggctgacataacaaaaatacaacagactggatggctgaaacaacagaaatatattacctcacagttcttgatgctagaaatctgagatcaagttgttggcagagttggcttctttttgaggcccctttccttggcttgtagatggccggcttgacttcttcctttgtcttcacatggtctttcctctgtgcacatatttatctgtttccaaatttcttcttttaaggacaggagtgagaatggattagggccccacccacatatggcctcattttactgaaattactgtaatttaaaggcctatctccaaatacagtcaccctccgaggtactggggtttagaacttgaacataagaactttgggtagtgacagttcagccccgtagttttgtgattaggatcaaattattttgcaatcacttggtgatggatttgtttgttatttggtcttgggctctgatagctgagacgttagcctcgtagtatacacagagaaattaactcaagcacaattcacaggtcttcctcatgacaggagaggcaaaagaatcatggaagtcaccacttggtaaacacctaccatgtgacaggcatggtaataggattttttattttttcttcacaatcagttagcaaaaataaatatttacacccccattttcatatgagaaaattaagattcagaggggctaaagtgatttgctcaaaggcataaaactagtaagtattggagttaagaattgaatataaatctgtctgactataaattcatgccctttcctcatgcatcctttatctggaattgaaaaaaaagtttttttttgctcattttaagctgtgacattaaaatgaaaaaacaattatatgaaagagtttctagatgttcacagtcatcgtttattcatatgtccatttatcatatactcatactggactagcattgcttcactttgtttttgagcttgccatggaaacttaaacaactgaagaatcaggaaatgatgacagcaaagtgattaattatacattgaaaaaacaatttgggggatgatggtgcagagagcccttttagccacactggcgtaatgaagtagtttagatttgtcctgtggcctctgcaatcgacctcttgtttgttttgttacaacaaattgctttacagtactgaaatggtctatttatgttcattgtttcttttgcagttttgttcccaaactttggaagttgttggagactgacagaagagccaggaacatcccagttttctgaacattttctatgattgtgacacattttaggatgctctttctacctagtgaatggtgcagtttgtaaggatagattatttgctgagaaagtgggtattgggtcctgtgacagaggaaatatatttcagagtattggagggccatttaaaaatgatgatggtgttgataatagcaatgcttcctgctgttgcatcatttagagtttacatggatcttctatatctcacttgattttcacaaaaacatattgaagtgatcagtcagggattgttatatccactttccatatgcaataattgagattcaaagaggttaaatggaggcaggacaaactcccacatctttgatcaccaacaactcccttgctaaattattctttgtaagtccagtacactgagttcattcactttaaattggtgcacattttgtcctcctggaaaaacattatgtcgaattgggaccattaataattgcttactagtttcaaatgtccagtgggatgtcaattgagatccagcggctcttttctccccagcctctttaagagaacacacagtgaattcaatgcgcagtgctttcctcctgctgcttgtacttcctaacaaagagcccccatttattggaaatcaatcatgtgctagatactggctatgtgttatttctaattgtcacaattgataactctgcaagagaggtattatcatacctaccttacaaatagggaaactgaggcttggagctgttaggtaactttcttaacatcacagagatggtgagtggcagagccagaacttcagcttatccagtctggcttcagaccattgctttaaaccaccataactctttaaattcagtacattgactttttaactgagttatttggaagttacagcttggaggaatccattccttaggaaataggttgacaaaaaaaatcataaagttaaaaaaatgcaaaaaactaaaaaaactaaattgttaatttatctatatcatctaatttggtaatagttttctacagttgattggaaagcttgtggtataagacaagcttctctgagggtaacctacagtcactgtaagtgcacagaggatgccttctttgctcatttctaatacaaaactatttctgttctcctatgtctctaatccactgaatcgtttttccatgtacctattctttttagttcatgcatagtcacttaattgaacacatactcaccaagataattaacaattattggctacttccctgacaaagggttaattcgttctgttggcaacccctgttaatactaaaaagccctggggcagtagatcctttcttctaggaatgacccccccactgttcattggagcaggcaggagtgccgaactaaccagtcctgctatctgtttcatctgtcgagtagacatttgactacctttttttgttgctgcctgtgactcaccctcattactcaagattgtggaggacagcaactgtgcttgaggagtagaggagcagtcctaagataaatcatcttaatgatttcccatgcgtttaggacttagaactttgcaccacaaggggataaatgcatgtcgcacgtagtcttcatagcaatgaagaataccattttggtttataaagatgtaggaaacaaaaattcaagccctccattatactacatgtctatcatgggatcctgcagattctaattatagtatctaccttttactaggctgctccttgtagttgcactttgacctcctcctagtgtagactgcttttatatgctcgacacctcacctcactccttctaccaccaagaagaacagagtccttagagcaatggtgaccaacagcttttgtggaaggtcaaactggtaaaaagaaaactgtatgagacaaatagtggacactcaatacataagtttagagagaaggaaggaaggatgggtagcttattattcaaattttatatcatcttttttctaaatagaaaaataccagtgagagaattgccacttctgtttagcaactaaaaaaaatttaatatctagtcatatttgagaaatggcaatacagaacctgctttttaatctttcagcctgaaattagcctgcctggttgtaagatgcatcctatgatctattggctgctcaagagtgctttagaggattttcgaacttgaggggcccttagaaatgatctagtctagtgattccaaaagttttcattatctaaggcatctttaattaattttcccctgcatactgtgttttgaaatatcaggcctactaaacaaattacctttatcacataataattccttctctcattttttttttctttttttttgctcagagccattaatgatctctcagtagagaatctggtcagcatgaaataaccagtgtaaccacaataagatgatataattccttcccaaagtgaaggcagtagatggttgagttggtctagggtcagcttgatcttagcaatctttacaaaccatctcccttaggcttattgaaatgttaaaaatagctcatggattcccatgatgaccttcttataatctttgtggacagccatttatcttatccttctgtagggaagaatggaggggaatcagatttaaaaagcaaagtgattggcccaaggtcacacagcaccttaatggcaaggaggaccagaatttgtgtttcctgagtctcaatcttctttctctacacacccaattttcatgtgccttaggtctaagagcttaatattgtataggcattccataaatctttgctcgatgagttggtagaacaggggcactaatacttaagtataggagatacaaaaaaaatccatgatgaattcattaaacaaccagtaaaatagtacaaatatccagttcccagttctgaattcgtacccagcctcctttgctttccttttcatgaatgatttcagacatctccctatagcgtatttcagctgctgttgctcttgaaaaggtttactcaggaagtcaaatagtgtccacttatcctgttataccctgtctccgagaggtgaaaatagcatggaattattctcagcagtgaaattcaccctcctcttttgctttcatcccctttacagtggtgatccttgctaaaatgatgagaatttgaatacctctactccaggatagttcattctcagtccttctagatgaagatccacttagctattcaatttttcttcctttctattactgttcaaatgtcctataattatccatgtggggcacattttagtgaatgacatttagtgaatgacatttttgacagacaggatacctacttccaagtaggtcagatattagagcttcagcagtgcatgctttatgtgattttcataggaattcatatttgggagctcctagctagctcatattctctcagtgaaatgttgaaatatgggctcaattgcagggctttagttgccgtgtactgtcctacatgcagggtgcacttcacatcaaccagaatgagttctgcatagcctgcaagactaaatgttgagttactacacattggacactggatctcacaaggggcctctgcaaaccctcatcacagaccatgggcagtgggagtgagccagtgatattctcaggcacagccctggggcccacccactgtgatgcccaggagaggaacagattgcccagtccctgatcaacagtccccttccatatttcccatggtacaaaaaagtatatatatatgcacagtatttcattctgatgaagagtttatagtcaatgtgagacaacaggtgggtttttggggggattttagtggagttgatataaattacatgagcaaagtagaatcttggatagtctaatgctttcagaaactatttgtcaggcccaaataaaatttttcggtcttgtaaatggcctagagcaatctctaagatgagaagttatgtgttaaatggcaaaacaaacaaacaaacaaaaaaaacaacaagatacttgaagaacacagtatacaaggagtcggcataatgagaatttccccagttgtatttttcttgtaatattgacgttgtttttccccctgttgtgaactaaagagatagaaaatacctttgtgtctagttgaaaatggattcttaattaactgtccagagatttgttgttagaggtaaaattctgggaagggttctttgtatggacaggaagaattagctctgtagcaagcataaaaagggcccatttcttcctaatggcttttccaaggaagtggggaaggagagaaaaaccgaaaaggacattctcttattgctcaaatgaccagatttcttggacccagaactgtagctcatacacagctaacctagggtcaaggtttgtaggctgcctctaaggcatccctttctttgccaaattgttatgcagatgtgatgtgttaaaaacacactccagccctggttgtttggagggcatctttcctaatggaggtgatacaatgtgcttattgagtcagcaggcactttgttccagagtagacagtaatgcaggagtaggaacataagatatggaggctaagttctgtcatttattatgtatatgacctggggcaaatggttcaccctcagcctctgtttgcttacctaagacatggggagaataataataccaacttccaaggcttgttgtatggatcaaatgagataatccatggaaaacccatctccccatgcgagacatatccttacatagtggctcaataaaagatagatgagcacgacagcattttgtaggacaaggaaaggctgggactatagactctgtttatttgaaaataatgccaatgagaggtctttttctcttgggccagtaagtctcactcagggaagaattctgacacaagtacatagactgcacatttaagctctatctggtgctcttccagattatggccttggttttgaggaactccaggaataaggggacttgatcatagacacactagtggagagggagcatcaggtgcctgtagatcagcagaaatgctacttttttttcagaggaatgagatgccatacatacaacctaatctggcttcaaatttcagaagcagggactttccacttaaatatcatcccatgaggtttgaggactttctttctgtgtaagactgaggattttgaaaggaatagccttgaatctgcaaattgcttagaacagtgtggccattttaataatattgattcttcctatccatgagcatggaatgttttccatttgtttgtgtcatctctgatttcttttagcagtgttttgtaattctggtagaaatctttcacctccctggctagctgcattcctgggtattttgttctttttgtggcaattgtgaatgagattgcattggctctcagcttggacatcgttggtgtataggaatgctactgatttttgtgcattgattttgcatcctgaaagtttgctaaagttgtttatcagatcaaggtgcttttaggcagaaactgtggggttttataggtatagaatcatattgtctgcaaacaggaatagtctgacttcctctcttcctatttggatgtcttttatttctttctcttccctgattgctctggccggaacttctagtactatgttgaataggagtggtgagagagtgcatcctttcttgtctggttttcaagaggaatgcttccagcttttgcccattcagtgggatgtgggctgtgggtttgtcatagatggttctcattatttggaggtatgttccttcaatgcctagtttattgagggtttttaacatgaagagatgttaaattttattgaaggccttctctgcatgcgttgagataaaacaatgacattattcacaattacaactcctttaaaattcataggaaatcaaaaaagtgcccaaatagtcatggcaatcctgagcaaaaaggacaaagctggaggcatgacgttacccgactttatactacaaggctacagtaagcaaaccaacatgatactggtacaaaaacagacacatagaccaatggaacagaatagagggcccagaaataataccacaaagctataatcatctgatcttcaacaaagccaacaaaaacaagcaataaggaaaggactccctgttcaataaatggtgctgggataactggctagccacagggagaagattgaaacttgaccccttccttacaccatatacaaaaatcatctcaagatggattaaagacttaaatgtaaaacctaaaactataaaaaccctggaggaaaacctaggaaataccattcaggacatagacacaggcaaagatttcatgacgaacaccccaaaagcaattgcaacaaaaacaaaaactgacaaatgagacatcattaaactaaagagcttctgcacagcaaaagaaactatcaacaaagtaaacagacaatcaacagagtgggagaaattatttgcaaactatgcatctgacaaaggtttaatatccagaatctataagtaacttaaacaaatttacaagaaaaacaaaatgaccccattagaaactaggcagaggacatgaacagttttgaaaaggacacttttcaaaagaagacataaatgtggccaataaggatataaaaaaaagctcaccatcactaatcattagagaaatgcaaatcaaaaccacaataacgtagcatctcacactagtaagaatggccattattaaaaagtaaaaaaataacagatcctggtgaggttgcagagaaaagggaatgcttatacaattctggtaggagtgtaaattagttcagctgttgtggaaagcagtatggcgatgtctcaaagaacttaaaacagaattaccatttgacccagcaattccattgttgggtatatacccaaaagaatataatttgttttaccataaagacacacgcatgtgtatgtttattgcatcagtattcacaagagcaaagacatggaatcaacctaaatgcccatcagtggtagactggataaagaaaatgtggtagatatacaccacagaatactatgtagtcataaaaaagaatgaggtcatgttctttgcagcaacatggatgaagctagagaccattatccttagcagactaatgcaggaacagaaaaataataacgtatgttctcacttataagtgggagctaaacaatgagagcacatggacacagacaggggaataacagtcaccggagcctacctgagggtgggggttgggaggagggagaggataaaaaaatacctatcaggtacttgcttattacctggatgactaaataatttgtacaccaaaccctcccgacacacagtttacctgtataatgatcctgcagatgtacactcctaaacctaaaataaaagttaaaataaataaactctaacatatgaaaattaaatttaaaaagctgaggatttgcaattcatggaatatgaagcaatatttgtgttgtcttagttttagcttatgaatacagggagaaatcatttgacttagggcttgttctgggtcagttgatctttggccttgtttccataaataaacccttactagcagctttggcaatgccagcaggaggccagactatgcctggtttcactatgtcctggcactatctcaaccaagagtgaaaatcttgggacaaatcaagtttcagattttgttgttgttgttttaggaaatggctttaaataccaatttctattctccaagtactttaaaagcaaagtaaaattaacattacatttaaagccaaccacctcaacatggcaaatgcctctcaacgcctaatggactctttccttgggctaaatggacaagttccttagcagagcttgtctaacccttgccttgcattgcaccccagtcccgcacaagaagctgagtagaaaaaactgcattgtgctctgcatgagaaacgtacctaagcatctaggtttagggcctagtttgtaattagacagtttcttggaagtacatcaagctcagcctcaaatcagaacatctcttggggagcaatctgtatttagatgtttcatttaaaaattcatcattgaataacaaaatattttgttgcaactcctacttgatgcattccaaattctctctgtcttttaattacaattatgttattaataatggatggaatgggtgggggcatgggtgagactatgccaggggctaagtagcaaacagagggtagcataagcagttaagtcatagttctttggggcggcagaatcccgtgaatcccaggccaagagctcgccactctggcttccttttatatatgcctgttatctacatcctacaactgctctgatttggccaggagaaatgttttttcaagtagtaggcaaggaatgaagttctaaaggtatttggcaggcagactaagtttcccccaaaagctggaagaaggacttactctttgtgtctatactgacagcctctacttttcccattatcttttcatgctatttcagccatccctccattgagactgctcttgtcaagatcaccagtgaactcctgtgtcacccaatcagtcttctcttttcacatccgtttggtctcctagcaccatccatctgttgactgctgttgggtgtggtgtagtccagggcaggaggagaagagggagaaaatgttatcacaaattctattctgaactacactatgtttagtaatatgcctatgttgtcaccctcatcctcatttatgttctccttgttcttcttcctcaatggccactccttctcagtctctttaattggcttcttcccacttaccattctctaaatggtagtttccttaagatttgcctctgggctttcttgccttcatctacatcctgctccagtgagattatctactccccatgctttaatctttatgcagttgacgtctatatttctatctccaatcctaatccttttagccacatgtattgtgctaaatcttctctctaaagcagaatactaaagggcagtcaactgattaatagccttctctttttctttttggccttcgattttttgtttctaaattgttcacctagagttactctttccacaaatattaaaagataatctatactgtgtcagacacagtgctagctgcagtatagactggggattaggaagttacaggtactgggatataggattccatgtgatactagaaaaatgtgtatacattcatgcagtcatacgtacatagctacatacaaatattcattcagcaaatgctaatggagaatgccaatgtactgggtgctatgccacacactagaaataccatgaggacaagggcatagctcctgcttacatgcagctagtggtttagttaaagtcagaaggcaatcaaaaggcagcaggaagtgtcatatagagataatttgggtgcagaaatgagtacagatgagggttcatatctagcctgtgtgtatttctgtgtgtgttattataagttgtattgaaaatattgatatttgctacatccttgccatctcgccccatgatatacacaaaggaacactctctgggtctttcgttctcaacatactgtgtaactctagccctagtgagctgaatttgacttgtaagaccagaagggctcattttgtctaaactcagtctctctgggtttctactaagctctataaaggagggggtagagatggactggagagaaaagaggaaacttcttctcaagaagaaagggggtccgggcctgcttttgtcatactagctatctaagagcaccacttgagagagatggcctggcactgcagggagatattctcacaaacagatataaaagaaaaaagccaaagtcacactcatcctcatttttgtgccacatatgcccagacctttaatcccttttctcaatgaagtataatctttaccctataacattctgaccgctcccctcactgtggccttgcggtccccagtgtggagggatgagggagaatggggaaacattaatgctttccctggagaccacaatatgtaagttttcacagaaattttcccacagaaggtgtgcttccgtagaaaggaatgcataataggtgctcaattagtatttattgaatgagttaatgaattatagagtgagcaggagttagccagaacttattctggtcagccattatgatggatgtttggggtacacaggtgaatgacatcaggtccctgctgtcaaggaactcagctcccagtctgatgcaagaaactgatatgctaacaagtaattaccatttggtgttatacttattataacaatagctaatgcttagtgagcccttactatgtctaggtaatgcttcatgtgcattatctcattttatccttacaattactctacttgatatattttgttattttctactctccagatagtcacaatgaagttaaataattttctcggagtcatccaaagtgcttttgatgttggcttgggtctgggctgaagcttgggggagttttgacagccatcagtaagattactaagggagagctctttttgtggagaaagaagcatccgagggatagaggtttaggaagaagcagtagaacattgtaggctctttggtctgtgggagcacaaccagtgtagactgtggggccttcgccccaagagatgattgagccttatcaagaattttgagataattcccctttgctcaagtacaactttgggaccttggaatcacccaatatgccttgtctttgtctctgatactaaggatgcctaagtgaccctgaagaagcaatggagagatgaagtttttacaagaacttcctgatcccacagcccagccaggctgtacatttaaccactggcatttggaagcagcagggcttgtaagtgtgcctcatgcacatcaaaataaaacacataccacatagattccattttcacatttttacgacattcttgaaaagacccaactataatgatggagaacaaagcagtggttgtcagaatatagaagagggtttgtgtgacttaaaaagtatagcatgagggactttgtgggagtgattgattgcaatggaggttccacagatctacacatgtgttaaaactcatagaactatacaccaagaaaagtcaagtttactgtatgtcaattttaaaagtccaaatataaaagaaataaagcacacatcatctcgtgtgctctatttttcacctctcaggctgtacaaaatgtgagcattcaaagcctttaatgatttggcagagttggaagaagggtaataagtggggagattacttgaacttggcacctgattcttttcaagtcatgagaagctaatttatcctcccttgtaccatctctgttgttaagctactgagtgcccttatttgagaaatgccctgtgggcaaaataggatggtgcatgatcacagtccgctctccaggaaactagtgtgaagctgtgtgaaagagcattttttttttcattttttccccaaactgtggcccgcaatcctcaaacgctcagcgtcccagctttctcacagtatttgacatgactgtagttcttgtttgtacttgcagcacagagcaagcagaccttgacttccagaggccctgacccattgaaggggccgcccaacaaagtttcctgcaaagagtaaagactctgaaacttcgattctgatgctataggacaggaggaccactcatctttaccaaatcagggaggtgtccatctcccctttcactcttttcctcctcctgaaatctttggggtgccctcctgagggcagggggagaagagggagaaaattttatcacaaattctattctcactagattatgtttagtaatatgcatagtattttttttttttccaaactcctctccttactggatgtgggacctttggccagacatttaaaacttttagattcttttcacatcctggatatatggctaatgactactgccttgcttaactcccagaaggactgagtcaaatgtcaaaatgctgggtacatttgtatgaggatgaggatcaattgaataggatttatgatggactggcttgggcccctacgatttattcccattagagcatatgttttgatttccaacctactaagcaaccaaatcacagatgcagttttgcaacctacagcacatttcatctcgtttattttcaaagctgtaagcagagagccatcctccatgagcagcacacatttgaaataaaatacaagttcccatcaagatattctgacatgttagacaagatgccaaattgttactgtgcttcagacttattaggcaggattgaaaagcagtttttagcatgatggcaggtcatttctgcttgcccatgaaatggccaaaccaagcactttttagatgtgatcatatggggaagaatgttcctcctccttatcttgatcagctttttaaggagaaggcatcctcatcttcctcttggttatgggtccgcttcctccactgaactcctatggcattttgctaggaccacttttacagctgttgccacattttgcctcatggtataattgttcctctacttgccacatatctgagtagtgtaggagcccctccacagcagccaagtcttgctcagagaactttgcagagttctttgtggattgctggaatctgggatttagctcttgaaagttaaagcaaaagaggttacaccgaaattctaagtaacctatttttttcatttagaaaagtaaaattgtatctgttgattatagaagattttgaaatattggttagtaagacatagaaaattaaaatcatctgtagttttcaacttaggatactgggttcataacttaatccagtttaatgtatacagttactatggctggttctgcaaatcgaaagatgactatgacatggtcaatgccctcagtaacctcacagactggtagggaagacagatacgtgaacttagtcctgcaggcaatggggagccagtacaagttttgagctggacattgacatgatgaaaatatttctggaatttttatctaaaggcagcatggtgtggagaaagctgggcctgaagcataaagaccaattcgcataaagaccaattcggaagccaatgctaaaaggccacacattttactgtttggccttaaggtaaacacaatgttattcaaccagagtgacctccttctcaagttagttacccttgggacttccaaaagtgaaacttagagattagctttgccctcatcacatttactgagcaacaaggcactttgacagcctctcactgtttgtgtttagagtgggggacacaactttttctctctccatctgattggctgagctcccagtctacactacagaacctgagtcttaggagacagatatttaaccccaagtcatgccactgggtgtccatgttaagaaatatcttagggaatcttccacaagtctgttgctgttctcctccaaatatttttggttttcttaaaaaattagtatgcccttggtcagaaaggtatagaaccaaagatgtttgcttctgcaaacctaaggatgactatgacatggtcaatgccctcagtaacctcacagactggtagggaagacaaatacatgaacttagtcctgcaggcagtggggagccagtacaagttttgagctggacattgacatgatgaaaatatttctgaaatttttatctaaaggcagcatggtgtaaagaaagccggtgacctctcttttacagacagaacagctagtctcctggttatacttgccctaggtctcacatattaagtggcagaggtgggcctaaaatttagcgttagacaactaacactggtcctccatgaaacacaaattgcttctaggctggaggagatataggtgtctctataagccagggcctgtagagcaggggcactagccataaagaccagacaacagcccaggatggctactgatcctagcagacacagttctataatgtaaaaacaaccaagaagcaaaccaacttaaaagttaacagacacacacacacacacacacacacacacacacacacacactacactcctgacatgtttttcccctttctattttcagttggggttatctttcagtttagttctgggaaggggtttctttttttgtcgttgtggttgagacggagtccctctccggtctctgtcgcccaagctggagcgcaatggtgcgatctcagctcactgcaacctctgcacacccccaccccccgccctcccgcgccgggttcaagcgactctgccacctcagcctccagagtagctgggattacaggcgtgtgccaccaggcccggctaatttttgtatttttagtagacacgggttttcaccatgttgggcaggctggtcttaagctcctgacctcatgatccacccgcctcggcctcccaaagtgttgggattacaggcgtgagccattgcactcggctggggtttcgttttaatggctcagtaaactgtgatctggtacaaaaggatgggattaatgggctcttttgctgcaaatggtactaagctcttccagctttatactctgcaccttttatcttcgtggcgatatttaagcttttaaggacgttgctgggagtgacgactccattggatccaatctcaggaacagtaaatggccttcaactctttttaaaaaagatgcattgcaggagtgaactgctgcaaactgctgcaaactccatggaggagtgacctttaaaatggggggtggggggatagtttgctgctggcttttcattccctgtagccacctaagctgttggggaatggacatgggaaacacactagctaaagggcccatttgttacaaactgagttttggtcattttttcttatttatatacttatttgtttttatctgagcacataaatctatatttgaatgctgcaaatcaccctttgttacactcttcttagtagacacatatgtatttagggtacagctgagtacagtacatttgaggttttgcaaatgataaattctgccatctccatattcttggataaaactagaaatacacaggcttttgtatacgaacagcagaagctgatgactctattcacatatagctatgttggatatgttggaggcctggagcaatttggccacagagagttgtttttaggattggaagaacactcagcccccaaactagataatgtgacatgttctatttttaatgagtttattttcttgtttcagcttggaggtgttagttcatcgttttgattcttgacaaaaggattctgcttagactctcagctccctggtgggttggagtttcacaaaaacatctgcgctaaagcaaaggggattcatactatcctagacagtgttcacttgaaggtttcccagaagcatctgtagctggaagagtccctgtcagtctctactccctagctgtagatgggcccacagccctgctgcctagggaaaagttgacagttattaaaaaaaaaaaacagcccttttctgtcatattcacttcagtaaaggaccaagtctgctattgcaaatgggctgtatccagtgcacaggtattctggtatctcctacagcacatagtcactattgctaaacattttgggtagttagagtcagtagtcccaaagattggccataagggccaaataagattggaattctgattatggtagaaaatcctttttaatgtattataattcataagaaatagacttcagaagagaattgatttcagagctgtattcctgctcatttcttccatcctttctgttcatttttcatttcctacagacaatcaattagtaaatgtaggatacgtgtgtacctcagtgacccaagttgctagggatacatcaagtgcttcagcccatagcagccaagggaggtttggggtgtctctacagctcttgacttttcaacttcaattataaatccatttggtcaagttgtggtttgaactgtgtgtgtcccctgtgatgcacttttggtaaacagctgcagtacagaagcagctgggcttatttgttaccatctctactaagccgccatataactgcatggggacggtgatacagcaagtgaaaacgggtagagttttacagcatagggtcttagattcatgatgagaaatgacactgaacaaatgactatttttgactttaaatagaagagattaaaagactttcagatctgttctcctaggtttttgttcatacatcttcatttttgcgatttctccggatttggagtctgttttgaaggggaaagttggcccatccagaaagcaccggatcatattttccattctgtatgcattttgctatctgccttgtttatgtgaacattaaaataaataaaaccttacaatctaaactttgcttttactaaataaatgaacacagcagttattaattgaattcagtcagctttcaaatagaatcattactttattacagtataaacacagtggaaagaaatcagacaccctagcacagtgcatgttttgctaggaatttaacaaatatgttggcctcaatgtgaacaagttatatatttttttcagacttgaggcttgttaactctttcaggccacttgctgctaggcaaccaataccctgctggcttgagtccatggttttaaaaattatcagtttcctgccagactgacttgaggacttttgaaaaagtaaattttgaatgcatgctgcgctttttaggcaaatctttattaaatgtcttctctggcaaagatagtactagaaatatactgagaagtgggagaaagggtggccccttccttccaagattttataatcttttgatatcaagcacacacacacacacacacacacacacacacacacacacacacacacagctaaggcagttcacaacaatggaccagggtgaatgctgtggactgcagttgctctagagtaatacagggaaaggatgtcttatctgtggactcatgcagccaacaaaggagctgtggaaaaaatagaggagtttgaactggactaagtagaaatgggggtatattttaggcacaagggacagggattcaggatgctgtcaaagtgaggcaaatagttgttgagggcctcttatttgctaagtgctagggacagagtgaggaatgagccaggcatcatctggcctttaatggagctttttagtatgaacacaattattttcattcttttttactggctaacttatgtgcaaatttctgtaagtaagttgagaacccatttgaactgctcaaataaaaaaaggagattatattggaagagtccatgattacagcctgcccctagatcttgtggtaggattcaacaactgaaagtttgagaacccaagattacttgtttcatcatcttgggtcatataaacttttgttgctgcttcaaagaccacttcaagcttatctcttctccacactaaacacacacacacagagagacacacacacacacacacacacacacacacagagttttcctcttctgctttcacacacttgtagtcacatcagcttccactttaaaactacttcctagtttgaggatccaacagagattgacttgaattcctgtgtcctgatgccaaagtcacccagctttggtcagttgtccattcttatccaatcagtgatgcctatttgggcaagttgtatgactttgagaagagaacaagagaaataaatgattgtcatttcaagtacagtcagtcattgttgagagaaagagcaaatcccaagcaggggcttaatatctgacctgaacacatgtgtttggtaaacagtagtgagacttgtatcactgaaaaccaggctttccatggaggggcatggtgagaatgaaaactggaaagatatggtgggtctatattttaggacgtcattttaagtgtggaaaagggaagtcttcatgtctcattgatattgaggcacattctgactggctaagttgcagagaaactgtagacaaaattcttgtcatcagtgaggaggtgtgggactggagtgagcattttctaagattgtttcccagcctatagttatttggtttgaggctcctgcagattcctttctgagaggaactttgtttattactcttttgctgtagggattatgctgccctctggggattgggagattcctgggatgtgagggcacccctgggtggggtctttttctttctgagagcaccgcgataacatcttcctgcaagaggagtgtgtccctcaaaggccgaaatggaaaagattcaaaaatctctaactctcacctctctagatataatgcaatacacatatagaatatacatgccctttttcttggagaaaatttccaaaaataagatatatatttttgtgtaatgcctattgcttactttaaaatatttaaattatttaattttaaaatttataaattatgtatttattaaaatttaatatataaattaaaatatttgctcagtctggaggattcaggaaagcacacaaatttggcatattacaaagtacatgtaaccctaaacatccaaagaagatcaaattggtattttattgtattctttttcaatgttttatgcatgtatgttatacaaaataaaatgattacaatactatacatacagttttgtatccattttgtcttagtgaacatttctccatgtcattaaatattcctggtagctatatagttttactgtaatatattttaatatttactaatttaggggaatttaattgtcctaaataattattccgataaatagctttatatgtaaatatttgatcacatctttatttctttagtccagctttcaaggcttgaaattattagggaaaatgatgtgaaattttaaggtcttgttatatagttccaatttatatagacccccagtctatggtagcggctgactacctcatccttgctggtactaagtaatagcatggcttgtagtttatatcagcttggtaggtggaacgcttctccatggtaaagaccatggcattttctcctttaatggtgttcagcacatatcaggcacactatgcaagtttgttaaataaatcatagtcaaaggagaaggtggtaagatctattacgaagacatgtttttttgttctaagtctgtggggaattcaagaagaaattagtttaagcttgtgtaggaggatgcagtagagaggtgggattgagaagcgaagggccagtgaacaatgatactgttaaatgcattgaaacttcaaataagcaaatggggccaaggagagaaacttgttaaaaatgaagtgtggtctatttcatggagcacagcataggtgactgcagagtagatcatggattgtttcaatgtaaaaaccagtgggttgaaccctagagcccagttggatgggtctatggatgggtctatggagcacagttggatgggcctccgactaagtgtgaactgtgcagggagattaggttgtaacaataaaagttacagttctacattcatttattcattctttcattcatccatttaacacattgtttttgaatttggcctgtttctgtagtgacgatggagctatgaagatagtactagagctttcatttgggtggtttgttcaaatgcgttaggtcggttggtgcaaggtttgtactctggccctaaataaatcatcttggctttctaagaggtgactgaataagactcacttactctgctctggccatataggcttagttgttgtatttttgtttttgtttttctttcttgagactgagtcttgctttgtcgcccaggctggagtgcagtggcgtgatctcagctcactacaacctctgcctcccggattcaagcaattctttctgcctcagcctcccaagtagctgggattacaggagcccgccacaccacaccctactaatttttgtattttcagtagaagtggggttttgccacgttggccaggttggtcttgaactcctgatctcaagggatgtgcccacctcggcctcccaaagtgctgggattacaggtgtgagccaccgtgcccagccccttgttttaaaaatatactaggcatgctcctacattagagcctttgcactggttgtttgttcaacatggaatgggcttttcttagatgtctattggaccaaatccttcatctcattcaagtctttgcttatcgctcacaatgtcaatgaggcccacattgatcatcctatttaataccacaacctacctcccactctggcactccttgttctccttattctgctcacatttttcttttttcatcaaattataccatacttttaattatgctacataatttacttatatgttatgctgattgcatactgtctgttttctcccacttcatgaaagcaagaatctttgtttgggtcatgctgtgtcactgaaccctaaaggagtgtcttaaacacagtagtgcattattatatttttgtggaatgaataactcatcatgtgcttggcaggcaacattaaagaggatcttcagatttttcagaagagcaagggagaactcccctcacctgctgagctgttggctgtggactccagatcaaagtctgaggaaccactcacctccatttcttggcagtggagagtgagatcaacaagagagataggagaaaatcatggggagactttgagtttagagggtcctgggcagctctctcacaataacagtaaggtagggaagcatctcagagctctttatgcaaaggccctcatccaaaaatcgagaccagatttccatgaccattgctgttgctgttcttactacatctgagctcttccatgccctcttttccctttgatcagtggtgtcagaaagcagatgcatactaacatttaccaattgtaggacatgtcccacaacgaagctcattctgccttcaacaccagagcaagagggaattatgggaagaatattcaccagggtagacttttggggaagtgatgctgaagcctcagtattaaaaacttggagcagtgggggatgtggatgggctttctgaaaaagttttgaatttattagtgaacctgttactcatcccttttggggtgtgggtaatggagtggagggagagccacagctgctttgtgctgagtcatacgcttgtgtttgtactttgccttgcatagaggaatccaaggttgcttcacaatgacttggttaaaattagcactgtcagagagctccgtaaagagtcttgtgaaaagtcttccaaaataaatcaaccttcctgttggggttgagtcatccccttctttcttcaactggaaatgattttaatgggaaggtaagccagtaagatctttttggttgccgattttgaaggtatcattgtgataacacagggtggtaaggcagaaagtgtcagacagtggtagggggtcaaatgttggctgtggcgtaacttgctgtgtgaccttgcatgagtatcataacttttcagagtttcaagtgtcccaaaagtaaaaagtggggctaccaacatctgctttgccgagagacaatagatgtgtaattaagtggagcaatgtatatgaagcatacttcttggcacataaagtccctcaacaaatgggaacagaaatgatattgatcactgctttccacatattcttcaaactaacatgtctcaaagcaagcttatcactctctgccctgctgttttcattgagacctgctgctacttgaattcattgtagctctcaggaaaccatcattcacccaggcatattgatatattgatggctgatcacttctcaattaccactaccaggactttaattctgcccttcaccacttcatacatagaatattttaccaggtttttttttttttttttaactttccccctacctcaaacacctgggagttcacctactagggtggtcccttggttaggatgtcccttacggtttccttcctattctgcttactgtgtggcagttgagtgagcatagcatactactgtatgtcattcagggttatggactcagttactcaattctgcaccccaaccccttgacacagggaagcacagtataggtgctctataaagactggctagaattgaagtatatgggaagctgtgaccaagacgtcctaaaggcatattaaatagtggttgtcaccatctaaaattaccttatttatttcattatttgcatatctatatgtccttgctgccttcattattgtccattttactcctgtatcatgtcacaagaggtagatgtccagacagctcatcattcctcaagtcatacctctaagagagcaggaactgtatctttcctattcatggttatgtctccagaccagagcctggtgcttctagtggccatcttttccaactgtgggaaaaacctgtctgacaatagagccaacacagagaaaagcaaagctgagagatggagaaaaaaggcagagtgctgctgatattgttcaaaccataagatcctggcatgcctgaagtgaacatacccccttggacatcccatatgtgagccaataaattcccatcattgctaaagctaatttgagtggggtttctgccatttgcaataaaaagcaaactgactaatacatcctctcctcagtacctcataaagcttcatgaaaatcaaaaggaactttccatttgcaacaagttattcattctagtatcaaagtttcaacatggttatcctttcctgccttactcaattcaggaatgcaccaataatgatgccactagagagagatttccttggtaatgggctgaagagcacctgatgtggtggtaagggttgctcctttaaataaaggaataagcatttgagctaacacatggatgatgagaagcagccatacatatgcttatctagaggaaaagcattctaagtagaggaaacagcaagcacagaggcccagagacaggaaagaagaagctgattgttggtttaagaactccacagaaggttcatgtggctggatctttgtgaaagaggaggagacatataggaatggagaagaagccaagggccatgtgcacttttcaggagaatgcatgaattcaagattgtctgacttgggacaggagtcaaatgggcggcaacaagggcagcaaagaaggcctgcattcattcagtgaaaatgcagggtggcttgcctggcactgtttcacgcagtgtagctgtacaagatggtgtctgcagggttgtaccagcaaatcaattgctgtactaccaacctagaaaagtcagtgaatcatccttatattttgatcatatagttaaatatattccgtttgatcctttagtaagttagtggagctgaaaataaatggattaggttggagaaataagttaacctctcacattcatcagagcttaatttagtgattgcctccttattgccctagatgggccagtagtatgacccatctcactgtgagtaccttactctgagaattttgctcagtttccaaaaggcagcaccatagatatgaacacacaatgttaataagctggtattatgaagcacatcatactgcaaaaattctgatggtttcatagaatgtgaatatagtagatagaaatgtatttttatttcaaagtcctgggacattatgcttgcaaaataccttgaaatcgtgtttattctctagcattcatagcatccctaaatcattaatatgcacatgttccaaataaggaaactgtctgtcatataggaatattttgtaatgcaatttaattcatctcatttcaacaaatatatatggactgtttgatgtggatttatggtgttgaaagtagactgctttttgtaaggagaatgaatggatgcaggctagagatgaagcggggcatcttacaaagaaatgtttctagtaccatgggttaagtgaaattctaccatgaactacgaaagtgacagtggaaatgaggaataggcaaatacagatatttaaaagcaaaaccatcagggcttggtgacagattagaggtgaagaaatagagaaggacaggaatcaagtatatgtctatgaagtcaactggaaatattgtggtgttcttgatagaagtgggaattcttgaggaactctagtttgggaagatgatgtctagtggacaattggaaggcaggcctagagctgagcagcaaattaagtcctgaagatggacatttttagatcacccccctaaagatgatgactaaagctatggaaatggataagctcatccagtaggtcaatgtagagagagactccccacagattgaggcgtgcagagccctatgcaggccaccttgacataactcaccatacctttccccatgagtgtgattggcacccttggggccattttgatttcggatataagccttgtgctatagaataggaaaatttatgaagacattcaaattctgccattgaaagccagtgtggtatctggataatggacatgttattttgagaaaaaacattgcttacactcaggatattagttagaaatccccaatttagtttcattttttttgtgtgagaaaatatggcagtggaaacattttcagaaatgggaagtcatttcttagagagatttatttggagcatagccagtagcaaaatcagctattgacaccttaagctacagacttaagatgaaaaacaatgatagagaggtcgttttttttgttgttgttgttttgttgtttttttttttttttttgagttccataaggagaacatgattagcctattcttctgattgttttatgtttgcgagttctgtctcctcagttaattttcatcttttctgaagcatgggttctacctcataatttttggatctccctgcagtgcctagcacagtgcagaactagtgtatcacacactcagatatctcttgtggaaaaaaatacatcacaacaagtagaattacaaggttagattcaaaggtccttgaaatgcagtcaagtctgttctcacgcctctgtgcaggatagcaatcaagctgccccataatattgactgtcttcttgtaaatcacaagatatgtttcttaggctgaggcaaaaaggacaagtagagaaaccatagtttcatgggctctttacagctggaagtcagaaataccacgaaagttggaagtaatagtgacaggaaagggtacatgtaggactcacactaaggaacttggtagcatttcttataatacctattcaatcaacattgtcagtaacacggtcagggctacattggagtaagaattaatactattaaaagaaataataaatatgcaaataacctgaaaaatatccgtagtatttaccacctgaattcacacagtgaaatgaagcctttacacactttggagttcacattgcacaacttctgcatggtggtagtgatgagtgcatgaatgttctaacccaattcgttttctatgacctcttaattccctctaggaacttttgtgaaaaaaatgtcatgctcagtagagattgcttttgatgtaagtaatacttagtggtttggtaggtaaatattagctaatttttgagtgctaactatgtacctggcaccagactgagacttttacatagattattttatttaatgctgataatggccctctgaagtaggttttatcatttgtatttttatagataagaaagtaaaggcttagagaggccatgtaatttgtctgagggtatacatgaagtaagtggcagagctagtggtcagctaaacctaaaatccatgctcttaagagaactaggctaaactgcttacataatatattaactacattaaaattgataccagttcttttgtgcatagttggccgagttcatagagacttgccaagaactgttgaaacctttatctacagagataaggtagacagtagagaagaccaggagcacttggaccatatttcccagcagttactctcacctcgctcgtccagtcctttctctatcattacaacattgaacactagtaatacaactctgtggcagagttgatagcacatcagttatccccatttaccttctgtgtgatagcatttcatggtattatatgaaattatctaaaggatgatatgatttgatgttgctaaagtgaagaaaaccaccaaaggtagacttgttctcatttaagaaaaagcctccataggttaacttgaataatcttcagcttgtcttgtgggaccatgtcaaattaatttcagctgatgctgtataggaaggaacaacctttatcatcatcattatcataaattcataccagtcattattccattcatagtatatgccaggtgagttatgttcattattttaatcaatcttacgaaaaaaactctctaaaaacagggatttttatgctgacttcataaaagaggaaatagatactctgagagattgacagtcccatgatcatatagctaattagtgacagtcatatgatttaaatgagttatgcttgacttcaaacctgttttttctattactattattatttaactatgatcacaaaataatttaaacatacagtgttggtgcagaaatattacctactctcacttgcctgctgacaagataaacaaatgtcatttggcctactttgcctcaaatctactctcccctcttcttaatttttaaaaaatttttattttgaaataactataaattcacagaagattgcaaacaaatacacagaaaagtcctatacaacattccccagcctcctccagtattagcatataacataattatagtacaatatcaaaaccattggtaaaatctttagagctttcccagatttcaccagttaaacatgagcccctttgtgtttttctgtgtgttgttttatgtaattttatcatatgtgttgtctcatgtaaccaccgtgacagttaacatactccactatacagaagactgttctgtgctactcctttacagccatattcatctcctctctcttctccctaatccctggcaactaagttgtcctacatatctacaattattatttcacaagtactagataaaagaaattatatagtatgtaaccttttgaaattgacctttttaactcagcaacaatttccttcagatgtatccaagttgttgcatgcagttgtgtcggtttacccattgaaagacgtttgaataatttacaatttacaaaatttatttatttttctaggataaatgcccaagagtgcagttgttgagtcgtatgataagttcatatttagttttgaaaggcactgccaaactatttttctgagtttttgtaccatcttcctcttattaatttacactttcgagattatatgtgataaagtcattagagctttctcttccttgaaatttccatttatataatttgcccgtctttttctaatgagatttttggcctctttcttgctgatttgttagagttcttttttaaattattagcactaatcctcgttaaatataccacaaatgttgtcctgtctgtgacctgttagtttgtacgtggtgtattttttcatgcatacattttaaattttaatgtagcaatgtttatcagtcatttcctttatggtttgtggtttttgtgatcttacataataaattcctttgcatttttttccataggtaagcccctagggaccaaacagcctctttgctcttaattgatacacagtattaatacttctgctgatctaatttggaagcacctcataagttagaattacactggaaggcataagggaaattctacagacagatactctgatggcaacaaatgatgatttttcaggccatctcaattaattctactttcttccagttggtcatctacttttggtcatccttcagtgctcaaatattaactcctctgcgaagcctttcattacattcctcaagacttgttttgagctcctgctttatgtttaatcatcatcttgtgctaccctccttattgtacttctcacactgcagtgtagctgtatgtttactcacctgtgtcccccaaccaactgtagattgcatgagagaagagactgtgacttgtttaatagttgtatccctcagtgcagtgtctgatggatagtaagtgatcagtgaccctttatcaaatgtggggatgaaagagatgcattcaaaataagcagacctaagacctcacagagcaaagcagccttagtgtgcttagttcaaaggcaaattcccttatagtccatgggtccattcctcatgagagaagcaggactggccagagctctgtagtctgacctgcttagaacagtgaataagggtctgggggccacaggatgcagtgtgggggatttgtgctcaaggcagtgaagaccttggtaataaaaggggttgtttaatcatgacagagtgaaggaaaaccaaagtccaattcccagagtatgtacgaataacaaggctcagtgtcaaaagccaagagctgcattaaaataatactgaagcacaagaaaacaggaaatcctatttttttttttgtcttctgtttaaagaagcagagaattgtgtcaattgttttggaaaggttttagtccaaaatggttaaactatctgttggtatgattcgtctccccatcataggcacagacacatgttctttccaagggagatggatcagactctataaaattcctagtacctccttatgtcagatgaagtaataatggacattcctttcagattcatcataactcaggaagattgttctgatggtaagtgagggaaaatagaacctcctttcgagtcaattcctgctgcttctggactttgccattatgaagcaaaaagtctgtttttaattagagacctgaaagcctaattttatgccatggtaacctgtgggatctgaaatacacacccccagatgttgcctgtagcaaaatatgttcatagcaaaggcaacttaaaagtaaaaaaaggaaaaataaagcataactccaaggaagcagaagatataaagaacacactttgataatctttagtgaacttgaagcaattgtccaaaagtgagctatcatttagaatttattgtaaatgataggaaaataaaataccttgagtgggacttgctgctcaaaaagtaaagtgaagtgtgggtgtcttagttagctggggctactgtaacaaaataccacagactgagtggattaaagaataggcatttatctcccacatttctggaggctgaaagtccaaggtcagggtgccagaattgttgagttctggtgagggctgccttcttggttgcagatcgctaccttcttgctgtaccttcacatggtgaatagaggatagtctggtatctcttcctcttcttgtgagaacagtaattataggggcttttcctcacaaacccatttaaccttaattacctctcaaaggactcagctcctagtatcatcacattgcaggttagggcttcaacatatgaatttgggagggatacagacattcagtccataacagtgcaggaggcaaaaactaaacgtgcattttcctaagtgttaggccacttagtaattcaatataatgctgctctctttttctttatttctcattttttttgcataattaatagtattatatgaacccacttacatagttatagtcagggtcagctttaaaacaaaactttcacgtcttctactatcttgctgttccctctctttccctcttttcccttcactcgtgctccctccatccatttggttttgtttgggtaatttagggataatctgatttagtaaaaacagctttggtccagaagccgggacaccttgactgtgccactaactcactatgtgaacttgggcacatttctttttctttgtagaaatcagtgttctaatctgtaccaagagtaggttggataacttggtctctaaagtttcatttgcttctgctcatattggtctcactgaaatatgatcagtactcagttgaatattgatgtgatacctgaatagcatgtagaatgtgatcagtctcttaggcgaagcagctttttttagagaatttaatttgttataaagcagttaacttgctctgccagtttcatattaatatttcactgaatgatatctttgtcaacatcagaaatagataatgagtttataatcaatatgatgtcttgaaagctggcctttttctgattcattgctgtccctgtctgatggtggtctatcaaaatgcagaccctttctttgcatcataatcagacatacctgtaagctttcccacattaaatgaagactgtttcttctttgatctagtttaaacagatcagggattgcaaatgagctcatttcacttgtcaactccaatcaattgtggaaatataacaggagtccgtatttagaagtattgtgaaaagtgttttgggcactgtgcactaagaattgtcagagtgtcccatatgtcaggagtttgctatcctagacttggagagtgagattttcaagtcatctcctgctgtcttgcaatcgactcactgcgaattatggaacagatgttgctctgtgatcaacaggtctcccaaagctctggaggcacctttatgcaacaccagcaggaccaattgaaaaagaaattacccaaacattacagagctgcttgctgttcatatcttgcagcttctaatgacccaaaacaaagatgtatttatataatttatttgctatggaatgggtaagaattaaatgtgatcagtgaaggtactaggaccagaagaacttagagaagccaacagagttcaccatttaaatttacctaccatttgttcaataaatactataagccaggcatttttaaagacactttagttcacatctaatccttcaaaaattctgtgatggaaatggagaggtttaagtagttttccaaagttcatatctcaagaaatgagcatttttacatctctgaagagggggtataaaaattggtgacaatgatgaagagaagaccatggacccgtcagcctgaactcttgaagatttgggattactcatctgtagatcccatctgacaacagatgttgataagacacaaatacctgttgaagctttagtggatcaataaataacaccccttcattccccatttgagtcttgaaaaaatgagggaaagtgtgaggtagataaaggtgaaaatatcacctcaatttttggtaaagctgcttgtagaacatagattaggtcggtggccaagcaaacaagaatgcatgctccttcaagcaagcagttagcaagaatgagaaaggaactcaatcgaatatgtccaatttcttcttccaagtttattggatctgataatgaggataagtgtcttaagtcagcttcttcctaaagtaggccctgagacaggatctgagttccagtggtttctttgggaggtgatttccagagcaccagtaatggagtagggaaatgaaacagggaagaaaggaatttatttaagccaatataaagtatattaatgagcaactggagctcagtcatcctgggaaccctaggaattgtgcagaacatgcctctgagttgaaaaaactggagtagccattcactaactgctatcagtcatggctaagggctcctcctaggaatgtcaactccctggaaattactaactctctagcttactctatgcccaggctgatcaagcttctggggccagagaatgcactctggcaggcagaaattgcaaataattgccataaagaattgtccatgtgcacaggagcaggcagtgccaagtggttaccagtggagtatagatggtgatacatttgtcatgggacctgaaacaacccagtggattttctaagataaactaaaactaactaaactaaacttggagcagttttcctactacttccttttctctgcaaggaattctcagcagggcctttccaacataagcatgggaggtctttttgtacaaataaaaaagattatttttccttatttcttatatttttctgtttgtaaggcaaaaaaaaaaaaaaaaaagtccaacacaagcttcgaaactagtgaggtcttggctgtacaaaacctttggaaaccattggtggttttggaagctgccaatgtgctgtcaggcagattgaatctaaagaaaaacgcagagatgaatgtttcccatgccatgaataccccaaccctgctgtctggggaatctgagaaggaaggcagcatgaagggctagactttcactttttgcaaatggtttcagaaagagcaggctgagaccacaaagttggagtaacatacagtgtgggatagctgcaaaataatggtaggagaaggattcatgaaaatgggatggggccagaaggattgtaatggtatttgtgtgaaaggcaatggcagctcggggggcacaagtaggaggaaccatcccatctagtatcctgttgcctggatctcaatactttattggccatgagctacttgctgtccaggggagtggtaagaggtgaggataaggtgctctctcagtaggagccttgagcgtaggatctctgagaagactgatgattgatttgtaattagtgaatggattttgtcaaagtcttatgaaaattttccatgatgttttgcattttctttatttttaaggcccggaaggggaggaattatctcagtggtggccttgccctcattaatgaggcattagctcacctggttcaagcacagtacaaagaatactaacagaataacagtgagagccttccctgagggttggtctggatgtaatcctggggtggagacatgttgtttctattaagttatttcatcctggagtcttatctttgcaccagaaacccaaaacaaaaaattcttctaatcataaggattggaaaaaacagtcaagtcatattattatgttctaagattgatgttaaaatactccttgttcgccctgatagttttctttccttccttccttccttccttccttccttccttccttccttccttccttccttccttccttccttcctccatccctccttccctccctccctctctctctctttttcttctcttctcttctcttttcttttctttccccttcctgacttgtttattgctgtgattctgagtaatctaattcaccaagttttcacaagtctaacagtaacccaactacaattgggacttctaaatagtagatgtggccgggtgcggtggctcacgcctgtaatccagcactttgggaggccgaggcaggcagatcacaaggtcaggagtttgaggccggcctggccagtatggtgaaaccccgtctctactaaaaatacaaaaattagccaggtgtagtggcacacgcctgtagtcccagctactcgggaggctgaggcagaagaattgcttgaactcgggaggcggaggttgcagtgagccaagatcaacagagtgagactccatctcaaaaaaaaaaaaaaaaaaaaaaaaaagtagatgctttttctttccaggtgcaagagaagaaaatcataacaaggtccttcccttaaaagtaaaatgatgctgtctggttacaaatgggtttgagatgtagtgaaattttgtttacagtttattgctgtggaatgatatcttgggtttaaatgagctgtctttgctaggggtttgttttcttttcataccaggacaacacaagagtgaaaacctggctttgaggaaatgtcagggccaaacactgcgtgcaaatagaggaagggtcaggatgctctcttccagagacttgttcaggactctttaaaggggttcattttccctggatgcagactgaaaactatccacatcattccccaacccccactgccattttgaatggcaacttcatggcaaagcagaacagaatctgggagtgagagttcgaatcctacatctttgcagttacataaatccatgatgttaatcatagctgcccaacagaatctcttgggagcctactaaaatgcaaataactgggtagttttgccaagctattgattcagtgggttttgggtagggcttggaatctgtgttctttaatctgctcgttaggccacccaattttgatcaacttccatcaatcttttactctaagttgattaaatagtgatatatttatagaagtttctaactctaattcagtagcatttttctttatttcctttgtatggacaactggcttgttaatatgccttcagagcccaagtctctgaagtcagtgttctcttctcagcactgcctctgatttgaaggatgacctttaacatctcaatggttgagtctttccctgtttcctatgtggacctaaccactcttttttagcatgctgaatgccgacagaaaacgattgtgaaaagttcaaaatgtaaattgccatggaaacattatagcactggtaaaacatgtattctcagtagataaaggggaagacagattggggtgaatgaagctatccattcatcaaccttggattaatcaatctctgcttgtcatcttaaacagaaggattttaaaggaattatggatttcaggtcagaatttgtctggtttagtattttttatttcaactccaaacatttttataaaatgtgccatgctacttctgggatatataaaaataccagtctccaagatagtaggaaagctgtttgctcagagaccaagggtgttactcccttttacttcaaaccaggaagctggaaggagctattctgttacgatatgtattggacatttccatatgcatttaagtcaaggaattattcctgagtatcttctgagacagggtgttattctgggtgtttcggaacatatagatgtgaggaatatgcagtctccactttgacaagtttacagatggttgcaaagttttgggtaaaggtaaattattagctgcctgtgatacaagataaaatatttgccatggagattcagagcagtgaaggcccttgcatgttgggagaacgagcaaatacttccaagtgggaaattagatttgagatagactgtttttttttaacttttattttaatttcaggggtacatgtgcaggtttgttatataggtaaacttgtgttgtgggagtttgttgtacgtattatttcatcactcaggtattaagcctagtatccattaattatttttcctaatcttctccctgcctccccccaccactctctggtaggccccagtgtgtgttgcccccctctgtgtgtccatgtgtcctcatcgtttagctcccacttataagtgagaacatgtggtatttagttttctgttcctgcattagtttgctagggatgatggcctccagctccatccatgtccctgcaaaggacatgatgagatagactttgaaaaacacacaggatttgaccagacacaggcattctcactacagaaaaaagctggaacaatggcctggaggtgcgctcaggcaaagtatgtatgaaattgtcttcaaaatctactgcaagactttcagatttccctggaaatgagataattgctcctttattgacataagttggggttcattttactatttagtcacctgaggatatgttagttatcccagcatcccagcacctcctttgcttgaaaaaaatccttagtgctggggcctttgagctgtgggagtgaatgaataggcatgggaccaaattgtaggacactggtaagtatcctgcactgggatactgacatagaggccaataggtttaggaaagccaaacaacctgcttacctcacagtataaatgaaaaagcctgggctttggaaatcagatcagcctggatttcaatcctggttcttgctattaatgttttcctaggcacattatttaatcattaaatataatgtctgtcatgtagctgatacagttggtatattataaattttcaataaattaattacctgggtcctgtgtgtagagaccatgtttcaaggagggatggtagatgctcacctgggtttccatagagccaaagtatatttctcttgctgttttatagcatactctgtctccttcaaatctcagctttttgcttggctctagccaagattggaatgttcccttaaatatttctgatctagcagaaagaccagcctttcagaacttgcagtggcttcctttgttgacattagattcatttgggacttctttaagttgatgctgccatcttcctatgctttggcctctactttgaactttctaatcttgctggttttgccctatctgcttgggaatttgaccacaacagtaccaaggtaccaatgtcacctctaggctaaactaatgtcttcttgtaacttggtcttttcatatggcacatcttgccaatcttatgggttgctctttgtgatcaaaaatgaccaacctgatcatgacggagggtattgggcaccagtctggggccagtgtgagtatttcttgagcttgaggtggactccttaaccttgaagactcctaacatgatgtccttatgtcctttagccaaatgcaggaagacctgtggtacatagcttgatcttgtctctttatactctaaacaagctggtgggctagattaacttcttcaggccatcctgactctctggcttttctttgaactgtctctggggcttttgagcagcctctggactccatgatggaatgggaagtttgtgatataagagctatgatacactaacttaatttttttttgctcctgtgtttcccagactcattagattatggcacactcctgctcatgtgcatgccaattcacatatatacccaccaaatgcctgctaacatattcagataatgtttttctctcactttggaaaaatgtcctagtttaatcctcataaacatgctgtgaaatggatttattatctcccttttatggatgcagaaatggagtttaaagaacttacaggatttgtccaacatcacctaactgtaagttgcagagttgtacacactaattagtaatcccgctgctctttgaccacactcactgtgcctgcatgcattagccctgctattggcccttgtgataaaaatgtcatgctagcacaaagttgggaaacaatacccttccatagggtggccatgccaatcagaagccaatgttacctctcttaatcttaaagcatgaatgggctctacttcaggtctaattgaactgagaccataaaaccaaattgagaaggctccatgggtgtgtcatttagtctcacatccaggagctttccattgggtctgctgccacatttacctctctctgggttttgggacattctcacatggaaggagccgagatcgtggcataattaccacctgctccatttgggtactctgtcggcttctacatctaccctcaagtctcccactccgggtgagagcaatggtagaggcttttgtagtgctgatcattatctccatccccgggaaacaggaaaacagcacaatagcaaaatccttttggctataagatttcctgtccctaagtcacagaggaaaaccacataaagacaactagaagctcagtaacccccagcaaacctagctatgcacatttagcatgtctaagcagccttaggttcaaattctggtacattgctgtgtttctctgagcctcagtttcagcattcataaaatggggataataatacttgtttccatttcatagtgtgattcaaggagataattgatgtactatgttctgtgtatgtctgatggacactctaaggcagaatttgaaataaagacattgcttcagctgaaggcagatgttaggaatagtttgttgttaatcccaccctttggcaacaaagacatttcaacatccagtatcaggctgactgtgactcacaaatgaattcagaataatagcaatacctgtgagctctcagactggcagtcagaaccctgctgaaaggattagcgcccgcagcacatggcaactctggtaatggtgacttgaagaagtagtaatgtctcagctctttaaattgtgtgtttttttaactaatataatttttaaaaacttcattagcagcacagaatgttagaactgaaggatcttccttatccctgcctctccttttacagatgggaaaactaaggaccctcaaaagggactgtacctggcttcaaagtgacagaagtaatagatgacaaaaatgagattctaacttgatctcttgtataatgtcaatattctgattttacatgctcattagataaaattgaaaaaaaaaaaaaagaaaatgatggccaggcacggtggctcacgcctgtaatcccagcactttgggagccaaggtgggcggatcatgaggtcaggagatcgagaccatcctggctaacacggtgaaaccccgtttctactaaaaatacaaaaaaaaaaaaatttagccgggcgcagtggcgggtgcctgttgtcccagttactcgggaggctgaggcaggagaatggcatgaaccttggaggcagagcttgcagtgagccgagatagcgccactgcagtccaacctgggtgaaagaacgagtctccgtctcaaaaaaaaaaaaaaaaagaaaatgattaagaagaaaaagatcaccaataatcctactctacagacatatacatcattaacattttggtgtatttgatgcaccaaatagcaaatacctctctttctgtcttctctgtgtgttcattttctttcacctgttcagaaacattaaaactcaggtcttctgacttcacgctcagtgctttctcttagcatatcaggctgcctttctaatcagcattcttatttgatatttagtaaccaagagttaggttttaaattctcaaaaccaagtaaagctgccagtgaaaccccatgtgtatatggctcattaagaaaacaggtgtaataatgaaatcatgaataaatagatcaccaaaatggcctagatcagagagccaagcatgatgctagacagaggtgtctcaaaaagcacagccacatccctgccctcaaggagcatgctcagtggcatgacctctatctgaaacaagggctgtctgcctgtgctcatcccagctcagaaatgaagcagaaaatgaaaaggccacatgggatgcttcctacagtcctgttaatgtcaggagtgcaatgcctaggccctaggcattttgactcagcttcagttctctctcccaaggctgaattactagaactccagctgcagcctgaactttaactccctgttctcttcccaacccacaatcttgttatcagtctgattctgatctgttagggagaggggagggggagctagcagagatgtgactaagggcaattgagataggtcagaatggccttgcagtatattctgtcttagtgaaggttttgctaaaccattgctgcactggggagagagtaggagaacccctgcctccttgtccgcattcccttagttaagctgagctaagatgatccctccaagcttttcctaacagggaatctacattctctgtgtcttgctggctggccacaattccttggggaggcaggagctaactctaccgtcctagccaacttgaataataggaaataaatgggatggagagccaggcagcctctttgttacacagcacgttagtgaagcagctatctatttttagaagagggggaaaaagtagtagcttactcttttgggatcagcaggtggaataatgatctgccaaattttaacattcaagattttttagctgggctacaaatgagacagacttttgtgcctgcctcagtgcaatgctgtcagtgtaatcgcacatccctgggcaactaaaacatgaacgctggggaaaggagatataggactccatgtcacagaactgaaggctgagggtgcatgctataccaatagcctgattgatttaattagaaaaaaaataggtggcctagtcaccaggagtattgaaacctcagatctctgctcaaatgttacactcagtgaggttttccttggcattctattaaaagtaacgcttgccgatgacgcttcttttagcctgcattattgttctttcctgtacgtatcgctacctgacattgctttttatctgtttattaatttttctattttctgtctcagccactggaatgtagggctcaaaaagacagaggcttgcctttgttcactgctatgtccccacggcctagaactatgcccagcacatgataggtgctcaggaaatatatgttgaatgaattaatgaatgaacatgtgaatgaataaacttagtatccaatagacaatgagtatgccaataaaaatgacaagagcaattaataattattgcatgctgcacattaactcacttaatcctcacagtaactctgcatggtacatactgtccttattttcattttacatttaaggaaaattagacttgggggttaagtgacttgcctccgtggcctttgggtcacagcatgaataaataatacagccagggtttgatcatcagcctggggacaatgattccagacatatcagactgagcattcacttaatagtattttgcattggttttttggaatttccttccatgattcttacctggccctgtaaaactctttcgataaaatgaccatatgagatggatgtttcatttccatctgcttaacctatagcatccatggacttgtcattataaactccaaccagaagagcaggatatgcctcattgttctgtgacaaaaagaacccattgaacattttttggcttagctgtggttcattggtgaagctagatcagatagagaatggtggtttcttccttaaaggtttaagaataaggattaatggctattctgacatgctctaatgtggactttctcccactggatccacgacctaaacaaccacgtttcccaacttaaagtgttttgcaaagccagagcatgtcagggcttcctggtcatgtttttagtcactttcattcacaaaagtgaaatttgtttgtactcccttctccccaaataaaatgcaacaaaaatacatcagaccacaaaatcacacctagtaaaagctgcccactgagctctctagggcagtgcatattcatttatacgtgcatccaaaagttgtcaaggtccccttagagtcttattgccttctggggtctcccatgcactgtcaaccacgtggcttagggagtatatggagtctcatttttatcctgagcatagtttatccacatggcaatatctggtatattccattgtcagagtagtcacattatcttgtgcttataaaaattaaagtctctattatgtgtttgtattataattacctaattaaatagttttattattccttttagaggagacctacatttgagtgagaggctctgttttcatgcaaaattcaaggggtcactgctctgttttcaaagaacaggcaagctctaggaccgtctactccatgggttctgtgctcagtaaggtccctgtcccaagaatcccagattttaggggaattctacgccactcaacccaatctggacatagagtccatctcagtgtacagaccactgccagatttcttaagtcattcttctttctttccgtcaggtttggtcataattgtacttacgtttactgtgagttaactgagatttcaaaatccttttcaatatttcatattgatttgcaggtaacgactaaatctctaatagaaagagtcctgacacttagattcctgtcacattagagaaaaatctattttttaccaagtttcactttcaacatattctactagttcaagtcataaattgtcaaggaagaaaaaaggcccatgtgatttgttctcttggagcgcgcatgtcccttttcccaactaactcagaggttctcatcctggctgcatatgaaactcatttgagagggcttctaaaaattaccagtgtccagcctccaggttctaccacaggccaagcaacttagaatgtctcagggtaaggcctaggaggatttaaatgtgcacccaagagtgagaaccactgaattacagaatttctaatgctgtccaccaccagagtttatttgtgcagccagtgcaagttgagcaccacttatctagaatggaagtgtcttaagggaaggccctatattttatctgttttcccagtgcctagcaaagggcttggaccctggtaggtgctcagcctcatatgtggaagataacagctattcgaagcaattcaatttgtgtcaaacaccttatgtcattgccagaaacatcaacacagttccaactacatttcatttaaaagatactgcccccctcgcccaccccacacaaccacgatacacacacaaattctaaatgtcatcctgggagttgcaaagtgcttctttgaaatcttatttgtgctgcttctgtgtatccatacttaaagtatcttgacacgagccactgtctttttgtgcttgaaattgtctttaacatattttactttgacattagtatttactaggtttttgttcatatatctcttttctaaagctctgggagaaagagaggcagaacaatcatatctgccaaatggaaagaagactttaaaatatatatatagctagaaactttcacctagagaatcaatctctatccatttatacatagtcaatcataactgccactgtggccttcctttgtttccccttcctacctaccatgcatatacacctgctcacagaagcattgttgggccagtatttgagacttgaggtgcccagaattgtatcattctgctattgagcagcatagaatactctattttgggggagaaagaatatgtgaaataaacagagcaaatatgcaaggtaatttagtttaaaataaatgctacagtagtcataagaggcaagaattttctcaagttttaatagagggagcagataccttgactctactataatagaactaagatgggcatagaggcctgggaaggcatcttggataagtggaaagcaagatcatgggtgtggagctagaaatgaggtggatatttgggaaaagtttgtctcaaatataatggtagttgtgtccgtttaatctacttgttggggtttggagacttcttatttggaaggagcagtgatcatgatgcagcctaaggtccacttgaaccactcctttctgttttgagaaacaaagataccaaccaccagtgaaaataagatgctttgaatactcaagagaaactcattctcagcctgacctgcaatgtggtagagatgcttggggagagtgctgggttatgccctgttaaacagttgtagacatctcgacgccataagaaatcattttcctggaccagattgattgctttcagctgatagagtatagttttattggttcctactcattttgccattttatatttttatagacttgtcagttttcttgtcttcctttctacaataacatttatccagtagtatatcaaccttaaaatttgattgttggcatattcagtaatgggaatttagaaatccactttttattgatgtcctagaagtttgtatgcaaggaagaatcattaagcttgtcctttgatgatggacaaaatctagtaattagtatttttttttcatttttaattgtcaactggcttttaaactttagatctttttttctccttgttcttttcactatgctctaaaacaatagctaatctcagcttctatgaaattgatctttatttaaaactaagaatgtttagtcaaatgtggtaatgggttccttaaaggcacttatacatgattttgtggttttacttaggcatttaggtgatgctgcatataatttgtattaaagagaggccattagcaaacatatatagacttccttcatagatttcaaaaaaccattacccaaataaatgtatttttggtatttaaatattcctaccaagagttttctttgcagagttttaatcaatatgattttgtattcctcctcttttatcctttctacttgttgttatcacagtgatagaaaaaaaatgaggaagtaaaactccaatttagattttgttcctacccccaaaatagctaaaaagttgatggagagaatgttaaaattattagttaaaatgagactgtgagagtatctgtggaaaggaaaacgttaaggggtgatcaaactgttagaaaaggagggatggtttccttcagagaacaagaagatcatatgagaacaagattgaattactcaaataagtgaaatataccctcactttgttttcaagcttataggccacattaagaacatttctgtattatacaaaatgggtgcaacatttatcccttgctataaccatcaaaataacctgtgttgagtgctttgctctagcagtctaacagaaatatctgacatccttaaatctgcaactcaacaggctaaaagaccggaaaatagatttctgcattaccagtcaaacactcagaaccataatcaaactttccctttctgttattttactggtttttcttaaaatgtcaggaagtatgattagcttcacaaatcttaaactattcagtttctctactctcctcccaatacttgtaaggaacttagagtgttttaactttgatctcccaattactacataccaaattattgtctgtcagtatttagttctaccttacttccacaattcctccattagccattatttcttttaatatttacagttagtgtttatttaaattcactagcaacttctttgcttgccgtttttttcttacatcctactccatgccttttgtttaaactacagtgtatccttttagtgaagtttttataagcaatgaactctctcagttttatttttttctgagattgaaatttcactttcactggtttaatgatgggttagctggatggagatatctcagtccccaccaacaacctcagtactttaaaaatactactccatttggtgctgatgagaagtctattaatacaagtttgccagggggataaatcatggaagagagaaaggaaacactttatatccaaaggctcagagattcaagagagtctaggtgcctggggacgaccatatcaatagctcctgtcaagtggaatgctataaacatcaaaggaataggtaatcctctgccctggcctcttgcacaggcacttgtgccctcaacacactgagctccccactttcccatgcaagtttcctgatgattacaaagagatgcaggacctatgggcttagggtctgtgacagaactaccaggcttgggtaaagttccagcaaacagccccaccgtgcgcttcatcatttcataaatgcgtatcagtccagatgctaaattctgaaactggagaggaaagaggaataaccaacttaaaaaaacaaaagcagttctagcatgccttttagcacatacttactgattatgtgccagaaaatatgctgaggatacagcagtgcacagaccacatccctattcatgtgtatcttatgtgccaaagtgaggagacagaataaatgtggaagccaatatacacctaatgtctaaaagtcatcaatgttctaaagaaacacagcaaggtgagtggacagggaataattggagagcacttctttacttaaggtggggtcgagttggtattaagaatgagacccaaatgataagaaggggctagcctcatcaaggaaagaggttaatgagtgatccaggccaagggcagaggaattgcaaagcctctatggcagggacatgttgattatgttcaaagggcagaaaaaaagcagtgaactaggggaagagtcagaggagataaggccagggaagtggccaggggtaatgtcatataaagccttgtaggccatgccaaggggtttgggttttcttctgcatgacatgggaagccattggacagttttaagtgagaggcaacacaatcagatttcagtttttaaaggcttgctctgatgattatatgaataattgagtagaaggggctgaaaatgcagaaggggagatatattgggaagctattagaatctagcagaggagtagtggcatcttggactagggttgtggctgtgaggatgatgagagtgatcagatttgggacctgtttttgacatagagctcatgggaactgctggtggattggaattgagggtgtgtgggaaggagagatacccagattctctactgtgttcctggatagtaccttttattgagatggagaagattaagagaaggaacagaggtggaaggatgagtataaagagttgcagttttgagggatggagggatgagaatggagatactgtgtaagaatggtttgttgaggagtttggacatgatcctgtctggatccctgagttagtggagttttagacattagtaagtgacatggtcagcttatggtatgtaaatgcagctgagagtccagtgggagcctcaaaatattgactggtgctcttgaatcacattacattttcaattagtaaaaagaacctgactgacttaccaggcctggtaggacatctcatcatttttagctttaattctccttccttttctcttctcccattttttttatctccaaaaccgagctcctttcatgagaataaacccagggcatatgcacatatactcacacgcatagacacttacatattcatatacgtacataactgtgctatttctaattttctgaccaaaaatgagtgacctcacttagggaggtggactagctagttgtctgcttcatgcttctaattgcaggcaatttcttgagggcggtgggaactagttatccatttattaattaccttaagaaaagctaaaaatattctttttggggtaaatacactgcatagaaggttcttttttggagaaatccaagatggagggcatcctgagctggtatcattcagttcattcttgtcttggcccatcatgtacatagttttgaaacttctttctctaattctggcagcttcctggtttgagatccagaaagcttttctgggtatgtgtatcgtggaccaagtagcctcagtttctcatgaaatcttgcaagcatttcaagaatgtcaactttggcaagcattctccccaagaaatggagagaattgtgccgatatggctggctttttgtgctaaggaaagggatgataaagtgaccttacccagcacctggaaggatgccccatgggatatgagtgcagggtatagtctggacagggtgctatgctgcacatgacagggggattgtaattggcttaacaaccatgacattgaaatttgtatttaaatacaagcttccatttccccatgtttctcctactcatgcatatcaaccttagcctatagccagtaactgttgagtttctacatgttcttataacccaacccccccaaaaaacacaagctttttttctcatctgagtctttccaatatgcaagccaaagcagcaactgacttagccttgaataaaagactaaataaaagctagagaacctgagaaaacatgagagacacagcattgaatctggtttctaattccatggacttgacggctggaatcgtgatggagcagggaggggaggccagtcccaccagtgtgaaagtaaacaccagaaagatttttcctcagtaaaaggagatgttccaagcattttagtgtgacaacctccttctgagcctttgataggggcatagaagagagaataagagagaagagaagggaggcaacaataaatcaccaaagagcttttgtcaattatttctccctcaaactgccaattgcacaggaaaggcagatgacgcaaattctctcctttccatctataaaattgctctaatattttatgaagatgttaaaagaaatgattctcttttttatcctctccctctcacgaatctcccccttcccaacaaacttggggcatttaatcacctctcaatattatttaaaccttctatgaaaaaaaatctatgaatgcttcaaaatagtaaaaggacacagaggggaaaaaagggagtctggacacattgactgaaggtgaaataattctttgtgtttctttttcaaagaactgggacataaagtgggtgctgggcctttcatggtccttgcacttacatgtttgcctcagtgagtgagtagaaggaaatgagacaaaagcatccattgaatccacatataccaagcgtctacttagcacgtggtaaattgcctggcctggcccccactagatgttcaagaaatatttatgaaccaactacttttagctttgaccctgtactagtcactgatgacgcataagtaaataatataggtagtgcttgcactcaaacaactcatacattttaggtagttaaagggtgtgcaatggaatgctgttcataccccctccctttctcctgcttgtttgcagctctactaggaagtcataatttgtattgttgttgttaatgtcagaggatgcatttttaaatagaagagcaaatatgcctcttgtagcgggagaaagatcccatggcatttatttaggcaagtgggatttaacttcagaggcagctgatgttctgtctaagctttgtacatgtggtgtgatttgtcagcagtgctactgaaagcctgagagggtgttccctgatccatgaggtgtttgtgagagtcctatgaatatttgacctcatcaagataaaacaaaggtatgggcttttgggttcctttatcacagagataataattctgattcagatctgaatctggaccagtgcccaggctgtgaagtgcattcttatgacaaattgccatggctgatcatgcaagccctagatgtggtgtgagggctgagactcatcaacctcatagtagtttggtggtgtgaactctttggttctgtgcctgctgtgctcagcttaatcagcaagtgtgcccagcctcagacggacccttaaagtcttccagatccaacacgatggaaatagtgctggcccagcagacagagatatgacaagtgtgtagcatctgctgtggctggctctgcttccctgatgcttcactggtaggtttttcttctagattctcaacaactctacctgatgtcatgtggccttagaacttgctcacataattgttcatagcagttagtgatcaacagaatgtgaaccattccaagactgagatccatattcacttagccaagcaaggctgaatagagtcccaggcccttccaatatgcaagccaaaggagcaacagacttagccttgaataaagaaaaaaaaaactgaaaataagctgggcgtggtggctcacctctgtaatcccagcactttcgtaggccaaagcgggcagatcacttgagcccaggaattggagaccagcctgggcaacatggcgaaaccccatctctacaaaaaatacaaaaattagctgggcatggtagtgtgcacctgtagtcccagctactctggaggctgaggtggaagaatgtcttgagcctgggaggcggaggttgcagtgagccaagatcataccactgcaccccagcctaggtgacagagccagaccctgtctcaaggtgcattttctgtcttgcctctgaagtggccccaacatgtacatgctacacgtcccgtgttcccacccccggaactttagactggatccaggatttaggtgctcaccgtcatctgccatcatctacgtgatctcattacttttctgtcaaatatgccatagctactgcagtggtgtcctgagggataggtagggcacattcagacagagtggcacaggtaaggttgagggaggcattccaggaaggaggaatggcatgtaaaagtgtcagatgtcgaagggcaattattttcccatttaacaaacaaggacactgatgtttagagaagttagacatcctgcttaagttaacatagctaaaagcacagccaagattcaagctcaagtctgcctaactccaaagcctgtttatttgtacatatgctgtcttatgaaggatagggtgaggagtttggatatatcttataagaagtcgggagccattgaatggttagagaggagacttagatgatgaaatcaatgttttatgaagattaatttggcggccatgtgcaggatggattaggaaagtgagaggctagaatagagactggttggtgaaagaaaagtataggtgaaaatgatttatgactcattattgtgtactgagctattgatatttaattcccctatcatagtatttatctcaagtatattttttaacttttattttaaattgacaagtagtattggtacatatttatggggtacaatgtgacgttttgagatataaataaaaatatatatacacacacacacaaattgtggaatgattaatcaagctaattaacatatccatcatctcatatacttaccatttttatagtgagaatatttgaaatttactattagcaattgtgaaaagtacactacattattattatagtcagcatgctgtgcaataaatctcacaaatgtattcctcctaattgaaatgctgtaccctttaatctttgtaccctttgagcccaggagttcaagaccttcttccatccccaacctctgataattcttctctctatttctatgagttcaacattttaaaatttcacatgtatgtgatatcatgcagtatttgaccttgtgtgcctggcttatttcacttagcctaagtttttcaggttcatgaatgttgtagcatgtgataaaatttccttatattttgtggctgaatagtattccactgtgtatatatgtcacattttcttcatctattcatccattgatggacattcattgactccttatcttgcctattgtgaataaaactgcaatgaacttgggactgaagatatcttttcaacatactaattttatttcctttggatatatacccgtgtgaaattgctggatcatatggtagtactatttttagtttctcaggtacctccatactatttttcattatggctgtaccaatgtacattcccactaacactgtacaaatctcttatctatgtgataatgaccatcctaacagatgtgaggtgattacctcattatggttttgatttgttgaataccttttcatatacttattggccaattttatgtctcctttgggaaaatgtctatttgaatcctttgcccattttttaattagatgatttggggtttccttttttgtttgtatgaattccctatacattttagatattaacccatcagataaaagtgtcctcacccttcctcccaacacacacatacatggtaactgtggatggtgatggatgtgctgatttgattggtgtaataattacaccatgtatacatatatcacatcatcaagttgtacaccttgaatatatcctgtttcatttgtcaagtatacatcaataaagctggaaaaaataggttgtcaagtaagggagcccaagaaaagtatcaggtatatttacagagccaaatcaggtgtttcacattcccagtatggatgtgtagcatgtttatactctgggttacatttattgatttgcgtatgttgaacctgccttgtatccgagggaagaagcccactcgatcatggtggataagcatttgatgtgctgctggattcggtttgccagtattttattgaggatttttgcatcagtgttcatcagggatattggtctaaaattctctttttttgttgtgtctctgccaggctttggtatcaggatgttgctggcctcataaaatgagttagggaggattccctctttttctattgattggaatagtttcagaaggaatggtaccagctcctccttgtacctctggtagaattcggctgtgaatccatctggtcctggacttttttttttggttggtaggctattaattattgcttcagtttcagaacctgttattggtctattcagggattcaacttcttcctggtttagtcttgggatggtgtatgtgtccaggaatttatccatttcttctggattttctagtttatttgcatagagttgtttatagtattctctgatcatagtttgtatttctgtgggattggtggttatatcccctttatcattttttattgcatctattggatttttctctcttttcttctttattagtcttgctagcggtctatcaattttgttgatcttttcaaaaaaccagctccttgattcattgattttttttgaagggttttttgtgtctctatctccttcagttctgctctgatcttagttatttcttgccttctgctagcttttgaatgtgtttgctcttgcttctctagttctttccattgtgatggaaagagaagatactacaggtcctttagtctttcctccgaatcccccgagacccggggcattttgaaatagagaacacttttgtgtattagaatggtaaaaaagttggattaataaagacagtaagtttcctcctggcagttcagataaaattttgctgcccaataagtccattcggctcatataataccacagaaatatgtcttttctatgtagaactttttggagtttggaattactaataacctcgtaaggtatggtagacctgtattataccaataataatgaatgtaaacatcatgaatagaaaaatatgagctctctgcttggctcattcagatcatgactctgattagtgcattgaggagcattttgtggacaggctggagtcagcattacaattgtgagtctgtttacccataatagctcctatttttgagcaatatgtgggtgtctatgctgggcactatacaaggtggctcaccttacaggttgcacaagtaattcagacttatttcacgttatccacctagtgaagtgttaccaatataggcttcaggtgaagcttttctctaatacctgtttttttttccttacccttaagtgattgatgacatgaaatcattctcggacaaaaagctcaactccttgcaggaggcagcatagcagggtgaaggaagcatctgagtggtcatacctgacttgtcatttattaggtgactcttgggcaagtcatttcatctctctaggcatcagcttccctatctttaaaatgggggtggtaatcccttccgagcccacctgacaagagagctgtgaggattttgatagataataaataaacgtgagggcaccttgtaatctccgaggcaccacttcaacataaggtggaaaaattataagcgcaaggacaagcctcgtgtatcaatttgctatgaggcaaatggccaaaatggagtgagaaggatatctcaaaaagcaaaggatctgggtgtgggtacagggtgaagggaagatagatgtcaccagggaaagccagtcactcataccatctgaccttttcagccttctcagttacctccgaggtccttctcatatccctgggagtctcttaattgtcccctttctcttctaatccctgtgcttcaaatgttgcatggattttttgagctgcctcggtagctaccttttgtagtctgctttgtagcttcttacaacatcaccttcatcttcctctctctccctccctccctccctttctgcccacccccctttgcttcctccccacttgtatctatgtattcctgggtcttggtgggtagtcactaaatattggatgggtgcattcttagggcactttaaaccttagaggagacaaacattcatgtagctaagtatgtctaccacccatatatgctccccttgaattctcaactaggttctctagaacccactatatatgagcccccatctcctcttcctggcattcgagggctcatctaaatcagccaaacttataactagaggctccccactaagcaccagctattcttggcagcctgatccctggtcactcctttggaggcttctactcattcccactcccagacctctatattagctcaagttgtttccccatctgaaacactctgcctcctctgcttcacttattgttaagaatcctttagcccttacctcctgcaaaaaaccttcattgacacagtttatacagatcttgtctgtatattacttgtctctgctgaccttctgtagcactttaccctctgtaccactaattccctacttaatctttctctgcttcttgtgatatacatatatgtattgctagtatgaattgtttgctttgtgtcagacactgtacttaatattttacatcaataacacaacttaatccctaccattcagtgttatccatttgcccattttataaggttcagaggggttgagtaactttcccaaggacacatggtttgtaggtggtgaaactgaggtttaaactcagttattgtatgaattcagcactgtataactaccacatatttgggtaataatctctgccctaaaagtgcttgcactctagatgggaagataagacttggacatcaactcttatttccctgttatagactgtattagtcagggttctcttagagggacagaactagtaggagataatacacacacacacacacacacacacacacacatatgtatatatagagagagagacagagattggagtttaagtattaacttacacgatcacaagatctcacaataggccatctgcaagctggggagcaaggagagtcagtccgagtcccaaaactgaagaacttcgagttagatgtttgggggcaggaagcatccagcacggaagaaagagggaagctaggcctgtctctccttttcatgtttttctgcctgctttatattcgctggcagctgattagattgtgcataccagattaagggtggaactgccttccccagcccactgacttaaatgttaatctcttttggcaacaccctcacagacacacccaggatcaatactttgtatccttcaattcaatcaagttgacacgcagaattaaccatcacatggactgaatgtgtttctgacaaattcatacatttcatgcattgaggtcctaacctctaacgtgaaggtgttaggaggtggggcctttgggaggtaattaggcttagatgagttcatgaggggtgagccccagtgatgggattagtgttcttataagaagagaaaccagagcttcctctcttcacaacatgaggatacagaaataaggtggccatctgaaccaggaagtgagccctcaccagaagccgaacatgctgacaccctgactttggatattcagcctccagaactgtgaggaacaatttttttttctgttttttgagtcggagtcccactctgttgcccaggctggaatgcagtggcgcaatctcggctcactgcaagctccgcctcccgagttcacggcattctcctgcctcagcctccggagtagctggaactacaggtgcccgacaccacaaatttttttgtatttttagtagagacggggtttcaccgtgttagccaggatggtctcgatctcctgacctcgtgatctgctcacctcagcctcccaaagtgctgggattacaggcgtgagccaccgctcccggccacaaatgtttttttaagccactcagtctatggtattttattatagcagctccagctaagacatgcctctccattttgtatcaagttgcacacattaacagaaatgacaacagcaataataccaatcacagaaacatacatccattgaaggatctccccttaggaccttagaatggacctaggaacttgttttatgctcagtatttgtgagttgatcccaaagcccaattgattggttaataagtgaggggctgctgaaccttagtaaaggctagcatagtgtatcttagtttggcacatggtaagggtactgaaagcattcctgaaatggtgtatttcaacaccagactgagtgagtaagcaaaaagaatgctaaaacttcttcaagtggcttaagctctctgtactttaattatcagtaaaataagaataataatagtaccttcctcacaaggttattatggggaataagtgaattaatgtatgtacaatactcaatacctggcaaagagaaagacctatttttttttgtcattggtatcattgctgttgccattgctgttaatgtgtgcaacttggtacaaaatggagagggctagtgttaataatgacaccaatgattcatatatctcaaggaaagagaagcactatcactatcttatatgtaactcggcactgtacttgccacataacaggtactacaaaaatatttgtagaatgaaaaagtcatggaatgatgtcaaaccctcacagtgctcaagtatctacatagaaaaagttcaggccgggcgtggtggctcacacctgtaatcctagcactttgggaggctgaggcaggtggatcacctgaggtcaggagtttgagaccagcctcaccaacatggtgaaaccatatctctaccaaaaatacaaaaattagctgggtgtggtggcaggtgcctgtaatcccagctacttgggaggccgaggcaggagaatcgcttgaacccgggaggtggaggttgcagtgagccaagactgtaccactgaactccagcctgggcgatagagtaagactgcatctcaaaaaaaaaaaaaagttcaaaagggagaggttgggtaacatattcctctcatgttaaaatgaatgggtttccaatatacactaacatctagcctctctctccattctgagctccgaaagcccgatttctggctcagtagtgcttattgcttccttttcatggcagacttttctctgttctagccttgatatacagttctaaacaaggatgccaccgtaataactctttgctctggcatatgaatgagaatgatttttcatggagctctctccatgcctgctgcttagagttatttgtcatttcttttatgggccatttcaagagagccaggctatgggatgggttgtgaaagccacctgtgttgtcttctctaagacaccagggagatttgatgggttttcattttctaagattctaaggagatgtttttatcttggacagactgcctgttgttacccttggggtttgccatggtgacaccaaatcaaaggatttttatttgcttgaaaggaaaaacaatcaaatattcttgctgggaggtctttttagtacatctggtccaaattcccatctaagggtggggaccatgtttgccttatttccttttgtatctctagtgcacatcactgtgcttggcatagagttgttatgcaacagacatgtgttgattacataaatattttgcagagggaagaaatgctttgtgttactagcctatttggatttggccattctcttctgtagttcagcaaagaaggccttttctctccccctacaccccaaccctggattatcctgctctcttctgcaccaacagacatactttgtatccaccattagagcactcacgatactgtgatatttgttttcgcctgtctttctgttcccactcctattcctggggctctgtgtctgacagtgctgagcacatggacatggttggtgctcaaaaaatattagttgaatgaatgattctaatgcccatggaagacagcaaaaataattacagtgtcatgcatcatatttatattgcactaaggacttcttgtggacaaagatatcagaagaatgatggcattcatgagattgctgctaacagaatggttgacgatagagtttcttcatttggaacgtaggcatgataatactgaattgcaggaaggttgtagagattcagcaggaagatcttttaaagggtgctgctgactcatgacttttatggtagcaggtggaatttttttttttttctttttcttggtcctatgagcaggtagaaggaagaagaaggaaaaatggcagtaacttgggaagcaagcaaagacaacacctcttctctctcctcacctccatcccctccccgccacccttgataagccaaaaggagtgctaaatgtcagctgccaaccttagggagcctgagaatcaccatcacagataaagacctggtgagcatgggtcttagaagacccaacagtagagcactaagccaggttccatgctaagctatagatataggtggctgggggctcaaatcctagaagtagaagagatagtgagagtccaaagacaagaaagttagtctcttgggatcataatgaaacagatgggtgctcacaaagactgaggtggagttctggccttctcaatttcagtatctgagaatattttatagtgcatttttcctgataaataataggacttgcaaagtgatattcccaagagcattggaatggaatgatacaactcaatggcgtattattattgatgtaggttagcaaatggccaaggttaacaaatgtagattagcaaatggccaaggcacaaaaaatagagtggtgagcaaggtagacatgggccctgccctgacagtctttatagtctagtaggaagaatgaaacaaccatacaaatgtaacataattcaagttccatgaaggagatatgggaaaaactataacggcaggagaagctctgaggagagaaagggccttttgagctgagaactgatggatgaataggtattaaactagaagggagaagaaggaggagagaaatcatgagagacattctattaggcagaggaagccaacataaaaaggcagtcacatttaagtgggataaatgctagggaaggaaaagagaggttactacaggagccactgctcagtctttaaataaccttgacagggaggcagggtaactatcatcatccccttgaatgcataagttgggactcagacatattgatttatttaatttatttaatgagtcattgtcaagcccctactagtttcaaatcattgtgctggggctggatgaacacatttatatattgtctctcccctctaggagctttcattctagtggggaagtagcgggagtttatctgtgtcacaatgctggtaagtggtagggccaaaacttgaagtcttttgacttcaagtccagtgctcttttcatggtgtcacattgcagctcaacaaggaagaggcctggttagttacatccatgatgacttggccggatgaggtagcttagcttttgttctaatagctgataaggatttccatagtgctaacttagcacggtgggaacttgattctattaaagtaaaattgaaacaaaaacagaatttgggtatagctcatctgtgtgacaatcatagctagcccttctggagtttgctgtgagctagacattgtacacatttcatatatttatttaatcctaataacaatcctataagtgaggtaaatacttgtactgatttgcccactttccgaatgagaatgctgagactcagggagataattatgcagcattattaagcttgctcagttagtaatttagggttataggatgcaaactcattcaatctgatgccacaacccatgatcttaaccaccatgcaacattggatctacttgccagactagaacaaagtagatgacactatcccagagacaaaggagcagtctgggataaaggccaaagtttgctcttcctggcaggactcccagtcatagttgtttaacaggtacaaaagcacaggactggacttaaaagtgactattgaatccaggtttcctaccatcgtatccatagtactttgtggtcataatttacaaggactttatatctgcctagtgtggtggagtttttttttccaagtaattaaaactatgaaacacaacgcttatacttgctgaattttagaggcctactgagaggccagatttacctcaaaccatgtgtattattgtttacagagtactttcacatccatgatctcatgagatgctcacaacaaccctgaggagggttattcacattttatagctgagaaaacaaagctgagaaagcccaaggtcatgaaactactaaggttttggagccattgctgtgcacctttactatgggaaatgggtgaaatctaccagagcttgcaattctgtttttgtgtcccaattgaaatgaatcagttagtaaaacatttggcttttcaaaatactaggatttctttttcattccagattcaaaagactgactccgtaagtattgactttgttcataaaacactgtattataaataggaatacaaaagtagcatgcattattttctaggtttcaaaataaatagtacataatggatgtctttagttaataaaagctacttggatttctgttcagatgcagctcattggggtgggggtaggggctttggtcttttttagaatgtagaacgcaccttcattccatttgaatgtcatttttgcacttcgtaagtgaaagtacattctttcttatagtgccttgtccctcatgaccggcagaattggtagctttaagtattttcattctcaaaacaaacatgactcataacccatgtggatgcaatgactgtacttgatttggtgaacatttgaaaatacgaagtgggaataaacaataccattaccgtagttatttttttaaagggaaacgaatgcactggaagtggtgtagatgaagtacagggaaatatatgaacattggaattatattccagttagctcaagcttagggtagaagaaattaaaattaaggaaatatttattcatctatttaacacatatttaatgaacaaggcattgctctagacactggagatacattggtgaagaataataataaagatgaaaattcatgccctgttggagttaacattcaagaggggccgtaatgggtggtagtattggcggggggggttagagaagccctcatggagaagatgacatctgaataatgaactaaaggagttaagggaggatgtaacgcagatacatgctcacagagagctccaagcagagaccttgcaatgatgatatactccaatgtggctgaagtagagtgagcaagacagagaataatgggagatgaagtcaaagaagtggccaggagttggctgacccatggaaagaagtttacaaagtaactggtgatattcaactgtgtagtggacactgttgatcccctttaccaggcagaggtacctatcccttagctacttggagcgttgtttgctaaagcttatagtcacccccttctctatagcagaagcactgggggcagcccacagccaatgactggctcaaccccttggcctcaaggtgagaccaatcctatggttccattcatggtcctgagcttctcctggggtcagttagagctagactccaggtgagaccacagccttgcttttttagttccttcatttccccttccttcttaatcccattctaccccaaataatccatctcaggatctgcttctacctaaggaacctgacctaaaacaacaaactttcaacaacataattttagaagctaatatgctgtatttttctctgcaagtgtcaactttgagttatattttattaaactaggcaccctgatggtaaggcagatcattcttgccagtctaaaggagctaggaaagatatttttgaactagatggctaatggtgccattttcgacatctgtgaatgtctttctaattctgtcactcagtaaaggggagcattttaactagggtctcaatggcatggtgttgcagcgattgattcatttttacattgataagtgaatccacaggaaggtcccattagatgcctccttttagttatttgaaatcctagtcaataaatatcgacttccttcctgtcctcttgcaattgtgtgtgtgaatgtagtatttgtccttttctgagataccctagtgctttatgtcactttgtctttacgtcatttaattgatgatatttctcaataatagccaaccaggagccaagacaataaaaagatattccttgtatcaactttaagaaggggaaataagctgtggctggaaaatctgaactaatctcaataataccaagtaacaaatttgacttttctccacttctcactagtttgggcaaatggactttgttattggggacaaggtttagagaacaaatactttgggtaacaggtgtctgcttataagtatgaactttagcaagcagtgtgagaaaattccaacaggaggccctctcccttgcatgggctctgaatgagcaaatccaagattgggaaaagctgctccaactctttgaggttctccactacccatctttggcatgtgatttgaccatggtcctgaggacatttgattctccctttcacaaaaccacttctaaggtataagaccagggaaactcatattgtataatatactccttttgtctggctctctatttctccaacacctgtagtagtccaaatggtgtgaattgccctgtctcttgccttaattaatactatcctgtgaattaggaaatggagtcacaattttttccagtttgcagatgaagaaataaagactcagagatttaagtgacttacccaagatcacaaagctagcaagtggctaagtcagaaatagaccccacgtcttctaactgctatacccttctggagaaagtgtcagggaaagataatgacttattttttagcattttgcttgttaatatgatcattttacttcttctttgtgtggggatgccaatgaatttccatttattcaagccaaatctttgttttctccaaataatttgctgaggtagtgctcttctcattaaagccccctgaagattggctgtgattcccacagagtggttctgtgagctctgatattctggattgtggctgtattattcctggatctcattttacattgcttttcatcagatgtaagacacctatttctttgtctatctctgttatctgctagcatatttgccaccttctttttattgtcttggctcctggttgactattattgagacatatcatcaattaatcccatacaccattgtatgagattttcagtaaccatgactctatacctccgcttcgtggtggcatgccttccatccccttaaagtgattgatcttccctccattagcctgtgcttgctcttctaaattcaaacttggtatcccagtttggacatgagctcaccttatgacctgaagaaaagctttcttttatgaggtaggatcacatgtactcgtctctggtcctctacccaatatctaattcccatatgttggctaagatgctgctgtatacaattctggctgacagagatgaagttgggctttacctccaaatcagaggcgattacttctgcaatctcaggaatagagaggaaatgttcacactaggctgaatttatttgtttggtgcatggaaaagttgcagtgaaatgagtgctgacactgcagcagaaaacttctttgttgaagctgatgcaaggcttggacagctgatgccaaagatgacaacactgtaatttgcttgatccatgtgtctgtgcttcttctttacatcatatctacttctgtgcctgacagtattccataggccagtggtggctgccactatcctagaggcagagaggatagacaagttttggggggcaggtttctctatcttttctcctagcctcaaagcctgtgatctagggcagaggttttcaaacctctgggatgaagagggaggcttgagggagggaaggggaaggaggaaatctagcagggattcctctttaacccttcctcaaacaagtttatgtattgagtttccatgcaagagtttgtttgaacaaagggttcggctgttgaagaaagtttgggaatcactggtctactgcactaaacaggttaacttctgtactgaaaccagcccaactgagtcctacaaaatgagagctgaggctaacagctagtttaccctggatggcttgagtttcctgaggtgtaaaatgaaaccatgcttcccttgatgtaacagcttacatagtggggagctaaaggttttgttggttatcctgaataatttggggctcctttgaggatggatgatagaagaaagttaattattttgagaaagttatttgattccaacctgataatgccaaacttcttctcataaaatgactgttaaatagaatcacgctgtacatcaactagacctaacaggcatatatagaacactccatccaacaacagcagaataaacattttttctcaagtgcacatggaaagttatctaggatagaccatatgttaggttacaaaataagtctcagaagtttaaaaaagatctaagtcatccaaagtatcttctccaaccacaatagaatgaaactagaaatcaataatagaaggaaacctggaaaattcaggaattttgaacaaccaatagccaaaacagaaatcacaatagaaattagaaaatacattgagattaatgaaaacacagagccacataccaaaacttatgggatatagcaaagggactactcagagtgaaattaaaactgtaaatacctaaattaagaaagaataaagatatcaaatcaataacctaactttacaccttgagaaactatagaaagaagaactaactagacataaagcaagcagaggaaggaaataataaagattagagcagagatttttgaaatagagaatagagaaaaacaatatggagaatcaatgaaatcagaagttggtcgtttgaaaagatcagaacaattgagaaaactttgtttagattgacaaagaacagagaagatacaaataacaaaaatgagaatgtaagtggagacattactaccaaccttacagaaatataaatataaagaggataatataaacaactatatacaaacaaatcagataacctagacaaaatgttcaaacttttagaaacacacaatctgccaagactgaatgatgaagaaacagaatatctaaatagactgacaacaagtaaggagatggaatccgtaatttgaaactacccaataaagagtccaggaccagatgactctgctagtgaattctaccaaacatttaaagaagaattaacaatgatcctgctcaaacacttccataacatagaagagaagggaacacttcctaattcattcactgaggccaagattaccctgctacaaaattggagaggaagaataaaactgttttttttgcatgtgacataatactatgtacagaaaatcccaaggaatccacaagaaagctactagagataataaacaaatagagcaaaattgcagggtgcaaaaacaacatgtaaatttggttgtatctctaaacaccaataatgaaaaatccgaaaaggaaattaagacaacagttccatttattataacatctaaaagaataacgtacctaggaataaatttaacaaaggaggtaaaagacttgcacacactaaaaactataaaacattgctgaaagagattaataacctaaattagtggaaaggcatcctgtgttcatgaatagaaagacttaataatgttaagatgtcagtactactcaaagtgatctacagattcagtgcaatccctatcaaaattccaatagcattttttacagaaatgtaaaagctcatcctcaaaacaatatggaattacaagggcctcctatatagacccctatcatgaaaaagaagaacaaagttggaggactcacactaatagatttcaaaattttctataaagtacagtaatcaaaacagtatgatactggcataaggatatacatatagactaatagcgtagaattgaggtttcaaaaataagcctatacatctaagataaattgatttttgaaagagtgctaagtcaattcaatggagaaacagtttctttaacaggtgctgcggagtcgactggatttccacatgcaagttgaacccatatctcataccatatgcaaaaataaactcatctagtgtttggttttctgttcttgtgttagtttgctgagaatgatggtttccagcttcatccatgtccctgtaaaggacgtgaactcatccttgtttatggctgtatagtattccttagtgtatatgtgccatattttctttatccagtctatcattggtgggcatttgggttggttccaagtctttgctattgtaaatagtgccacagtaaacatacgtgtgcatgtgtccttatagcagcatgatttataatcctttgggtatatacccagtagtgggattgctgggtcaaatggtatttctgattctagatccttgaggaatggccacactgtcttccacaatggttgaactaatttacactcccatcaacagtgtaaaagcgttcctatttcttcacatcctctccagcttctgttgtttcctgactttttaacaatcgccattctaactggcatgagatggtatctcactgtggttttgatctgcatttctctaatgaccagtgatgatgagctttttttcatacgtttgttggtcacatgaatgtcttcttttaagaagtgtctgtttatatccttccaccactttttgatggggttgtttgtttttttcttgtaaatttgtttaagttatttgtgcattctggatattaaccctttgtcagatggatagactgcaaaaatgttttcccattccgtaggttgcctgttcactctgatgatagtttattttgctgtgcagaagctctttagtttaattagatcccatttgtcaatttgggctttgctgccattgcttttggtgttttagtcatgaagtctttgcccatgcctatgtgctgaatggcattgactaggtagtgggagttgaacaatgagaacacatggacacagggaagggaacatcacacactggggactgtcagggggtggggggctaggggagggatagcattaggagaaatgcctaatgtagatgacgggttgatgggtgcagcaaaccaccatggcacgtgtatacctatgtaacaaacctgcacattctgcacatgtacccccgaacttaataaaaaaattaactaacgttaaccaatatctaaatataagatctaaaaccataaaactcttagaaaacataagggtaactcttcatgaatttggatttggcagtgggttcttagatattacagcaaaagcatgagcaacggaagtaaaattggattatatcaaaattaaaaatcgttgtgtatcaaagaacattatcaagaaagtgaaaaagacaatttacacagtggatgaaaatatttgtgagttgtttatctgataaaggcttgatatatagaatatagaaagaactcctaacagtcaacaacaaaaagacaaaagaaaattgaatggacaaaggacttaaatagatatttctccaatgaagatatacaaatgtccaataagaacatgacaatatactcaatatcattaatcattagggcaaagcaaataaaaaacaaaatgagagaaaattttcgcaacctactcatgtgacaaagatgtccagaatctacaatgaactcaaacaaatgtacaagaaaaaaacaaacaaccccatcaaaaagtgggcgaaggatatgaacagacacttctcaaaagaagacatttatgcagccaaaaaaacacatgaaaaaatgctcatcatcactggccatcagagaaacgcaaataaaaaccacaatgagataccatcgcacaccagttagaatggcaatcattaaaaagtcaggaaacaacaggtgctggagaggacgtggagaaataggaacacttttacactgttggtgggactgtaaactagttcaaccattgtgaagtcagcgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtaggggcagggatgaaactggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgttaaatgacgaattaatgggtgcagcacaccaacatggcacatgtatacatatgtaacaaacctgcacattgtgcacatgtaccctaaaacttaaagtgtaatgataataaaattaaaaaaaaaatgagataccacttcacactcattagggtgtatacttttttaaaggaaaataagtgaagatgaggatgtggagaaactggaacccttatgtggtgttggtggaaatgtaaaatggtacagtcactgtggacaatagtttggcagctcttcaaattgctaaatagagactcatcatctgattcagcaattccattcccaggtgtatatacacaaaataatttaaaacagggactcaaacagatatatgtatgccaaagttcactgtagtgttactcacgattagctcaaaggtggaaacaacctgagaatccatcaatagatgaaaagataaataaaaatgtgctgtatatatgcacaatcgaatattattcaaccataaaaaggaattaagttctgatacatgctacaacatgaataaagcttgaagacattatgctaagtaaaagaagctagttaccaaaggataaatactatgtgattccacttaggcaaattcatagagataaaaagtagattttatgctactaggggctgggggaagagaaggatagaaagttgttgtttaatggttacagaatttgtttgtggtgatgaaaagattttcgaaatagtggtgatggcttcatagcatggtgattataatctatgccactgaattgtacacttaaaaactatttaaatggctggtttcacgctgtatatattttaccacaataaaaaattcccattaaaaataaagttattcaaaagtggtttcattatttaaaatgaagcaaaagtgttttcacgtctttttctctaatagagaaaataaagatgatcacaaatgtgtcccttctatgaataaaaatgaaatgttcattaaaaggaggcttttttcctttttttttcttcatttcttcttaaaaaaaaaacagaatacatgtgcagaacgtgcagtttgttacataggtatacgtgtgccatggtggtttgctgcacctactgacttgtcctctaagttcccgtccctcaccccccaccaccccctgacaggccctggtgtgtgttgttccccacctggtgtccatgtgttctcattgttcaactcccagttataagtgagaacaagcggtgcttggttttctgttaaaaggaagcttttatatttcatatttaaaatgactttttgatggaagaaatagtaccgacactttatttgctttacttagattctattaagaaatttttcttttgttgtatcctttctgaggtaactaagtattgagataattgtttatctttatcatggtaatctttatagaccacatagagagatccatcttaaatattctggtccatcaccatagtttgtttcttcaaacttaacactcaaagtctcaaaatgacagcacatttggggctagtaaactctctgccagtgaatgcttagaggacgtagcataggtagctcagtatctcacaaggcctacggctgtgctcttttctggaggtcagcatcctcttctaagctcatgtgattgttggcagacttcagttgtttgtggcaataggaccaacatccccatttattgctggctgtcacacagggcctattccgagctcctagagacttcccaaagtcccttgccatgtggccccctcgtaggcctgctcacatggcagcttacttttttaaggcctgaaggtaaatctctcttttaatgctttcacttgattaagtcagacccacccagattagtgtgccttttgatgaactcaaaatcaactgatcaggggcatgaattacatcttaaaaatcactttacctttactatattctattggctaaaagcatatcagaggttctgcctacattttaaggtgagagggttatacaagggtgtaatccattgggcatcattctagggtgtgtccaccacaatgtggaactatcaccctgtattgttgagagatggaaagaagagaactgatttttacaatgaaaaaccaaagcagccatgtcaaacttggtaaaagaaatgggcaagtggtccctttatgtgtttcagcttcccatagtgtgcgtttgcttcaatcagggttctccagagaaacagaaccaataaagtgtgtgtgtgtgtgtgtgtgtgtgtgtgtgtgtgtgtacaagccgatagggagataataataaatcagactttcatggttatgcaggtatgcaagtcccaagatctgcaaggttagtcaacaagctagagatgcagaagagctgatttatatatctaatccaagtccaaacgcctgagaaccgggagagctgatgatgtaattctagtccattggctggcagtgctgagacacaggaagtgccagtgtttcagcttaagtttgaaggcaagagaaaagctgatgactcagttcaaaggtcaccaggcatgaagaattatttcttacttaggagaggatcagtcctcttgttctattcaggccttcaactgattgggtgaggcccacccacattatggagagtaatctgctttactcagtctaccgattaagaaaaaaaacactcataggcatacctagaataatgtttgaccaactatctgggcaccacatggcccagtcaagttaacacataaaattagccatcacattgtccttcagtaatcgcatgtcatttcccctaacaagtgacactaattcagttattatgacaaatggactcaaccagtttctgctattccaataaaccagtcaaggatgagtggcctccatcaggctgtttcctgcatctgttgctggagtacattacaggtgtggttacaaggttttaagctgtgtgtctccagtgaactgctggactgctgggagaagagaagtaagctgcactttctttcttttcttttctgtttttttttttttttttgagacagagtctcgctctgtcaccgaggctggagtgcagtggtgcaatcttggctcactgcaaccttcgcctcccgggttcaagtgattctcctgcctcagcctcctgagtagctgggattgcaggcacgtgccaccatacccagctaatttttagtagagacggggtttcaccatgttggtcaggctggtctcaaactcctgacctcatgatccgcccgcctcggcctcccaaagtgctgggattacaggcatgagccacctcgcccagtcacaagctgcactttctcaggagcagagaggctaatatgaagctaagtacagagagaggcccgaggctgcttgtagtttcccagctaggcatgcctattgcctcctctgtctatttgcctttgccacattctccattcattaggactgacctaagtatagatatcaaaaagagaaccaagttactcttctgctgaccaggaatttggtaaggagctcccaatgttccctgcagagaagaggaacttacagagaaatggcctgctgaaaaaggctgacaacccaaatttgcatgtaagtcagtccatgatcattgctgcttcttagatttgagtgtgacccatcctgctctcttgcccaaaacatctttttcaagcttgccataacttcacctaatgatcgctttgccagatagagacttgcgtcaagtgatgtcttgagtagcttagaatatctcatatatagtaagcttgtctttgagaggctgtcagttaaacaggtgttacaaaaagccgttggggaaaaaaaagagaagaaagaattgccctctaggcaactcttaaaggattgtgattattctgcatttcataggaactctaaaagtatctcttttaccactcagcaagtaagcatctaaattggctgggagataatttacgtggaactttttgccctgtctttcttgagtctaatcttaaattctacttaactgtccattaaggaagacgcagagagctgtccttagtatgagaattgggaaatggttttttttttttaattttactttatatatatatatatatatatttattatactttaagttctagggtatgtgtgcacgacgtgcaggtttgttacatatgtatacatgtaccatgttggtgtgctgcacccattaactcatcattttcattaggtatatctcctaatgctacccctcccccctcccccccaccccacaacaggccccggtgtgtgatgtgccccttcctgtgtccaagtgtcctcattgttcaattcccacctatgagtgagaacatgcggtgtttggttttttgtccttgccatagtttgctgagaatgatggtttccactttcatccacgtccctacaaaggacgtgaattcatccttttttatggctacatagtattccatggtgtatatgtgccacattttcttaatccagtcgggaaatggttttactctggctgacatttttgaagcttgtgaaaactggcatgtttcaatttctagaagacaccaataaacactccccaaatgaccagtttctcaacatgaatttaattaatgggaaaatcggaggcacgtcaggagagactcactgacaggggccactggaaaagacagggaggtaagatttgggaagcttgtgctgcctcccagtgtggacattactccaatgccattcaagaagaatgaattcacagctttatttcccctttgcgttagttttcctgttcccatgtatgacctacattatctttcccacgtccttattgctgctttgaaatagagattttgacagagcttcctgtgggactacaagaacttcagtcaataactagtgatttccatggcagcagaaggtttttaaattaatgtggcagtctgtaccttccatctgtgaaggaccaaaccggcactccctcacctctctctttccttctacctggtgtttttaccattcctccttccaatttttttctggccttatagtgcaggtctcctggtactgatctggaccatgaaacacaggaagccagagccaaattggccagcaaagcttcacgttttgtagaggatttaggcttctccaatactatgaaggccatgattctgagcattcacaaatattgctgggagttgtggcagcggagcacaaaaaaacctcaaaacgttctttttctccccctgtctaagttgcaaacaaattaagaagtaaaatgagaacagtgtataaaaagcaattggatagacgtaatcacttggccacagaaaatcctgagtgacagtagacccttgtccccctcttccacccctcacttgtcacaaaggccctccccctacaaacttaaggcataaaggagcagagaagaatgaatgctttctccagtgagctgactcccaaggagaaagtaaaaaggaaggagctgagctaggaatgctagtttatcttttgaaacctcaccagtcagtctaccacttccataaaagagtgaatcatgggccagagggaagccagcactgttatgctaatgcgattcatatcaaaaacagtatcaagaagagggaagaaccccctgccccatgtaagctctgaaaaaaattagaggtcatctggtcaactccagttgaggaaatctggattcacacagatgatgtggcttattcaataaggagtagagcttaggctgatttaggctgatctagaggacagaaacaagaatggtgtaggagttctagagaatcagtttttcaaggatgttgttttgcaaactgcccatcatcatttccatcactgccatcagtactctcctgcaatgttaatatttgccgggtacctatttgatcacattctacatagatagatttagtgcaatgagacaccacaggagagagctaactgtgggatgtctctcctccttgcccaaagagtagagttagctaatccacagtaattattttccgtttgtgaaatgtatatcccagggagttattattatcaaagggtatctatattaaatagtgtcattagatgctgcctgccatcagccattacttctgttcatcagagttttatattcctagtgtgtataaccagaatctaactacttcttcccaactacacaactgccactggtcctaactactgtcacctgttgcttagattatagccgtagcctcctaaccagtctccctgcttccatctttgcgccctgcagtctgttctctacatagcagcaagagtgagcctttgaacacataagccagctcacatcattcttctgcctgacactatccagtggctgcccgccagtcagaattaaagccagagctgttacaatggcctacatgagcagacttccttttacccttctggcctcatctcctacctctctcctcttcaatctctcagttcctgccatactggtctccttcattttctacaaaaacagcaattcacactcctatctcaggacctttacatttttgatacttctactggaaactcttttctcctgggtatctctgtggctcactcccttccgcacttcctccagcctctgcgccaatgtcttcttcttagtgaggacttctatattatgtagattaggctgaattatactgcaatagcagaaagctaattgacacattaggaacttaactcataaatagttatttctcacttaggtggatctagcagcaatttggagcagcttctttccaatcagtgactcagatacccttggaggtctcagcttaacaatttgtttactgtctctttactcctcaccaccctcaaatgtgtaaactatatgaaagcaagaatttttgtctgttccccccccatcttctatatactgtatgctttgaatagtgcctggcatacagtagatttccaataaatatttgttggaagaatgttgaaaggtagtgagatgagaaggaatggaaaataaaaacctcaaaggaagcttctttgtgtgtatgttttcttctcaggttaaatacagtgaagctgtgtcaattctgcatacaatatttggttattgttataactatagaaggcatgtggactttaaaacctacttaggttttcagtatcaagatttgaacatttcatttgttttctattgctgccataacatattaccacaaacttaggggctcaaacaacacaaattgattatcctacatttctgtaggtcagaaatcagacacccatctccctaggccaaaattaaggtcttggcagggctgcattcctttttggagactctaggcaggatctgtttccttgctccttttgatcctcagcacgattcaattccttgcggaatggagatctctgctttattgttggctgtcaactgagggccatccctggcttctagagactatgtgtactctttggcacatggcttccttcctacatctccaaagccagcaatggcaagctgagtctcttcaaacttttgatccctcctgcctcttctttcctttcatctctctgctccactattctaccttcctcattttattttaagagttcatgtgactacattgggcctacctggataatccaggctaatatcccccatctaagggtaaattgaatagcaaccttaatttcatctgcagtcttaaggtaacatagtcataggttccagggatttaggacatgggcatttttgaggaccattattcagcctttcagagatacgcagacaaatagaaggtatgggatagttggtaagaatgtaggtttgggaggcatgcagaccttgctttgaatcagctcttcatcttgatagctgggttaatcgggatatgttgtaacctctttgacattcagttttctctctgttaaatgtgaacatgggttgctatgaatattaaaaatgatatgtaaaagtgtatggtatatatcaagaactctactttactacttaaaaaaataatgtgacaattcctaatgttctgaatctaagcatcaaatgcagcttagagctcaatgtggaggacattgcctttaataaaacaaagtaggccaagtgctcttttgctaaaacctcaattaaccagctaggtttatagggaatgagaggggagttacatataagtgttgataattcatttatacctaaatcgttaaacgctattttaaggacatttgatgacttgaggctttcaaagaagtcgtaatgcctttttcttaaatagtaatgctgccaagagtaagcaaactaaaataccatttgctttgaaattcttctcaaacaaatttggagcgggttctaacctggcacaatatattcttccatctgtaatccctgcaaggacagcccccctgaaaataaacaccagcgctatttactgaatggggaattagaatctgtggcaggcaagaatgcaaagaaaagcacccatttagttggaatatttatttctctattagaattgtttaatggatttcaactatcgtaattgagagttatgttctagtgttttccattagctaaaaatgtgcttcttttaagtatctaaggaggacaaattcctccacagcaaataggtagagaaatgcatttcctggaggtgttgaccgtttgagcttgcaaattgatgaatacaatgttggggccaaattgaactaactgccttttgatgagcttgagtgcagcttgtgactaactagggagaggattttaccagtgcattctttaaatgaaacaagaggatccaaggactcatgtcttgatcaattggaagagcttctcctacatcccttcctgtacttcctccctgcttttgctactactctcatcagtggcacagccacatcatatggaaagccaggtagcacaaagccaaaatgtcatacacatacttcatatttcagaaatggttctgtagatcagcccacctattggtatctgcttcatggtttttgccaaaaggtcagtcaagatgggttgttaatgtacttgagtgaattttcaccattgttcctgggcatggagaaaagcatcaataggtgacagaagcatatatgatcacagaacgttggcaggaaggaaaagaagagcaccctacctgcttgaaaataaaagtatttcctgactaataaggtaaaatgagtttgctacttagatacttttggggggtggttatggaaagatggaggtgcacatgatggcattgatcattcttccaatcatataattttccagcaacatttgcactataattttttttgccgctagcactagaaccaaggaattcctagcggtcaactgagcctggggtggggtcttcgtgaggcagggagctctggacacatccctggaaatttcgggcaaccatcaggaccaaatttctcgcttgacccatgaaatttggatcagagattaggtttccaaacaccaaataaaagtgtgaaggggatagtgatgatgcatagtgcagggctcttccagcatgccatgtgaagaggtgtggtgttgatgagcacattttctaggaagacaggagtgtaatgcctgagaatgcactctatagtatattggtgaggaaacctcagtcctctgagctttaatactccaaaaattgaaaagattgagagaagaaaataggctttctctagcaatttagcctataatattgcctgagaaaggtgttaagatcaaaggctgagaagatttcgggcaagaaagtttatatgagtaactatgacatcactctgtgagcctaactggagtttctctactaattgttactaatgtcaaagacatatgtccagcctcacacacacgtgcatgcaaacacacacacacacgcacacacacacacactgggccccgctggctggaacaacatgcatagggcagtgagttttctagaaactttgcctgaaatgttggcagtgacctccataagtatgcatggaggaagaggcaaaatttagtgcaaaaacaatgcctggaatcgatatgtaaataatctttaaaggctgcctagataattcagttcctgggacactgtggccagaggcactttacatttaaagcaaagtgagtgagaccaaacatttttcaatgaagccagtcacatattgaacattttcatgaaatttcagacagcattttgaaagaaatactattagtcaatttgataatccataagcagtacagccatctttttctccactgagtcatctctcctactttggttagaaaactaaagtgaagttcgtgtgaggccttctctggaccagcagttataagtggttgaaaattttttgtgcgtggtgggagtggaagacaccttcacgttaacttgaattcagcttcagttactacttagggaggatagatagatagatgatagatagatagatagatagatagatagatagatagatagatagatagatttagagacagtgatacggtttggctgtgttcccacccaaatctcatcttgaattatagttcccataattcccacatattgtgggagagacccggtgggagataattgaatcatgggggtagtgcccccatactgttcttgtggtagtgaataagtctcagaagatctgatggttttataggggaaaagcccttttgcttggttctcattctttctcttccctgatgccatgtaacatgtgatttgctcctccttgccttccaccgtgatgtgaggcctccccaaccaagtggaactgtgagtccattaaacctcctttccagtctggggtatgtctttatcagcagcatgaaaatggactaatacagacagagtcttgctttgtcacccaggtttgagtagggtggcacaatcataggtcactgcagcctcgaactcgtgggctcaagcaagcctcccacctcagcctcctgagtagccatgactacaggtgtgtgtcactatgtctggctaatattttttacattaaaattttttttgtagagatgtggtctcactatgttgcccaggctggtctcaaactcctgcatcagcctctcaaagcccttggattacaggtgtgagccattgcacccaccagggagtacttaatacatagggaatagctatcatggggtaggcactatgctggatgctcccacccacattatcttgtttaattgttaaagtgaccttgttaggaattaaacgtcgagattcagtttggtcatctgtaagagataggaaattgacttgcacaaggtcatgttgtaggtgatgttctttccccaacctttagttgtgtttccatgtgtatatatttaactgatgcccaaataatgcttggcctcagaagagaagagaattgacccatacttagtactgactatgtgactgtgtgccagctattgtgcaatgtgcatctccaactttaatgtgcatagcagtcgcttcagaacctcgtgaaaatagattctgattctgctgatctggagttagcagtcctgcaagtctgcatttctaacaagctcccaggtgaaacccaggatgctgggccaggatttacacttaaccctagctatcatctcatcttatggttgaggaaactaagcctcaaggagtatacaggacttgcccaaggtcacactggtggtaagtggtggtgggggtgggagcggaactgtgatttgaaagcaggataggttgattataaggccgttgctggtacagtgcaatctgccacatcgcccaaggtttttgaaaccttcttcttaagagaggagaaaatccatttgaattccaggcttgatgaaggggcctggcactttaaagtcctagtttcttctaaagctctttcttctaagctcagaaaaacatggtctttgcagttaattgtgcatacgtttatgttttttctcttggcttcttcagatagacactttggtttgccacccttgcttcaccttgggaactctaaactactaaggcccaagccccactcataggccaattaaaccagaatctctggaggtggggcccaaacatgggcatgttattaaagctccccaggtgattctgatgtgcagctaggataaagaaccactgaattacagattcaaggaaacaatttctggaaaaatgtagcctcagtcccctttctcgtggatgtcattaaagaaggtccagtgtatttaactagacattcaccaacaagatttccaattagttcttggtaccattttattttgtgactgcgagcttggactgctctgagattgcagcctatataaagtttgaaatgattctgtacagaccctaagggtggggagctggtaaggagggatgagagtagaaagatacaacatcatagaccagctccagggcaaagacacatgttgtaggtcctgattttcttgctaacctaagttcttgggggggtattttgaaaaactgaatttgattttattcaattcaacaaaactggctagtcaagagatggtcatttttaaaaatgagaacacagtgcagggttggattaatgctatagaactctgagcagaccaccttggtgggtgaggctggaacagggcttctgtgtagagacgtgtgctgctgtgcaattttacacagtgaacagcgccactgcacaagagtacatactctagcctgaggtgtgggaagaaacgcaaataattggataatcatgagccagagcctgccctcagggaagagagaggagagagagaggagagagagaggagagagagagaggagagagagagagagagagagaggagagagagagagagagaagagagagaggaattttcactggagagagtaaagaaaggctttacttagagcagtaattttcaaccttggctctgtagtcaaatcatctgaggagcattgaaacctaccagtgctcaggccccagccaggtgtttctgttttaattgatctggtgtggcaacatgggtgttttggtttttaaaagtcctccaggtgatgctaatgctaaaccacaactgagaaccactggtttagattgcgttcgtactgggcagaggagaatgcatacaggcagagaaacctgggagagacaagtagcttgggagagtcgttctccaatctaagtatgatccttgaccagcagcatcagcaccacctgggaacttgttataaatgccaattctcaagttccagcccaaaccacctcaattagaaactcctgggtgggggtccacagtcagtctcaataagccctctaggtgactgtgaggctcacttaagttcgacttggacatgaacgtttatggaaagggagtgcaatgagctaaagctataagacttgaacctaacaagctgatgtcaactctcctgatggtaccattgagatgtacagcaataaccagtgttctaaggtggaatgtactcctctctagtcttaccatatctttcttatctgtttgaaactgtagcacagaaaaaagtatatgtcattcatgcaggggcagaatacttctggaagaagactctgcttttctggtagaagctgcacttttcttcttagtggacctatttctgtcttcagcagggggatctatcctccctggccacatgggcctttggctgatggaaaggctgggctttgaggaagctgcataggtaaggtgaaagagggtcccccaacctcccctttttgcttctcgttcccacctgggccaggacttcggttggctgggccccacctgccattcacagcaggcccctgaggctactcacagaatgccaagtgatgccactcagtagagaaagtctttgtcctatgctgagtaaagaccccactgatgtgtagcagtggtgctttatgttttgccagtcagaggctttcttttacctgggaggttgatgtgcacaccagtgcattcccctctcttcctggtctgcattgtatgggccaaactctccaaaatggaatagctgagtccttgcaggatgctgagcatctttgagggtcaaaaaagtgtttccaggattggagctaactcttcacaaagaggtttgtaggacaaagggactttacccatcaagtccagtgattctcaaataaggcaattttgccttcagttgtcagggcggggattggggggatttgacaatgtccggaggcattttttgttgtcacaactttggggagcagtgccactggcatctagtgagtagaggctagggatacagctcaacatcctacaatggacaaaacagcccttcacaacaaagaattatcaggcttcgaatatcaaaagttccagtgttgagaaaccctgacctagtctaaaccccttatttttgaaatgaggcagctgaggctcacagaggtgaaattacattctaaaggttacacagaaagcatcaagtcagggtgaggctcctggttttccaactaccagagtgcattgctcaacagtttcatctctggcagggacagtgtttcctccattgcagataccatttactttgtgcctactaggtgccaggcaatgggctagactcttcatttattaccgcttcatagcacacaccttcaatgtaggcatgactatccctagaagtggctcattttgtgcatgcaaaacaactgtatgaaaagtgttataggccattaagaaagcaaaaatgattgcaaaagagactgagacatggttcttgtcctgggagcttacattcaagtagtggagaaaagatatatgtcaaaatagtgatcatctagctttttacttaaggcccatgataataaccaaaaacctgtcccgaggcaccacaagataaatttcttaaaacgtatgtggaaattgagagttaggagagggagctgactgtatgccttagcatcatgggaaggctacataggtcaaagagaattatttgtgtgtattatgagtaagcactatcctagatcccacatataaatggtcaatgagacatataatgtctctgcctcagggggcttatattcttgtagggaaagccagacaagagagaaatacatacatatataagtaattatagactgtgacaaattgaaacctccctaacgtggctaaaagggcatctctgaggaggtgacattttagtggaaccctgaaggacataaaggggccacttgaaggacataaaggggtacaaggccttgaggcaggagaaagcctggcatattctagatactaatggaaagctaacgtgagccagaagagaggcatataataaaattgaggaggtgaggggccagcatggtagggagtttgcatttcattctaccatgaaaagagcaagttagcctgaagaaacataggatggatgaagacctagtaatgcttggagaatgagggaggttgcaaaggagaaggtaactgaaatttccaaacattgaaaagttgtttctaccttgaacaaattgaaagaccattagcattgatctgttccattcagtgaattatttacttaagttactcatgcacatttaaacctgctaacttcatagtgtccatggtggcagtaaagcttaaatcttatatagagataagtagatggttagctgggaggaaaaatggaggtcttgagctaacacatcctgtggttgaatgcacttttcagcatgacaggtgctcagtgacatggaagagtcattgctctaattaccccatttttttttctctctttctgattaggtaaggatgtctgataatctgtatgttttgccatattttctgtttcatagattttttaagtattttattgttggagtcactaatatgtgtctaataattttgattggtagtcccattgctgtctacattgctgtggccttggtgatctcagatttgctttgatttaaaatcatgtatcattaattatgttctgttatctttcggaagagttaatttaaaggcaaacagcatcatcatcaaataattgagggcttgttaactgcttccagcttgaagccagcaaaccttgcgaattacagtggcctgctgagggggcagatgcctctgtggcattgtcaaaacagtttcctaggctgtctctggttgcttttctgtctttgaataagggaaaaagttttttggagacaggggtagtcttgaaaagtaaaaaatactgaagaacccaatagctatctaatatattgatgcttttacaaagttgtcttactttatttatttatttaatttttttgagatggcgtctcactctgtcgcccaggttggtgtgtagtggtgccatcttggctcactgcaaccttcgcctcctgggttcgagcaattctcctgtctcagcctcccgagtagctgggattacaggcgtgtgccaccatgcctggctaatttttgtatttttagtagagatagggttttgccatgttggccagtctagtctcgaactcatgacctcaggtgatccacctgccttggcctcccaaaatgctgagattacaggcgtgagccaccacacccgacaaaagctgtcttactttagacttgttgacaaacacactggaatcctggctacatgataggctttttcaataacttactatgtgacttttaagaagttgcttcccctcctgagttttattttccttatgttttaaaacaaaggagtggcattaaattatctctaaagaaattttgtttgaaatgacatagaggatttcatcatagtgtttgtcacgtactaaatatttaggtagctgttttctgaggccaatgttatgtctattgatacaacttttatagagtaaaccaaaacattctaaatataggaaagataaatgattaacttatttagcttcaaatatatttaaaggatacattgcattggaatttttttattctatcagagattaaggtttactataagattggttctttctttacctctagtttgaaatgggaatactgtatttctgtgaacatgagtacgttaggccaggtcagcaggcttagactctgttaaactctctcctcttaccatgactgctccctgactgtgtccttaaccttgacaatggcagaacagcactgctgctgctgagaaaccaaacctagatgcaagcttgcccacctgatggttagtcaatggaaaaacatttgcaatgggaactagctcttttataaaagttgcttataaccatcatcccaccactaaagtcacttattcttatcacctctgtgtctgagtatgccacctgtcagtgtctgtgtgtctgtggatgtgtggatttgcacatgtgcacttgtgtcctcctactctgcactactcctgtgagacttcggagtcctgaatgggagggctgtgttttcgaggctgggggcactgcctatatgggcaaaatttccccccaaaggcctgttctttggcagctattctcatggggctcagcagcctttcaaaaagcatggggcttccagatccagaaataaaccaggagccacttttaccaccttatctgtcttgaagagtcaagttgaatttctgaaatcggaggaagctttgtataaatctaatgtctacctaatcactggaattttttgtccacctccaagactggataaatctatttttgggtagggcagcaggagtcactgaatgaaaggtggacaaatggttcagatgaacagtggcaagagtggttgtcagaggatagaggtcatgtgcaagaagggaatgtaccagattgggtaaaatggcagaaaacattgcattaagccagggaaaaaagaaacccattcccttttcctatcttaatgggctggattctttgcaggtctccttttcccttcataaagctggtaccccatggacgcattgcatcctcatcactttcttagggaatcagaacaaagctacccacctatcttactgctggagtcctgtgggaagtcatctttcattctttctgctgtcaactgcacatacagccaccatcctacttgagggagccctgggaataagtgcatttgatataacagttttaattttccatccaaaatatctcaaattaaagagattttataagccagcgtaatgtgttgcctatacagtgccacttctggtttaaaaaaatcagtgtttctagctcttttgccaacataacatcaagctactgttggttgactactctttttttttctgttttgcttgaattgactgacatttgaggtattgaggagagacagcctgagacccaaagctgacccattaactcccagatgttcacgatttccgaggaaatgttctgtgcctatggttactgttctgatgactccttgaacactctcatcttggcaccttttgcacttgctaaattcaatttgaagaaagaacaaaagacagggaaaattttgtggaaagcaattatcctgcacttttatgaccttcatgtttttcccatcatgatgaattttggggttagcacttgtatcagtcagcatgtagctttcactagaattttgttgtgtgttacagataaccagtcgtatctaattaaacaataatgatgccagtacaaggcattttctgggaattaatgaccagctgggaaaagctgatggctggagagtcagccaaaggctattagcttcagtccactattaatctccagaaatgtcaatttgtgacatcattgttggtactgagcaatgaaaatggaagacagtttactgttatctgtcacgtacttctgaataacaaattccttatgcattgtcaaaaagtcattttttctcttttatcctccaattgtccttcagtcttataatatgttttctatacagcagtgggtgaaaatggaatttctcagtttccatataatcatgggtgcttctttttttaaagagttccaatttggggagttttatttaaatattttggatggtaaaactagaatttgtcttcagctgtgatgctggaatttgatgagtgtctatattatcataactatctgctcatggcaggaaatggttacaaatgttttgaatagcagctgttgctagcaaagatgtgcattcaacaacgagattctaagaagttatagtcgcattcctagtagatgaagggaactctctacggaaaaagctatcgtggtgtgtctatgtaatatttttgattgctgctgctgaatgctagagggaaatagagaactgactaaaatatcagcatcaccatcttgcataatttaatgagttataaaggaagacaacaatccctcatagagtcaatctattaagaacttgttctaaactcataatactaatttaaaagttatgttggtttttatactattttttccttgacatgaaaggaaattcttaaagccccttaagatcccagccaatgagctaggaatgttttacccaacacagaagcttcatatcccatctaaattcagccaccatttgtttatttatttatttttttttttacaaacaccacggcattattcaccccacaagaaatttgctagtagtatcagtcctcctacatgcgtgttaagtgtatgcatttcgggtagtagaatgagtcagctcgtcattaatcaaagctttggaggcactgactcacttctggtgaaatggaatggcctcattgggaagggtgtgaaagaaaacaattcatgctggggtcagttccctgtttctgaaaatgcagatcaaatttgcacctattttcatggaaggttttcagaatagagaatgtagcagtgaaccctataaaggcaaatatcttgcttttgcagggaataaaaataatagtgatacaaaaacactagtgatacacttaggaagcatataaagagcctagaaagaaaaatgtggactgagaggatcctggtgtatacctaaggccaaaattattaaaccaggcctggctcttttacaatccaacaaggtagtcctttgaccaagcgttgtttcgtaggctctcagctggaatctcttgtcttcattaaggggttttgaacatctgaagaatgtttgcaacagcttcagttctctttggaaatcaaaagagtaaagagcagtgactgattcttctgtctgtctccgtgtatactgcttggaagtaaggccctcaccaggagcagaccaagaaaagaaacagaagcaaatttactgataattggtggatattagccagtttaacctatgaatacttatattgtactcaatctgaaacctataagttctacatggtgtttatttagatacaacatgagcatccatattaaaatacgtttttgcactttgggtatgatttaacactgttttcattgtactagcaacagaggtatatatagtcgagtagctatttccacggctttagtattttaaactaagcccattaaaataaaatcgccaagctattagatgtttttctttgaaacttttcttagggctgttgtttctttagtcttccctgggagtatatttgatttaagacattcgctgcttttctgaggctctaacttgagttcattttgttatgtggtgaccacagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaaggtttgtgcacgacagacgcgtgttttgcttgttttctctcattcttctttctttctctttcttttggattgtgcattgccctctggtgtgctgtgtgttgttcaggccctgccatagctaggaggccccctggctggctggtgaaagtgttatacagtctcagatgggacgctgtataatatggtcatctctggcacagcgcacagcgtcaccctgcttttcacagctgaaacattttcagttgctgtcattttactgccccatttgggctggcaaagttgcttgcttctgtagccaacatctggccaattctgttcccatcaccttgcattcctgaagcagcagtcagctgaggaatgaaacttctaaaatgaaataatgagaagattgtttcaaaaattttcaactctccttcactccataaagcttttgcattgcacttgaagaatgctcatgatctacttagtttgctgaagcaggcccagattacctgtataatgcacgccccgttgcactttgccatggtaaaatgcatgcctcaaggaaactatgagtagtttgttttttcttttcagctcaagtacaggtttggacaactctacttgctgttacttaaactgaggttaataaggtactcattgcaatccatatcacaaatatatcttcaaagtatttcatctggccagaaatggtatttattcattgtttccaacatttttgcatctatcaaagagaaatatttttcacattacaaataaaatgtggtaaatttattgccatctgtttacattccagcttccaaaataacttctgagaattataatgtaaatgctaatacttgttaaacagcccattttcccctcacattaaatatcactgaggcagtttaccaatgaataacatttggaagtgacaaaattcacctgttctttggcagttggtgtatacttttgcattagtggtttttgtataatttctaaaagcgaccttgtttctatttcaagttgcccttttgcatcattatgggaatccttatgataattgtctttctgatatgggagagactggcatgtgggttaaaattcggtgagtaaataaatttctccaaatgcactctagtccgtagttttggaagcaaaacttcacaactcaaagtttccccttttcttctttccaaatagagtttaagacaatcattggcagaaaatgagaagcctacatgtatctgtgtttaattcagccatagaatagagcactcatatttatattctacccatacttttggtgtctaaactattcacgttgagtgtgaccaccgacttccacatatattcatctggaggtataaatggtgaacttttacagtgagtaaaagcaatcatttggttgtttagtggagaagataactaactttattttgtactttaatgaaacaaaaaaattttaaccagtgacaattactttactatatatactacattccaatattttctgctttctttactctaaaaattataaacacacacacacacacacacacacacacacagtttttgtacttgcaaatcagcctaaaaatcaaaatttggtttcgttaagaaaaataagccagttaagaagcagctggttaaattcgctcaagcaatcagttacataattaaaatatttttaacaatatttcagattttaaaaaacagttaagaccccattccttttattattacatataattttgacagaatctgttattttcaagtaccatctggagtgtattgtaaatactgttatgaatattttcagatatagagaattcttaagagaataggtagcagttagactctcttctgcaaagttaggtagtttttgatctgtcatttaatccacatattgagctgttgccattgtgtttaatggggctgccatcctttcacttgtgtactgtgatgatgggcattgtcttctttcagattggagattttcctcagtcttgccctccttccaggtcctcctgccacgatatcaaagctaatatttctgtctttattcttatgaatgatttgtaactagtattaaagtcagaggttttctgggatgacatttaaatactatttgcaatcttactgtaccccctcaaacaagatcccagaatctaatgatgaactcagaccttaaaatgaaaacacttgatctctacacaagttaacaggatccagaaggctttagatgggggcgaaagaaaacatgctgtggagctgatcttggataaataaggaaacattgccaagaacttaacatgcttacttcatgtaggatatcgaagctcatcatttccaggaggcgaagtaactatgggtttggaagggttcactggtcattctggcaacctggaagatttttgcaggactgttttttaattgccgtaagttatagtgttcggttccctcttaaggttgttgtgacattttgttataattagtagaaataaaagacctctttttttttttttaacaaatggatagtgttttgcatttaaactatgtctataccttgaaacattttattgttacgtgaaacattttgaagagatactccctgtcatggcctccgtgccaaaacatgagaccttaattgaccttggctgtggatgctcaccaattctacagcaggtgaaggcaatggacagggtggttaaaccatacattgtttgatctatgcaatgcccgtatgctagtataacctcttctaatgagattatttttttatgcaatgttaaaacccccaaatgaaaaattaaaaaaaaatttttaagccttttggggaaataaatgtttgaattgcgtaagctttagaaatgattaattaaacaggtttatgtgtattgtgatacagttggaattactaaattgataaaaattacccaactcttttttaattagtatagataaagtcttgctgtttcttttgtttggcagtggtttataagggctgggctgttttcatagtttatgacctcttaagatttgctacagataatttaacattgtttatagtcacccatctttttatagatatttttgtcttacgtccagggccctcagaatccatataaaataatacacaaagggactgaaatatctcactggcttttcaggatacacgaaggccaaattacactttgccaataccaggtttctatttatgaatatccaattccaaaaaaatttttaatctgttccaaacatttgcgattttcagtgacatgattatttctataaaaaccacttatgatataatattatgtgagtgctggaatttggctgaagaagtgcacacaagtatctgagagtctaatttggcccagtaccagcaatgttctttgttaaaagaaagccacatggagagtggagatcattaccaaaatctttttcttaccgctccaggagccttttggcaaaagaaagtataagcttcatagctttattcttttgttcactttatcttcctatggcatttgtgccaaaatgaaatcactaatttagagtaactcctggaagccaatctaatattagcatagttgtcatttcctaaatgccactccttggacttttactgatgttcgaagattgttaaagagaatcacaccaagataaatatgcttgcaagtagatagtgttggaaatctacagggaaaaataaatcatggattcccagtgtttgcttttagggtttaaaattctgattacgatagtaaatgtgaagaaattaatgcaacataggaaagtactacagagcttggtgatttgtcaccatctttttatcaggcatttgagctctttgctatagtcctgttttcatgtgattacacacacacacacacacacacacacacacgcacacgcacacacacacacattctgtcttccttagggcattcgtaacctttttattcagagagccatccaaccattgcggctttggttggagaagagaatctgtgctggagattgatgataaagtatggcagcttccaccaaccaagagaaagcaaaattacatgctaaatggtaagggggtatatttgtaactaccatgtctgttactctgataatgcgttgggttattccagaaagagcatacatcaccatgaatatcagtcttaccttaatgatgggagaggaagaagtcagaggaatgctgaggaacatgctgagggaaatgtttttcatcttcatgttttttcaacattgttgttttcctgttgtgccttcctcatcttaatgctaattttcctttcgagaaaaatgtgtcagcattaatttgaattaatagttgaataaaactaaactatggttattaaatcattttgtcactaagctagagttgggtaataacctctgatgcttgtcagctgaaaatatcttgactttcaggaaagacataactaggttccatgtctgtctcctttagaataattgaggggacattcctattctgttagaaaagcatggggccttggtttgcatttctttaattatcagtgataatgagcttttttttttctaatgtgtttgttggctgcatgaatgtcttcttttgagaagtgtctgttcatgtcctttgcccactttttaatggggttgtttagtttttcccttgtaaatttgtttaagttccttttaggctctggatattagacctttgccagatagacagattgcaaacattttctcccattttataggctgtttgttcactctgatgatagtttcttttgctgtgcagaagctctttagtttaattaaatcccatttgtcaatttttgcttttgttgcaattgcttttgatgttttcattatggaatctttgcccatgcctatgtcctgaatggcattgcctagattttcttctagggtttttgtagttttgggttttatatttaagtctttaatccatcttgaattaagttttgtataaggtacaaggaagaggtccagttccaattttctgcatatggctagccagttcacccagcaccatttattaagtagggaatcctttcccaactccttgtttttgtcaagtttgtcaaagatcagatggttgtaggtgtgcggtcttatttctgagttctctattctgttccattgttgtatgtgtctgcttttgtaccagtaccatgctgtaccgttacagtatactttgaagtcaggtagtgtgatgcctccagctttgttctttttgcttaggattgtcttggctatgcaggctctttttggtctcatatgaattgtaaaattgtttttttctaattctgtgaataatgtaaatggtagtttaacaggaatagcattgaatctataaattactttgggcagtatggccattttaaacatatttattttttctatccatgagcatggaatgtttttccattggtttgtgtcctctgatttattttgagcagtggtttatagttcccttgaagaggtgtttcacttcccttgttagctgtattcctaggtattttattctctttgtagcaattgtgaatgggagttcattcatgatttggctgtctgcttgtctgttgttggtgtgtaggaatgctcgtaatttttgcacattgactttggatcctgagactttgctgaagttgcttaccagcttaagaagcttttgggctgagacaatggggttttctagatataggatcacatcatctgcaaagaaagacaatttgacttcctctcttcctatttgaatacactttatttctttctcttgcctgattgccctggccagaacttccaatactgtgttgaataggagtggtgagagacggcatccttgtcttgtgccggttttcaaggggaatgcccccagcttttgcccattcagaatgatattggctgtgggtttgtcataaatggctcttattattttgaggtatgttccttccataactagtttattgagagtttttaacatgaaggggagttgaattttattgaagacctttgctgcgtcattagagaaatgcaaatcaaagccacaatgaggtaccatctcatgccagtcagaatagtgattattaaaatgttaagaaacaacagatggtggtaaggctgtggagaaataggaatgcttttccactgttggtgggaatgtaaattagttcaaccattgtggaagacagtgtggcaattcctcaaagacctagaaccagaaataccatttgacccagctatcccattactgggtgtatacttaaaggaatataaatcattctgttataaaaatacatgcatacatatgttcactgcagcactattcacagtagcaaagacatggaatgaacccaaatgcccatcaatgataggctggataaagaaaatgtggtatatatacactgtagaatactatgcagccataaaaaggaacgagatcatgtcctttgcagggacatggatggatccagaggccattatcctcagcaaactaacacaggaacagaaaaccaaacaccacatgttctcacatgtaagtgggagctgaacaatgagaacacatagacacagggagtggaacaacacacaccggagcatgttgaggtgagaggtatcgggggagggagagcatcaggaaaaatagctaatgcatgctgggcttaatatttcggtgatggtttgataggtgcagcaaaccaccatggcacacatttacctatgtaacaaacttgcacatcccacacatgtacaccggaacttaaaaagaaaagcatgggaccatgtgttctggtgactctgaagagataagaagactttgttctcaacctttttatttcaaagtcacttttttctttcatgacttagggccaccctgcctttgatttatgacctgaaggatcacaaaatgacacaagacaattttctttgctcattgaagcaaatggcagcttaattgcagagtcacaagaaagataaaaaaatattagtccaaattaatgccagaaatctggtggccttggtcattagcagtgagtaaacactatcctctccccacaaagtatttaattctatttctcttacagcttatgtcctgataacattagtaaaccagcaatggcaatgaaacccattctttcttcccccttatttcccctaccttatggcagcaaacacaaaatgaagtcatattttggggatagtttctactctctggaaaacttacagtctaatcaaggagtatgtatagtagccagtaattcactttcatgataagatggacatttatcattctcttattgaatatatgcatctccattcagtctctaggctggaggctggcttttagagtacaaactaataaccgttcgttctttaaaatatcattcactttttaaagcaactgacctcccctctcccttgagcttatgtgttccaatcatggtggtggtttccttgagacaaagttgtttctcctttgtaactctcttggctgaagtcttccttagttaatacttggagcagacatttctcctgtatgaagccagcactgatgacccgtttcaggcatttatgtttaaagtgacacttatctgcgaaagtgctttgaaagttctactagatgaatgacagtgtatgctggtgattttgattttaaaaagtcaaaatcaaagatacttgaaaacatctggaagttatacatccatatgggtgcttcccctttcaaggccaagacatcagggattgtgttggcaacatgctcttgggatgatgtcttgccaacttttctggagtttttttctcttcccagccagttggtaaaccacttaagaaattctgccttctggacccagcatggtatgacccagctaggctatgttccatgtccataaaggcatagcctgaaagactggttgattccccaaatcaagcccaatcctgatattagaagtctacgtctattaaggagatgcacaagaatgttctgctccctctgctccaattttcaccctgtcttttgttttaaatgacaattcacttgcctggttgaagagaatacaggagtgaactataatctttttcacagattcttacatagttatcagatcaatgttttccaataatatttcatgcaacactgatcatatatttatgtaaaaagacagcatttgtggtcaaatatgtttcccaaattacacgccattcctagagagtcacaatgcatatgagtatatgaaagattttaaagagtcttgcagattaggaagctgtctaccttaggcagttcagtggtaaacagcatcttctagctactggacccttttactgataatacagatgaacatcttccaagtaacactttgggaaaggctctgctggctctactaagcagtgtgttctcatcaaacatgagctttgtcaagtagcacacttttgaaaatgattgctgttcccttcctctcgattcccacctactatcgttagagaaaggctactcaaatgttcttcatgtgtctcaagttctttgttaccaatccatgactagataaggatcttatgccagaaggtaaatcactgcttccttcatgaagaaaatattgctgtcttgctgtgaaaagtaatgtcagctgaactaaataagaactgtattaagtaacatagttcacagactagtgctatgtttgtgtaccatacattgagtaacactgctttagattagtgattctcaaacttggctgtacattggaatcaactgaggatatttaaatactactgacgcctgagctcaacatcaaaccaaaaactgacaatcaaacaaacaaacaaagaaaacctgcaaaatctcttgtcgtgcttctggtcccaagcatttcaaataagagatactcaacttttagttactagtttttatatggataaaacatttcattctatgtcctcattgtatattttttcttgagaagaaatatttcttgagaagaaataattaagtaaaaaggactttataactggaaaaaaatttattgtggtagcggctcaacaggggtacttttttttaaaatctatctaagtgattctaatgtgctaacagggttggaatcactgccttaggaaataatcaccttggcataaggtctgctgagtgatgtcagctgtcaatccaggaatcttatcatgctgattgcatgggcctcttcaaaaggtgccctgtgatagagggctcagctggagaggcagcccttatatgacctttagaacttatggccatgtaaggtatccgtctttcccaccatgtgcacacacacctttctgaagttcccttacttgtttgccactctgtgcttttagaaaaataattaggattctccataagcgtgtggtaatctgccaccttgtgaccaacattctttcttgcaagcaattgttgaaacacttgttctgctctcagaatctgatgcagcttgcaagtatgggtcaaagagtttctcagactgtacttaaacaagaagatggagaaggagaaaagggtgtcacgatatgccagaaaagtactgacaattctttacttgattgctactgctctagagtaagattgcaaagcttgactcaagcagcttgtagcctgtgtatctgtctctgtgttacaccagaggctgtcatcgaggcattgccctcttatcatctaaatgtaatcggctactgcagcataaaaggattacagcagcccatatgtgaaacttgactctgacatgattaggaggctttaattgctatccatgtttataaatcattcctagcattttaaactacgtggattctgatattcatttcttatactctacggcattttttagtgtgcttaagaatagcaccttcaataatgaccactgtgaaagcgttaaacaagagacattatattctgcattttatcagcacttgcccttgtcttgcctcacagccaatatccacactcactccagcacatgaaaatcacttgtccacttccacccatgtgctagcaaatttttacttatgagccctagctattttaagatatatattctcagaagcatgtccagctttggaagcagcaagtgtacaatggccccaagactatatctacaaaagggaaagggaagagagcgtacttccactgggccacatcttcagtgacaacactgtgcatagccccttagaagcatgatcacgaaaaccctgtcagatagggttgctactaccatttcacagatcagcaaactaagatgcagaaagagtaagtcacttcaccagtaaatgagaggacttgatttgaacctaatttttctggcttctaaaagccatgccttctcccctccatggcttctccatatgctcagtttcccccctcttgctccataagtgcatttgttatctaaaacaaactgtagtgctaaaaagtgatcttaagtgtaaaggaataaaattctgtctacagtccttcctcagctttgtgacagcaagagtttgtcataagcagaagggactcgactcaggaggtacttgctcattctgtaggcctaagattaggtagagtgcagcactcaaaaggaagagatgaaatgacccttacctttaaggaactgatgacttggtcccggcatacaaagaaataatggagtgattaatgaatacttaaattcgatttgaatgcaatagatctgttcctagataaaagatattaaaagctcacttgtctactctgctttctttaggctagggaatgtgcctttccacctatgtgttagtcagttctcacactgctataaagaaatacttgagactgggtaatttataaagaaaataggtttaagtggctcacagttctgcaggctgtacaagaagcatgatgctggcatctgcttagcttctggggaggcctcaggagacatttaatcatggcagaaggcaatgctggagccagcactgagagaggtggcatcctttttacgatagtctgtccacaaatacagggagactcgaggaaatgacacatccatattgaaattatttgcttcttctctctctttccgtgcatgagcacaggtgacttgccctgaattgggtgtaaaaccttcacagaggacttcaatggggcaggagctgtctcagttgagctccaccagagacctgccattgctctcataatggcacagttgattctgtcccttccaaaagcacaaaacactgggacaagggaaacatgcccctttgtggtcgctagttgccattcaaagagggtttgaatacacacacacacacacacacacacacacacacacacaaatggacacatattactatttaaaatagtttatttgggggaaaaaacacttaaaagcagaatagtacagctcacatggttcctctactggagtcctttctacgatacatccagcccaacaaagcccagattaatcacagccctctatgggataatatgggctcaagcaagccattcatacagcgaggacatttgtctagcaaactgcctcaggctgtgaacaaaatcgggttctttttaagcaacaaggaaggaacaaagggcatttcaaaaagtggggattatagaagctgccagcaagtaacttttctcttatgttccttcttcagccatttcccctctgtacttacttgatttttctctgagaagatagcatttagaatccatgttagaagattcatgaactaattcagtaaatctctaattggcatacatggtaagctgttcacttagtggataattggttaaatgtacccagaatatttagtgagggagaaaaaaaatccccaaagcaaatcagcatagtttaggaaccttttcctctagtgccgctttttctttgtgaatggctactggtgcttaaaagtggtctctctcccttcccagtcaggactccatttaaatatacaacctccattgcatccctacttaatagagctttattaaatggataccataagcatagcacagtgtctgtcaacagtaagtgctcaatgaatatttattattacaaataacttatttatctaacacattttgatattctgtgttcaacggccatttgctctaattccaggtggcaaatgactgagtgcttctcatcaccattagcagaattgatatatttgttaataggtgtttattgagtgtcttgcacaagccaggcattatggtgggtaggcacagcatgataagacagattacatctctgccctcaaggaggaattaaagactagcaggaaagcagacttagaactacttgattatcaagattgtgttgcattcaaaaacactctaatacatagtggcttaaacccgctaaatatattttatttctcttgggctataggttggctctgtggttctgctgatctaagctgggcattgcttatccttcctgggctcaacaatatatttgtggtcagctggtaaggcagggtggcattgactgttctatgatgagtttgtacaggacacctcagctctccatgtgtttttcaagtcttatttatctattttaatattcatttattaatttttttcattgaacatttactgagcaacttttctgtgtgtcaggcactatatggccttgcatttcaattgctcaggaatgagttctatgctggtaacacacattcagtattgttagcctctggccagtattaaaaccatgaaagcagatgagacacatagggagagagactagagaagcaaggcctggggcatagaaacattgtaagatgttatagagaagaaaggactccagaagaaaaagaaggaaaaccaaaagaatgaggtctaaggaagccaaggaaggactcggcttcaggaaggaggaatggatcagtagagctgaatgcggtaaatcgttgctaatttaatacaatcctttcatatatcccttttagcatctaggctttgtaatccagttcctttcaatgtagaacagatgtctctgcctctcacgctcttgggaataaatggcataaatcactgaaatagttaaactgacccttgatagatagagtgatgaggaattagatgttgtctaactgctaaggaaagagtaggtctttgtaaagatgtcatcgatttttcttctctataatgcctgtaaagtttaaggctttggcaagaccaatttattcttttgttgtttatccttttgaatgtagttaagcttgctcggtaattttttctgtaatctaaaaatattggatcactgagaattaaaattaaatcaccccttgagtttggtattttaaaactgacaaactttgaagccacattaatatgatacaatcaagatgacattacatgtgtttccaataaagcaagttttctgccaactttacaaacgtgcacttttgctagaaattgattccttgtctagcagtgaacgtttcttgctgaatgaaagaagtagtgtttaaaaagaacaaatacacagttttgtggtgaagaactgttaacaatatgatatagagtctatgtaattaggctaagtttttatctaggatttgtgaatgttgatcctaaggaaatgataacttcctatgcaaaatatgatgaaagttttctgtacagagtgtcccactcaccaaggtcaaatgctacttccttagtagcctcaagggaggaaataggctatgtgtttttgggattaaaaaaataagaaattaaatgaattcatttttcatagtgtaaggtagagtgtttgggaaaaaaattctttttgaaggtctgtcctatgtatttgaaggtttttttcccttgcacttggattgtcccttaattcagactgtattaggatactacccatttctaaactaacatgagagactagagcttttagacactttttgctgactgccctttttcctaagacaggagaatgtcatgacagaaaatactgcattcccaaaacatctattgaaataaaaaaaatgtagaaagaaaatactgcattcatggacctacctctagcagcattccattttttccttagcatatccaatactacttttctccctgaatttgtttaaattaaatctgtgctgagacaggatcttgtgctttgattataggttggaatctcaatagtggaacatgtgagctaaccagggagcttgtgaacccctttgatatcctgtcatccttttctcacctatgtggtaacctagagaaaggactttgaagaagaaggagaaatatctctgtaggtagatggaagaaggttacatttaacatgcgaactgaactttatcttctctcttgtttagtaaaatcactgctggttggaggagcagggagtggacactgggaaaatcagaagccaacctgtgcccctacagtgctccagagctttagtatttattacatttatggaatgttacctattttttttctacatagaaggttttaacaaatcaagcaacacattctcatacttgataatgaataacattggcttaaaaattacaccaaattatcatgagaagcacaagtgagacctaaaacccagtgagcaaatctgttagtgattcttttcagctgtaaaaattagttgagatatttatttttccttcagtcagtagtgccaggctctgtgttgagctagagcaggatttctcaactttggtgctgttgacatttggggctagataattctgttgtcaagggctgtcctatatattgaaggatattgagcagcatcccttgactctacccactagatgccagtagcaccccatcctagttgtgacaactcaaaatatgtccaaatattgccaaatatcccataaggagcaaaatcaccttgttaagaaccactgggctgtgtaatacctatacaaacaaaacacatatattctgaaaattactctgcttctttgagagccagtcaaaatacttctgtttcatcataaccaaggttctccatccttgggttactaaggtagtagtttcaacttaattcaaactccgccttactcttcctgatccttcccctgcccttctcaaacctttaacttatctcagctatttatacaaatataaatatatttatattatataaggctctccagtagagctcaatgcagtgatttggtataagaaaactgaggctgcttcgggttaaattccactgtcattgaatgagttacaacttggtttgttccctgtgtctactataggagatctggagaaatatgacagagtccctgccttttaggagcttgacatgaaaactctgtatatgaaaaggaatgtaagtcagttatatcatgggctcaggctcaaatataagctcattcagaaaaatcttttcattgctgtccttttagaaggcttctgctcagtctagcctttcttcagcagggctgatgatgagcagaggtgaaggtattcctcaagattttatttttcatgttttcatatctagttcaacattgaaaaacttagaacattcaagctaactattcagactcgactaacattgggtacctataatggtgccaggcactgggctagttgcttcactcagtatttaatctttaaaataactgccaaaatgaagcatcactttttccttacctcatcctggttcctttacactgtcagcaagtctatgagatcaggaaagaaggaattttggaattttcacataatattttgggggacatgcagtaactaaactcattaaaattcagagaaattaatactccaaaagactatcaaagaatagaattaagtttacctcttagctaatttaatgtattttgatttattttttcaaaagcaattgtggtttatctggttcctgtttcttagctttgattttgttcctttatcgtagtaaagtgtcctcagtgactcatgttactttggataaggtccgttccttccttgagtctccatatccttatatatatataaataaaaaaaatttttaaaaaggattggataggtactgaattctcttattttgtatatctcaagatagtttaaaataagactcaatttgttattatgtttcctgacaactttatgcatagttaaaatggaaattcaactaatagatatggttgaagtctgacttcataattgtttcaagtttttgctgcgttggttgagcttgaggggaggtttcctggccatataatgatggccgtgggcttctcctttttcacatttttgctgaaactcgtgatcttaattctggactttgagaagattaaagcctaggcatgacctggtatgggcacagggagaaggaaaagtaacattttgtaagtacttgcctgtcttccttttgaaaattaggtaatatgatcgaattagctaagtaacttacccaacatctcaccattagaaaatggggagatcgaagtacaaaactatattctctttccaagccacactctgtttcttccaaaagggagactctcaagacctgccatatggattaggaggtaagcatacttttcctgttaactctgtgacctgttaactcttccttttagtgcctcaaatcttgacttcagggacctaatgctttcatgaacctaatgcaaagaaccccttgctttgtgttattttgtggaagaataatttggagcaaagaaaatcccctcaccataggcagaaagtcagaaactggaagcaagagaaaatgcttggttggtagaccaccaccctggccactggacttcgtacctttatatcctgattcaaaatggtagatatcaattttaacatcactcctcaattcaccagcccctgtcttggggcttccctggcattcatcttctacctatatttccttccttcccttccagataacacaatgagagtcaggtatggggaggctttattctgaaaggaaccacatctgttttcactttccctttttcatttagatatccactgttttattattgttttattatgatttcccctgtagagaagtatacagtggcagggcgacctgttgtgcatattgaattttacccttcatttactccaatgtttgcctatttctgctagaagctgaacagcaatccatattctccctgtgtgtaaactgtttctggataagcattaggtaccatggcgggatgtttgtttatccaactgaaagtctaaaggttttcaaactccccagttctcttttaggtggtagcctattcatagaatcagcactgctgatttatgagcaccatagctgctcagatctctaatatttctacagctattccaaattccagtagtttagataatggaggaatttaatgaatagctagagaaacatacagatgttccagtttcagtggaaactagagaaacttgtagaatattgcctcaagtcaggttttcatttcacctttctttacccttgtccccagcatctgacattggattaagagcagcaacaccatagccaccattgctaaagtgcaatctgggccagatatcacctcaagtttctataatctcgatagaaatgctagaatgtagatattttatcccatttttatacagaaggaaattgagcctcaaagactttaggtaaggcagaactgaaaaccccagtaggtgttaaaaaatataatgtgatttgaattttgaactataagttttctaagccagatggcttttacatctggggtgttacctgggttactgacttgaactgttgtttaagatgtgactaaacttaaatttatattctctattgacaaaacattttattctagagtaattgctgtactagatacaaaaacactgcattggtaaatcttttgttagctgtaaagatggtagctgcatatgtatgcattcaaatctgcttgttcataaatagaagacctgatttattaaagattttcatatctgacattttaacttgagatttttcactttcctttttctgtgaacagcacggctcatctctgtaagttcaaagtttgtcaagttcataactcttaaaaaccttgcacaaaccataacctcgccctttgccttcccagatctattcccgaaactgtcatcttgatagattcgtggaataacccttccttctcaatttctcagcacttttctgaccccctctgtcttagtctgttttctgctgctataaaagaataccatagagtggaaaatttttttttaatgatttatttggcttaccattctgggagatgggaagtccaagaccgaaaggccacatctagtgagggctttcttgctgtgtcataagataatgaaaggtatcatatgacaaagaagtgtggagggatgaaagatagaggaaattgaaccaaacccatccttttatcaggagcccactcctaccttaactaacctactcctacaataatggtattaattcattcatgagggtagagccttcacgccctaattaccttttaaaggtgtcacccataaataccatcacattggcaattaaatttcaacatgagttttgggggacatattcaaaccatagcattcttctcctagtccctcaaaattcatgtatttctcacatgtaaaatagattcattccatcccagtagccccagcaatcttatttcaataccaactcaaatgttcaaagtctcatctaagtcatatatgggtgagactcagggaggcaaattcctcaggcagtttctctccagctgtgagactgtgaaatcaaaacaaactgtctactttcaaaatacaatggagggaatggggaatggccaagaaggctgactagaagctccatagctctcaaagagaggaatggaaaggacagtaaacacagcaccttcaactgaaacattcaggtactcgcattgggactaacgaaggaaacaactcaacccatggagaacaaagaatgacagcccacctgagagtgacacagaaccaagtgaacctcccccacccaaggaagcagttgagtgaatgtgtgaccctgggaaaccacaattctcccatggatctttgcaaccctcaggtcgggagatcccatcgtgaatccactccactgggaccttcagcctgacacacagagctacacggagtttctgcagagtagccactcaggcacatgtggagacccaggagctttagatacgccagcatttcaggcttctcagcaaaagtaactgcaactccagcaaagtgggaggttggacacctgtacatacccctagaaaagaggctgaatccaggggaccaagcagtgatagtctgtggacaccacttccactgtgcctcacaggataagacccactggtttagaattccagccagtcaccagtagcagtattgcacctacctgggacaaagctttctgggggaagggtggggcgccatgtttgctgtttgggcaacttagctgatccagactgtaagctttggagagtctaaacctaccaaggtttgaagggatcccccagcacagcacagctgcttatcaaaacatggccaggctgtttctttaagtgagttcttgctcttttcctcctcactgggcaggagctcccaactggggccaccacccactcaagccagttttctctggccaacagagatttgaaaactccctgggacagagaacccagagtgaggggcaggctgccatctttgctgtttaggtgacatagccagtccagcctgtgagctttggagagtccaaactgacaggggacagaagcagtaccccagcacagtgcagcggctctacaaaagcatggtcagacttcttctttaagcaggtccccagtactcttcctcctcatggggcagaacctcccagccagggcctgcagccaccccgactggtgttccctggtctacagagttttgaaaattccctgagattaaactcccagaaggaggggtgggctgccatctttgctgtttaaacaacttagcctccagcttctgcagagccaaagctgaccaggagtggaagcaataccacagcacagcagagtagacccacgaaaatgtggtcagactgctttttaaagtgggtccccaaccccatttctcatcaccaggtggagcctcgcacctggggtctctggctacccctaatggtgttctctggctgacagacgtctcagctctccctgggatgcagctcccaatggtaggggcagaccgccatctttgctcttaggaaaacttaaccattccagtcttcaggcttcagcgtgtccatggtgaccaggggatgaagtggacccccagcacagcatagcagctctacaaaaatgtggccaggctactttttaaagcatgcccccaatctcattcctcctaactgggcaagaccacccaactgggattgcccgccacctcctatacatgtgtttaggctggcaacaggtccatacctccctgggatggagctaccagaggaaggggttggctcccttatttgctgtttcacagccttcactggtgatacctccaggtactggcaaatccaagtctactagaaactggagcagacccccagaataccacaacagccctatggaaaaggggccagactgttaaagaaaaaaaaaaaaaaacccaccaccaaaaggtcagcaacctcaaagattgaaagtagataatttcacaaagatgagaaataataataatcagcagaagaaccctgaaacctcaaaaagctagagtgccctctttcctctaaatgagtgcatcacctcttcaacaagggttcggaactgggctgaggctgagactgagatgtctgaaatgacagaaggagaattcagaatatggataggaatgaagttcactgagctaaaggagtacattgtaacccaatgcaaggaagctaaaaattatgataaagcattgccggagctgacagacaaaatagatagtatagagaagaacataaccaacctgatagagctgaaaaatacactacaagactttcataatgcagtcacagctattgattgccaaatagaccaagtggaggaaagactctcagagcttgaagactggctttctgaaataagacaggcagacaagaacagagaaaaaaagaatgaaaaggaatgaacaaaccctttgagaaatatgggattatgtaaagagactgaatctgcaaccgattgatgtacctgaaagagatgaggagaatggaaccaatttagaaaacatatttcaggatatcatccatgagaacttctccagcctagcttgagaggccaacattcaaatttcaggaaatgcagaggataccactaagatactctacgataagatcatccccaagacacataatcattagattatccaaggtctaaatgaaagaaaaaatgttacaggcagctagagagaaaggccaggtcacctaaaaagggaggcccatcagactaacagcagacctctcacttgaaaccctgtaagctagaagacattgggggccaatattcaacattctctctctttttttttttaacattcaacaatcttaaagaaaacaaattccaacctagaatttcatatctggccgaactaagcttcataagtgaaagagaaataagatcctttccagacaagcaaatgctgagggagcttgttaccaccagagctgcctcacaagagctcctgaaagaagcactaaatgtggaaaggaaagactgttaccagccactacaaaaacacactgaattacacagtctgtacacagcccagtgacattatacagcaccacataaacaagtctgcaaacataatgatgacaggttgaaatccacagatatcaatacaaactttacatgtaaatgggctaaatgccccaattaaaagacacacagtggcaagctaaacatcaaagacccattggtatgctgtcttcaagagaactatctcacatgcagtgacatacacaggctcaaaaataaagggatggaggaaaatctaccaaggatatggaaaacagaaaaagtagaggttgcaatcctagtttctgacaaaacagactttacccaatgaagatcaaaaaacaaaacaaaacaaaaatccgcatcgcataatggtaaagggttcagttggacaagaagatctaactatcctaaatatttatgcacccaacacaggaggacccagattcataaaacaagttcttagagaccttcaaagagacttagactctcacacaataacagtgggagactttaataacccactgacaacattagatcactggcacagagaattaacacagatattcaggacctgaaatcatcactggatcaaatggacctaatagatatctacagaactctccaactcaaaacaatagaatatacgttctcatcactacatggcacttagtctaaaattgatcacgtaatcagaagtgaaacactcctcagcaaatggaaaataactgcaattataacaaacagcctcttggaccatagcacaatcaaatttgaaatcaagactaagaaattcactgaaaaccatataattacatggaaattgaataacctgatcctgaatgactttggggtaaataataaaatttaggcagaaatcaagaagttcattgaaactaatgagaacaaagatacaatgtaccagaatctctgggacacagctaaagcagtggtaagaggtaaatttatagcattagatgtccacatcagagtgatacaaagatctctagttaacagcctaacatcacaactaaaagaactagagaaccaagagcaaacaaatccagaagctagtagaagacaagaaataaccaaaatcagagcttaactgaaggagatagaaacatgaaaaaccattcaaacgatcactccatccaggagctgttttgttttttttttgaaaaaaaataagtaaataaaatagactgctagttagactaataaagaaggaaagagaagattaaaataaacacaatcagaaatgacaagagggatattaccactgaccccatagaaatgcaaacaactatcagagaataggatgaacacttctttgcacacaaaccagaaaccctagaagaaatggataaattcctggacacatacaccctcccaagactgaattaggaagaaactgaatcccttaacagaccaatagcaggttccgaaattgaggcattaatagatagtctaccaactgataaaagtccaggaccagagggattcacagctgaattctaccagttgtacaaagaagagctggtaccattcctactgaaaatgttccaaaaaattgaaaacaagggattcatccttaactcattctgtgaggccagcattatcctgataccaaaacctggcagagatacaacaaaaaagaaaacttcaggccaatatcctcaacacaaaaatcctcaagaaaatactggcaagccaaatccagcaagcacatcaaaaagttaatccaccatgatcaagtaggctttatatctgggatgcaaggttggttcagcatacacaaatcaataaatgtgattcatcacataaacagaactaaagacaaaaaccacatgattatctcaatggatgcataaaaggctttcaataaaattcagcattgatttatgttaaaaactctcagtaacctaggtatcaaaggaatataccacaaaataataaaaaccatctataacaaagccactgacaacattatactgaatgggcaaaagctaaaaacactccccttgataaccagcacaagacaaggatgccctctgtcacaactcttattcaacgtagtattggacgtctcggccagagcaatcagtgaagagagaaaaaataaagcacctccacataggaggagaggaagtcaaattatccctgttagcagatgacatgatcctttatctagaaaaccctagtctcagctcaaaagctttttaagctgataagaaacttcagcaaagtctcaggatacaaaatcagtgtgcaaaattcactagcattcctgtacaccaacagtcaagccgaaagccaaatcaggaatgaactcccattcacaattgccacaaaaagaataaaatatctaggaatatagctaatgactgacgtgaaagatctctgcaataagaatcgcaaaacactgctcaaagaaatcggagatgacacaaacaaagggagaaacattccatgctcatggacaggaagaatcaatattgttaaaatggccttattgcccaaagcaatttatagattcagtgccattcctattaaactaccattgacattatttatagaactagaaactattttaaaattcatatggaacctacaaagatcttgaatagccaaggcaatcctaagcaaaaagaacaaagtaggaggcatcatgctacctgacttcaagctatatactacaggactacagtaaccaaaaccacatggtactggtacaaaaatagacacgtagaccaatggaacagaatagagagcccagtaataagtctgcacacctataactatctgatcattgacaaacctgactaaaacaagcaatggaggaaggagtcactattcaataaattgtgccgggataaatgactagccatatgcagaagtttgaaactggaaccttttcttacaccatatacaaaaatcaactgaagaaggattaaagacttaaatgtaaaatccaaaactataaaaaccctagaagaaaacctaggcaatatcattcaggatataggcatgggcaaagattttattatgaagatgccaaaagcaatagtgacagaagcaaaaattgacaaatggaatctaattaaactaaagaggttttgcacagcaaaataagctatcaaaagactaaacagacaacctacagaatgggagacaattttggcaagacatgcatctgacaaaggtcgacatccagcatctataaggtacttaaacaaatttacaagaataaaaacaaacaaccctattaaaaagtgggtaaaggacatcaacagatacttttccaaagaagacatacatgtgaccaataatcaaatgaaaaaaaaatcaacatcactggtcattagagtaatgcaaatcaaaactacaatgagataccatgtcacaccagtcagaatggctattattaaaaagtcaaaaaatacctgatgctggcaaggttgtggagaaaaaggaacacttatgcactgttggtgggagtgtaaattagtttagccactgtggaagacaatgtggcaatttctcagagacctaaaacagaaataccattcaactcaacaatcccattactggatatatactgaaaggagtataaatcaatctattataaagacacattcatgtgtatgttcattgcagcactattcacaatagcaaagacagaatgatagactggataaagaaaatgtggtatatatacaccatggaatactattcaaccataaaaaatgagatcctctcctttgcaggaacatggatggagctggaggccattatccttagcaaactaacacaggagcagaaaaccaaatactaaatactgcatgttctcacttataagtgggagctaaattatgagaacacatggacacatagagggaacagcacatactggcgcatttcagaaggtggagggtaggaggagggagaggatcagcaaaaataactaatgggtacttggcttagtacctgaatgatgaaataatctgtaaaacaaaccctcatgacacaaatttacctacgtaaaaaacctacaattgttcccttgaacttaaaataaaagttaaaaaaaaaaagaaatggaatagcaaggaaaaaataacaacatacaatggaaggacaggaatagaatatatattcctattctaaaatggagaaataggcaggaagggttagttgtttcaaataattcccaaacccagcagggaaaacatcattaaatttaaagctggagaataatctcctttgactccatgtctcacttcttggatacactgaggttgggattgggcccccaaggtcccagaacgttctgcctctatggcttttctgggcccagtctacccagcagctctcacaatttggagtctcatgcctgtagctttcccagtatggagttgcccacttgtggccccatagttcttgattctctgaggttgcctttctcccatggctcctctagtcattgccctagtagtctctctgtggtggctccacccctgtgacaagtttctaattaagcccccaggcagtccacaacatcctttgaaatataagtggaggaagccatctctacacagctcctgccttccacacacctgaacaattagcgtcacatggatgctgctaacatgtatggcttgtacgttctggagcaacaggttgagctgcacctgagctcacttgggccacagctgggttggccaggggacactgtgctggaatgtggggagaatagacccaaggcatccttaggcagagagtccatggaagatgccctaagcccttcacccaaaaccattctgccccactggtgctcttggactttgatgagaggggcagcctcaaagatcttcgagatctttgaaatgccttcaggatatttctcccattgtcttgacaagtagcacctgctcccttcatttatgataatctctttagcaaatggttgcttggcaatacctttgatttgctctcctaaacacaccttttctcctactgtaggagatagcttaaaacacacacacacacacacacacacacacacacacacacacacaaacaccccttttcactctttacatggccaggttgcaaattttccaaacttttctgttctgcttctctattttaattataaattttatctttaagtaatttcttttctcttacatctcactgtatgtggttaaaagttgccaagcaatagcttgaatgctatactgcttagatatttcttcagccagattcaccactcttaaattatgcattctataaagttctaggacacgtgcacaatcctgccaagttttttaaaattatataacaaggatggtctttactccagtttccagtactttgtttctcatttctctctgagacatcctcagaagggtctttactttccctatttctgtcaacattctgatcataatcacttaagtaatctctaagaagatttgaacttctcctatagctctcctcttcttttgagccttcaccagaatcccccttaacattctattcacagccatctaggctttctctagcctgttcctccaaattgttccagcctctgcccattacccagttccaaagctacttccacagttttaggaatttgttataacaacattcccgtctttattacccattttctgtttttatttgttttctgttgttaaagtaaactactacagactgggtcatttataaagaatagaagtttaagccaggcgcgatggctcacgcctgtaatcccagcactttgggaggccaaggtgggtggatcacctgagatcaggagtttgagaccagcctggccaacatggtgaaaccctgtctctactaaaaatatacaaaaattagccaagcattgtggcacacacctgtaataccagctacttgggaggctgaggcaggagaatcacttgaacctgggaggcagaggttgcagtgagctgagatcatgctactgcactccagcctgggtgacagagcaataatctgtctaaaaaaaaaatagaatagaagcttatttggctcagggttctgcaatctgtgaagtcaaagattgagtggctgcatcttgtgaggaccttcttgctgagtcaaaaaatggcagaaagcatctgccttagtccattttgtgttgctatatggaatacctgaggctggttaatttgtaaagaaaagaggtttatttggctcagagttctgcctgaacaagaagcatggcactggtatctacatctggtgaaggtctcagagtgcttccactcatggaagaagcagcagaacaggcgtctgcagagatcacatggtgagagaggaaggaagagaaggggaagaggtgccaggctatttataacaaccagctctcttgggaaccagtagagtaataactcaccccccagggacagcattactctattcaagagggatctacttccataccccaaataccttctactaggccccatcttacaacaccaccatactggggatgaaattttaatatgagatttagtggggacaaacaaaccatacccaaactatagcagcatcacatgctgagaaaacgtgtgtgtgagacagagaaaggaaattgggccaaactcatccttttatcaggagcacacttctgccttaagtaacccattcctgttataacagcattagttcatttatggggccatagcacacatgacataatcacctcttaaagtttccacctcttaataccatcacaatggcaattaaatttcagtattggttttagaggggatattgaaactattgtactctccatttaagttcttatcacttcctgctaaaaattaaaggattttgtcttcccatagagggaatgtcctgtgtctttttcctggcacgtagtaggtgcccaatacatgtttctgaattgaagaccacaatgctactgttttataaagcagatggcgggggaggggtgcatacaaagtaaatggaaccttctgatacctctcaatgcaaaaaaaaaaaatacttctaataattggaaatattgactgttccacaccattgttaagggcatgttagccttactagtaagtggctttcacagaatgtgttgcacaataagatctgtctcttgagtgctgttttaccttaatggagatttttttttttttttttttgagacggagtctcgctctgtcgcccaggctggagtgcagtggcgcgatctcggctcactgcaagctccgcctcccgggttcacgccattctcccgcctcagcctctcgagtagctgggactacaggcgcccgccaccacgcccggctaattttttttgtatttttagtagagacggggtttcaccgtgttagccaggatggtctcgatctcctgacctcgtgatccgcccgcctcggcctcccaaagtgctgggattacaggcgtgaccaccgcgcccggcccttaatggagattttaaaatgcagagtgagcaatagattcattagttaatcgaggcaactagcctccacatagaatttttttgcaagttactttgggttaaagacatttgggttgctgattgtattttcctgtatttttaattctgagctgtgagagtccattcatatatatcgttttctcctagtgccttctgccgattgcaattacctataatgtaaaccactgtacatgatattctgaaggtccttgagaatttgtcgtcaccagtgtattcatgagggaacattccactagaattaaaacaaagaactcgtagctgaacaaacccgggttttaaccccacctctgccacttattagctgtgtgattggaggaaaacaagcataaaatagagacaatgataagattcaacttacagagttgtcttgaggattgattaagcatagtgcctataacatagcaagtaatcaataaagggaaattatttttattacctttgtttatgattatgatgatttagctctgagtgattcttttaacttatcttgccatccttaagcttatacagtcattgacatgtaaaaatgggccttcagagtcctcatctgtttttagccactcgcaaactgctcactgggacctatcttatactttgcttctagaatgattcctgagtttcacatattctgttcctaacacttaataaattctagctattctaactattgttaaaattgcctttacagcagcatttcctaatatgttacccaaatgaaatactcacctaggaaagttcccaagagtaaaaactatttgagaaacaggtactagccataaccctgccctggaaattttcactgtacattagaatattaaataatctaaacagtcctatatgatttattttatgtatataaaatcatttccacagttacaaagtactgcctccccccatgaaagctcttctgtgctgctgtcttaatttctatattcaggaccctcaacattctttcactctctttctacttcaggagtgtccctcaatacgcaagggcatgaagttgcaatcactgggatccagccacagcaccgcagaacaacctgatctgttcattagaagtttccagggagttgcttctcaatgcctttttctatcttggatacaaactcttctagcattagaacatgctctggtagctggcagacttttcctttgataccattgaatcttaaaatgtagccaatggaacaggaagtggaatctatatagaggcggctatgtgccataaatgctcccccatgttacaattcctgatgttacaagccttatggcttgtctttcagtttactgtgctttaatatacctgtgtaccagtgtagtgccataagatccttgttggaataaaagttacttaaggtatgtagctattgagctaggatctcttgggtcataagtaaatgccactttattactatttgagtatttggatttataaagaggtaaatgggagtgattattcaatttgctaatagatccactgaaagattgctttgtaatgctgttccaaagtatatttaaataagcattgattcatatgcacctttctaagatcaaaccattttattagataaaataagggattaccttatttgattccatcccttagcagcattcttaggatctgattttctgtttccgtttagtcggcagatcatgaagaggctttcataactggaatatatattgtgaaatattaccatgtagatctttcctttaccacttgagaaatgcatactttaaacatgtgtttctgtgttttatattctgtggaaagatatcataatttggtttcactttggatagattttgtttgaaaattataaatgacttttatggaaatgagttaggaatttaaggggtgtgccaaattttaggccacctgggtgccattagtatattgtagacatatgttgtctaatggaattcacttagcctaaaagaattaagaggtttccggaaatagcaataacctaatgcattgggcaaggcatcctaaaactagagttacagcaccatggcacatggttctgtggaaaatagcacatccaaatatttcagaaaggatagatgtaatgatcttctagaaaggatctttatgaatcagaaagctgagctgatggtgactgagagcatagatggctattcaatccagaaaagtttttctgtcagatgctatctctgaatgcccttgcccacattgtgagacccataattggaggtctagacgtcctcataggttgtcccagtgtagctgaactatttctttattgcctaaggagttagaaactccctatttaagaagccatgtaattaaccatcctagggtgagttttgctgccaccacagaaccaagtatagtgcagaattttgtacactattggtaggaagcctaaaattccatttttgtcatactgccactgaaaaaactatcagcttatcttcatgagctaagagtgaggctgcctattaatatcatttgcttacatatttaacatattatatgctagtcgctgcactttaaatacatgattccatttactgctcattttgcgaatgagaaaactgaggcttagaaaggtaacttgcctgaggtcacacagcttgtaagtagcagaacagagactcaaacccaggcaatcagagtccagaggtcaagttcttaactatagcagttcattttcagagggtctgtgtgcttatcatgggggcctggaaaagtaaagaatgaaagagttgctttttcctttgaagtaaaagcaagagaaagcactgagttatttttatgtagctgcacattatggacgactattatgtgccaggtaccaataataagtctttatacacattatttttgtaatcgccataagaatatcatgagtttgatcttaatgtttgtccttaatttcaggatgagaaatggagatgtggagtatgaatttgtgtttacttgcccaaggtcacctggctagtaaattggagctggaatttgaacccagatttgtctgactccaaagacaatgctctttaactattatgtatacatttccccagtaagcaactcctaaaacattgaaactgtcacaacctgtatggggatttctcacaactaagatgtcacagtgataggtaagaggaagagaagatcagtgtaataacagcccaaacatcccgtagccttattcagtgatcctagagtcatcctctttaaaggaacacttttctcatgtccttggtcctgtatgcataaaaaatgtattggaagctacctgtgtagtggaggaaatgcccagaggagaaaatggttgagcatgaatattgttcttacgcacgaattgaacagggcatataattcccttgaagcagaaagacattgttccttttccttaggggccatgaaactatagctaagtgaaggaaaaggaggtgagttagagactttgtaacatagaaaatcctagccgtgcccaatcacttttcttcaaagaccaaatgttaacatatcatgggctctttgaatatacttagaaggaatataggcaaaatttagtaaaatttggcctgtatttatggccaatatcatatatagctccacttaaaatgtactttttatctttaagactaacatattactgtcattatatatgttcagttatcccttaacttttgacctgcattaggtcagttttgaacaaaaagtatcgtagttggtcaggttctaattttttaggttatttaaaaagaataattctccctatttgctctttgccctgacaagtgagtaggtcaagtgcatttaggatacagctttgccactgaagtcaccacatcagtcattcagtcatgtatcttattgttttcttctttcatcttccacagcagatgtcctaaacctctgcaactgggctcaagcctttgccccatctgaagcctactcatcagatgaactgtcttgactttgcagatgaaagtccaggggaattcccttagcttccctcttctgcaccttcaaacttaccccatttgtagtcagcctccatcccattccccatcttagagaaaatgtctttcttcctgtgccaagttaatcctcctttcctttttggtatgtgctgtggatcacattcttcctgccccttcaattaccttgatctcaatcagtcttccctctcttacatttctagcttcttccttctcacttcattgactatgctgtctttcaaaatataaatatgctcagataaaggagctctagagactggatgactattggtgctaattggcagggataggacatgcaagaaaatgagttacaggttcactcacatgcttcacctattccctatataaaaataatccatcagtttaatgttctgatctcttaaatggatataataatatgggcatggtatggttcttttgaggatccgatgaaacagtgcatgtcacctcactgaacaatatgtatcaccaaacatagaaactagcacctagtaagtgctcagaaatgataacaattgcagtcatggtgttatttacagtacttatagtagtaatagcaggagtaattgtataggggaattgaactgaaatagattcaaggtgccccttgcttctaaaagtagaagcttgaatcccattgttgcaggacttttccttagctcagctacagatagggttcttgtcacatagccatgaaagattaggcttgcagacaatttgaagggtgagtaaggcagggttttattgggtaaaaaggaaaaaaaaggggaaacagaaactcttagtgaagtgagagagtgtgtttatcctgccagcgggcttcccaacttacagattgaattctgggttccacccagaaagaggagaggccaggctcctccctgctgcaaactgtgaacttctgtggccccaccctatcatgcactcctcctagtgcgcaggcgggctggagtctctctggggactccttcccacctagctatctcaccatagccccactgcccaatcctttttcacagtgtttaatatattacaactgtatctcaaccctctatcatctcctctcaaagcttctcttgttccagacacattggaccacttgacaatccccaaatcaggaggctgtgaactttcacgcctcctgactctgttcatgctgttccttcagtcttccccgcctttcccccttctccataacacctcgaatgatgttctctgatatgtgacactttcctcatctccacactactctgtgcagtgttggttatcccacagtctctatatgtactgtaccacactgtatgttcatagctgacttggttttccatttgctacacttggaactcccagaggacaaggatgagttcagcttggtatctccactgcctaggcattcagtaaaagcataatgattgtggtaatggacaacttctgtggcaccatgacactgcctgccaggtaaggaactgcatggccagtttaacaaaaattttgattacattattagagattctttatttttgaaattttagagcagttaaatagcaatgtcactttcctaaaatttcggattcctgtatctgttgcccttctttcaagcctgcagctctttgtaagtttcagtaataactctgtccacttgcccttccaagtttaagtgtgataacaactttatactcttgctcatccctgggagcttcaccacctcataagggttttgtgagtgctatctatacttctttaaatggtccctttattaaacactcttcagttattcccttgagtgtgctatctattttctgcaaggacactgcccatatgaaatgacccttctctttcagtgaacccaggtagcttttggtaatttgtttccatcaggttattgactgcccctgaggtgtctcgaaagatttctatcccattatctataactgtagtctgggaaagttgttgacaatccgtagcattactatgtgcaacaatgtaaaggtaagaaattgctttgactctcttactgtgaagaatatagtgctacaacctgtcctcatttctgcaggaggagataaacagaggccttctgtatgctttagaatgattgattctaaccaagcatagaaatcctgggcagaggaaaaaccacatttcttgacttgatcttgatcttttaggtcacttctaaacctgaggttgatcttgatttggtgtgtaatcatatcatgtcatcatcatcagatattttgtacctctcatatgtgaggacctataatgctagacacaaaaatgcagggtatgagccttggttctccttcccatattgaagaaactaggctatgggagaataatttgattatttttctttttaaaaggcttgaaattaactttctcttatactcttcctcctgtcattcaattttatcgccattgatccctccactctgttccatgtatttagtcacagaaccatagaaatctcttttaaagcaggattattcaatagaaacataatgtaagccacatgtgtaattttacattttctagtagtcacatttaaaaactaaaaagaaactggtgaacgtaattttgatcatgtatcttatttaacccaatatgtccaaaatattatttcaacatttaatcattataaaaatatttagtgaaatagtgtactttctaaatacgaagtcttcaaaatcttgtatagattttgtacttaaagtacatctcaatgcagatactaactactcatcagaaatattttgtatttcaatttcatcacatttatagctgaaaaagtagattgacattgcccaagtcgttccaggcatactcaaaagttttctgataactgaaccacgtacaggtttttgtatcgaaataaaagtttattaaaattttaaacaagttaaacattcagttgctcggtcacattagctacattttaggtgttcaagagccttatgttgctagtggacaccatcttggacaatgcagttataagctatctctagaatgtatctccttttttcacttcactaataaagcctaagatgaaggctttaccattggctgtttggcctattaccacattctcctatctagcctctttgtctttcattttctgccagcttacctcaggctgtcatgctccctgattcctgaggcattttggtaaatcacatatctggtcacataattttactgcttaagaattctttactgcccactgttgagtgaaatgcaatgcccaattttctgaatatgacttgctggaccctctctgagctggtccctgacaagcttcctagtgtcttagtctgccacccctcatgtatttccctgtactttaaatgcactggactattctccattatctaggagcaccatgcacaaacaaccttccacaaattcactctcactaatgtctcccaaattttgcactttcttcagaacccagatcaaatgccatttactataagaagctttccacaagcccttctatcagacagtggtaactttcccatgtatctctcaaataaaatactttttccactgcgttaccttcagatgtaagttgatttgtctcacgaactagtctgtgagctcagagcagaggttagcaaactatagcccgtgagccaaattgtgtgttttaattaatataggttttttttggagcacacctatgctcattcatttacatattatctattgctgctgtcatgctgcagtggcagaattgaatagttccaacagaaacttaatgaccccaaacccaaaatattgattatcttgccttttgcagaaaaagtttggctacctatgtcctagaggatgaggacactgtcttatgcatcctcagtgctaagcattgcactaggtacatgcaagttttcagtacatgtttgtggaatcgaacaatagataaattgaatcaaattgaattgatgagttttatgaaagttgatgtttctgtctgtaattggtaagttatttgaggacaggaatggttcttgctatttctttagaatgccttatgatatttaccttattgttagttactttataactgttcacttaaataaaagaatttttgtttttccaccttcattctttttgtttaatactatgtaccacctaccattttttctgtaatttctatttgattttacttgtttctcaaggatgcaaatggattaaatcctgagaagttgagtgcctccaatacacaattacataatggaagctgtgaactcaagtcttggcttgatctttggtctaattggctgcttcagataagccacttggcctaacttgttgtttttttctgaatcttcagtgcaaatcacaatattccaccttcaagttattgtttgaagtacatgtgaatgtgatatgcagttccataataagtattatgaacataatttttttaaataaagaaggtatttttctccactaaaaatggagaaataaacattatatgtgctgattttaaacattacttagagtcagcctccattattgaaagttttctgttttgggtaagaaactggtggccaccaatacttccatattaacaccaaaagaccatttggccatcccttttaatgtcatatttaaaaagcggaattctgaaagcaaacctgggaaatggcttccacacttgagccatacatttatgaatggagaacttgaagaacaagagcatacaaatctcagagaaggatctggaggctttatgatatgaaagcaaaaagtacaagagctgtcactggggagttccatttctataaggactttctatgtactagtagctagaagcattcattattcactccaacctccagccttatagtttatgtttctagcttgccttttctcagaattcttaggttaatgacagattctagttactgagcactactatataccatttatatattttgtttatataattgatatcttgtcctaaaaaaaccccactgaggtaggtattaatatttttaatttacagaaaaggatattgagcctcaaaaaggctacataagaagtaagtagcagatctgggttttctacctaagtctctagagcccatactcttaactaccatacaaactgtaagattttctgagattaaagcaatggggcttccgaaaaaaaagtttccatatggtgctttgaaatattctacctttttcctctgaagaatgaagtcctagagctgggagaggccagagaagtcacctgttaagaggctgaatgacttgcccaagttaacttagcaaaattagtggcccatacaattctctagcctcctgacacctggtctactgctctgtatactacatttcaatccacatttctggataaaaatagccaagtgcatacccattttatttttattttaaaattcatttaaagaaaagtatttctgctttgagaaaatgaaagaaaaaaaatgacagccctcccaaagtaaactaaggatgattcttttttaccaaatctttagggaatccagccagagatgccagcacataccgaattgcttgtttaagagttctgctgctgacagtctggggtgctgtgagcaaatctctaaatttctctgagccttaattctcatctgtaaaatgaagaacttgaactagatgaaatataaagtcctttctagcatatgagtgtgtgtgtgtgtgtgtgtgtgtgtgtgtgtgtgtgtgtgtgtgtctgtgcatatatatatccttatataactttaggagtatgattagataactttaggagtatgattaggaggtgccaggaccaattgaaggagatagatttgggctcaaataagaaattccttcgtatggacatagccttccttaagtagactgagataccgtaagtagtggtgaatttcctgtcattgaagttattcaagtagaaatggatagcaacttgttggaaatgtcatagtagtcattcagacattaaattgatgattgggttacaattatgattaatgttattccatacttcacactctgagaaatcaaatatgtagaaatctctaagcacaaccacaaattttaaccctgtgctcaactacacactcattcaacagtcgattattgagtacctttgaggattctaggtactgtgctagaactggagatgtcaagacttaggacattgcctctgtcttgagtgttacagaccaggagtgtgcaaactgtggcccaaaagcctgatctcacccactgtatgttttggtaataatagtttactggaacgcatccatacttattcactttcatattatctatggctacatttacgttacaacagaattgagcagttgcaacagagaccatatggcccacaaaacccaaagtatttactatgtgattctttataacaaaagtttgccaggccttgttgtagataaacatgtacatctgtaacttcaatccagtgacctaagtgggaaactggagaaaacataaaggcagcacatatgattacttcttcttgaacaaggatcagaaatttttcagaggaattaaaccatatcattgtgctgtctttgagtgggaagagacattacaggttataactgtcttcattttccatcagtatctctgcatattgcccctatagcattcatgacacaccactgacattttcttaaaaaggagagcatacatgcaccctacagataagtggcaaaattatataaagtttagcctgccaatttatgcaggagtgacagcaacatccataggttgcctttgcattctaaaataaattaagaaccagttatgttcatgttactgttttaatttaaaaccaaacaatttcagggtctttatctggttcatgctgaggacatcaatctataggaaactcttcaggaaataaaggactagggtccatcctccttcccatacagagggatggaagcccagtgtctgtggccattgttgttaccacaaggcggtatacctaagtcctattaagcaggactcacaagttctcaataatcagttttagggcagatatggaaaaataaccataataatcacatttgccctcctatcattgcagggcctcctgaagtgctatccacacagttgaaattctcaagataaatgttgttgactgattgactgtattcttccaaatttactaccaatctggagaggactacaacagtgtgattaatgatttgtaaaatattcttttcacttacatattcaaagccttaatcctctaattatttttaaaatgcaatgtgagatggatactatgacaataggggtcctgaatgctctcctaataagcagatgaaggtctccttagagcagggatgtcccatcttttggcttccctgggccatattggaagaagaagaattgtctttgagccacacttaaaataccctaacagtaacaatagctgatgaggtttaaaaaaattgcaaaaaaggtctcataatgttttaagaaagtttatgaatttgtgttgggccacattcgaagctgtcctgggcctcatgcggcccatgggccatgggttggacaagcttgccttagagaaaaacaaatcatttgttaaagttttaattttgacatgatttcagacttccagaaaagtcacaaaaacagtactctatagtacatcagtttcctattttttgcaattacaagaaatgctgcaataagtagccttgtgcttacatattttcatattgttggtgatacattttcaggataaattctgatgagtgcgattgctgggtcaaaatacatatatttttgttaaatattgccaaattcccttcagaaattttatatttctaccagcaataggaattgtgcctgtttcttcacagcctcacctacagagtaggttgcactatttaatttttgcctgataggtgagaactagttatcagtgtagttttaatttacatgtccttttttatgagtaagggtgaatattttttcataaacgtaaaagccattttaatatctcttgtgacttattttcatatttttgatcattgttctatctgagatttgtttttttatccccttgaattttaagaattctttgcatattagaggtattagccatttatctgttatatgtgtttcaattattcctcctcttttgccagttatcttttgatttctttatggtttctttatggtatcttttgatttctttatggtaattttgggcatgcattaggtttttggttgttgctatgtagtcagatttaacaatcatttgttttattgtacctggatttggagttctaattaggagaactctttctacacccagtttaagaagaattcacccatgttttctcctagtgtttgtttggttttattgaacaattagatccctgatccatttggaatttatttttatttttactttttttcttcttttttttttaaattatactttaagttttagggtacatgtgcacattgtgcaggttagttacatatgtatacatgtgccatgctggtaatcatggatgtaatgtatcttttcctaaatggtgtccattgttgcagtatcatttgaaaactccatcttctctaaagttatttgagatgtcacctttattatatactaaagttccatattttcttatgtctatttctgaactttctactctatttaactgggctctattgatgtgtcagtaccacacctgcattttttttcattttttcccgcagctttttttggatataattgaccaataaaaattttacgtatttacaatgtacggtgtgacattttgatatatgtatacattgtgaaatgattacgtcaagctaattaacatatgtattaccttatatacttattttttgtggtaagaacatgtaagttttactttcttagcactttttaagtatacaatgtagtattattaactataatcatcatgctatatgtaagattctttgaacttatttctcctatctaatccaaactctgtactctttaaccaaccccatcacccctccccagcccctggcaaccagcattctactctctgcttctatgagtttgacatttttagatttcatatataagtgatatcaagcagtattcatctttctgtgtctagcttatttaacttaacatgatgccctccaggttcacccatgttgctgcaaatgacaggaattcattttattttaacactgattattgtttcattgtgtatatagaccacattttatgtatccattcacccactgatggacacttaggttgattccatatcttgagtattgtaaataacgctgcaatgaacatgagagtgcaagtatctctttggcatactggttttatttttttaacgtgtatccagaaatggaattactggatcatatgatagttctatttttaattttttgagcaacctccatactgttttccatgatagctgtactaatttacattcccactgaatgagaacacaatgatattccctacatcctccccaacacttgttatcttgtgataatagtcattctaagaggtatcaagtagtatctcattatgattttaatttgcatttccctgataattaggatgtcgagcattttttcttatacctgttggccatttgtatgccttcttttgggaaatgtctacttaagtgctttgctcattttttcttttggttatttgttttcttgctattgagttgtttgagttccttatatattttgtatactaatcccttaaatgtatggtttgaaatttttttttccattccataggttatctcttcactctgttcattgtttcttttgctgtgcagaagctatttagtttgatgcaatcccaacaccctttaaattatagatgatttatagtatgttttactgtctagtagggctagtacctgctcatagtttatcattttttgtgtgtttcactggctattgttaatttttccatgtgaggttcagtgacaacttgtctaattctaaaaataacttattgttatttttattgggattatattaaatttatgaattaatttacatatttatactattgagtcatcctatcaaaaaacaagaaatgtctttctatttcttcaagtctactttcctttcctttatggatggagaaaatgtaaattaagaaaaatatagttttgggattttgaatttatacaggatgtgaaaagtatatttaacaagcagaacatgtgcatatgtaacaagcagagaagaacaaattttctccactgccattctaattatattccaagatagaaatgtcctagtccttcctttattcattcatatattctcattggtgactccactgaagccagaaaacatacttaccaaaaccaatgagaatactcataagagatgacagtcatgactgataatactcaaaattcaaaaccatcttaacagtctggaatgatcaacctaaactcaacaagtggagaaaattctgcactgagtcttaaaagtggaattgcataggtgaaagtcaggaaaaagttgcttcaactgcattacttttgacatctggaggaggtatctagattgactgcaaacttaacagagcacggtatttcactgtagcaactgttaaaatggtatgtttatccaagcttcattaaatgggtatcagtagcacatcattgccctagagggtggatcaagaagcagcagaaaagtaaaacaaggaggcaggtgttgtttcaacttggatttcctagtaaagtttatttgaccaaagaatttgagggagagaagaaagagagggagaattagaatgaaggaatggacaatcatagagcaacaacaaaagcagagagctcagttaggaagctgttggtgcagtaataagcagagtatgaggtgctctggctagactccgcaatgatagtggagattatgaaaagttatcagcattgtggaagacagtatggtgattcctcaaagacctagaaccagaaataccatttgacccagcaatcccattactgggtatatactcaaaggaatataaatcattctactataaagacacatgaacatgtatgtttattgcaacactatttaaatgcccatcagtgatagactggattaagaaaatgtggcacatatacaccatgaaatactatgcagccataaaagggaatgtgatcatgtcctttgcagggatgtggctgaagctggaagccatcattctcagcaaactaacacaggaacagaaaaccaaacactgcatgttctcactcataagtgggagatgaacactgagaacacatggacacagataggggaacaatacacgccagggcctgttacagggtggggttgaggggagggaacttagaagacgggtcaataggtacagcaaaacaccatggcacacgtatacctatgtaacaaacctggaaacccgcacgttctgcacatgtatcccattttttttagaagaaatttttttaaaatccaaaaaatttttaaaaagaaaatgttacaaatcttattcatgtaaaaacatgtgtaactatatttcccaacttttctacatatggaatgtattatcacattggtctaaaatcaaggtataaccaagatcatcaggaatggagaggtaggaagtggtataagagccataaattctcctttttccatagtgagacattaacagataccatcaaaagtggaaaaatttggaggtaaaccacttaaaaagtttaaatgataactagatgatgaaccaaaaaccaaagactattcaaaacaagtgcctcatatccaagagaaatgaaaacatgtccacacaaaatcttgtacatgaatgttcatagcaccattgttaataatagcttaaaagtggaaatgactcaaagttcatcacctgatgaatgggtaaagataatgtgggctgtctgtactactattatgataaaaactgaaatattatgcatgccgcaaatggataaactttgaaaacattatgctaagtgaaaggaaccaatcacaaaagaccacatgttgtatgattccacttatgtgaaatgttttagaataggcaaatctagagacagatggtaggttagtgcttgcaggggctgggaggaggagggatggagagtgattgctaatgggtatggggtttctttttggggtgttgaaaacattctaaaattgattgtggtgatggttgcaaaccttgtcaacacattaaaaaccactgaactgtaaaaaaaaaaaagaaagtggttggatttgtaatatattttataggtagaattaatgagatgtaatgatggattggattggggatgagggaacgacaaaaataaagggtaaagtttagtttttgtgattgaacaacctggtggatggtggtgtcatttactaacataggaaatactggagggaaagtaggatagggtacaggtgggactggaaatctagagtcctgttatagtcatgtccattttgagatgtagaagtttgacatagagctacacagttaattactatacagtgtctatcttaaaagagcccctagtcttgttacagaggcagaaaactatttttttattcttttttattattattatactttaaattctagggtacatgtgcacaatgtgcaggtttgttacatatggatacgtgcgccatgttggtgtgctgcacccattaactcgtcatttacattaggtatatctcctaatgctatccctccacactccccccaccccacaacaggccccggtttgtgatgttccccttcctgtgtccgagtgttctcattgttcagttcccacctacaagtgagaacatgtggtgtttggttttttgtccttgggatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgtaataaacatatgtgtgcatgtgtctttatagcagcatgatttataatcctttgagtatatacccagtaatgggatggctgcgtcaaatggtatttctagttctagatccttaaggaatcgccacactgtcttccacaatggttgaactagtttacagtcccaccaacagtgtaaaactgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataagtgtcttcttctgagcagtgtctgttcatatccttcatccacttgttgatggggttgtttgattttttcctgtaaacttgtttaagttctttgtagattctggatattagccctttgtcagatgggtagattgtaaacattttgtcccattctgtaggttgccagttcactctgatggtagtttctttagctgtgcagaagttctttagtttcattagatcccatttgtcaattttgtcttttgttgccattacttttggtgttttagtcatgaagtctttgcgcatccctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatgcttatagatgtgtggtattatttctgagggctctgttttgttccattggtctatatctctgttttggcaccagtaccatgctgttttggttattgtagccttgtagtatagtttgaagtcaggtagcatgatgcctccagctttgttcttttggcttaggattgtcttggcaatgcaggctcttttttgtctccatatgaactttaaagtagttttttctaattctgtgaagaaagtcattggtagcttgatggggatggcattgaatctataagttaccttgggcagtatggccattttcacaatattgattcttcctatccatgagcatgggatgttcttccgtttgtttgtgtcctcttttatttcgttgagcaggggtttgtagttctccttgaagaggtccttcacatcccttgtaagttggattcctaggtattttattctctttgaagcagttgtgaatgggagttcactcatgatttggctctctgtttgtctgttattggtgtataagaatacttgtgatttttgcactttgattttgtatcctgagactttcctgaagttgcttatcagcttaaggagattttgggctgagatggggttttctaaatacacaatcatgtcatctgcaaacggggacaatttgacttcctcttttcttaattgaacaccctttatttctttctcatgcttgattgccctggccagaacttcaaacactatgttgaataggagtggtgagagaaggcctccctgccttgtgccagttttcaaagggaatgcttccaggttttgcccattcagtatgatattggctgtgggtttgtcataagtagctcttattattttgagatatgttctatcaatacctaatttattgagagtttttagcatgaagggctgtagaattttgtcgaaggccttttctgcatctattgagataatcatgtggtttttgtctttggttctgtttatgtgatggattacatttattgatttgcatatgttgaaccaggcttgcatcccagggatgaagccaacttgatcgtgatggataagctttttgatatactgctggattcggtttgccagtattttattgaagatttttgcatcaatgttcatcagggatattggtctaaaattctctttttttgttgtgtctctgccagattttggtatcaggatgatgctggcctcataaaatgagttagggaggattccctctttttctattgattggaatagtgtcagaaggaatggtaccagctcctccttgtaactctggtagaattcggctgtgaatccatcaggtcctggactttttttgtttggtaggctattaattattgcctcaatttcagagactgttattgttctattcagggattcaacttcttcctggtttagtcttgggatggtgtatgtgtccaggaatttatccatttcttctggattttctagtttatttgcatagaggtgtttatagcattctctgatggtagtttgtatttctgtggcattggtggtgatatcccctttatcattttttattgcatctatttgattcttctctcttttcttctttattagtcttgctagtgatcttgttagtgattttgttgatcttgtcaaaacccagctcctggattcattgatttttttaagggttttttgtgtctctatctccttcagttctgctctgatcttagtaatttcttgccttctgctagctttcgaatatgtttgctcttgcttctctagttctttccattgtgatgttagggtgtcaattttagatctttcctcctttcttatgcgggcatttagtgctctaaatttccctctgcacactgctttaaatgtgtcccagagattctggtatgttgtgtctttgttctcatttgtttcaaagaacatctttatttctgccttcattttattatgtacccagtagtcattcaggagcaggttgttcactttccttgcagttgagcggttttgagtgagtttcttaatcctgaattctagtttgattgcactgtggtctgagagacagtttgttataatttctgttcttttacatttgctgaggagtgctttacttccaactatgtggtcaattttagaataagtgcgatgtggtgcggagaagaatgtatattctgttgatttggggtggagagttccgtagatgtctattaggtccgcttggtgcagagctgagttcaattcctggatatccttgttaactttctgtctcgttgatctgtctaatgttgacagtggggtgttaaagtctccctttgtcattgtgtgggagtctaagtctctttgtaggtctctaaggacttgctttatgaatctgggtgctcctgtattgggtgcatatatatttaggatagttagctcttcttgttgaattgattcctttaccattatgtaatggcctttgtctcttttgatctttgttggtttaaagtctgttttatcagagactaggattgcaacccctgcttttttttgttttctatttcattggtagatcttcctccatccttttattttgagcctatgtgtgtctctgcacatgagatgggtctcctgaatacagcacactgatgggtcttgactctttatccagttttccagtctgtgtcttttaattggagcatttagcccatttacagttaatgttaatattgttatgtgtgaatttaatcctgtcattatgatgttagctgattattttgcttgttagttgatgcagtttcttcctagcatcgatagtctttacaatttggcatgtttttgcagtggctggtaccagttgttcctttccatgtttagtgcttccttcaggagctcttgtagggcaggcctggtggtgacaaaatctcttagcatttgtttgtctgtaaaggattttatttctccttcacttatgaagcttagcttcctacctccccatacatccaagctctgcttttaattgttttgtcttgagtttcacatagtgtttcagttacataaactgaaatttgctgttgtaaaacgtaaaaataatagaaaataatcattcattttttttttgctagtaacatcagttttatatcactggggcatcgactataaagcctggctgaaggcagggccggccctcaacagattacatagttagagtagggtctggttcaaggtctggtgagtctccacattcttttccttgggactattcgtggtcttctctagcttattggtggccttctccaattttgctgtagacctttttgtaaattctgcttgagtctcaacccccttcagctttttctccaccaatttgatatcctctgcgtatttacacattttcatggaatattccctctctaaggccctcagtgccttgatggcctagtccatggcttgaagtttctcctccagctgtctggctcagatcttggtcacctgagctatctctcctgagtgatctagttttcctccccagatcttctcctcatacttcatgggctggtatttgatgaacttcatccttctgtccctctcattggctacctactgagtatcttccagcttttgcagggctacagccagatgcacctgtgccagtcaagctcctcttctatctgctcaatgaggcgttttatagagaccacatttgcctcagcaacagtatccttatcttcctgttccagtttctccaagatatcattcatgaatttaaatactcttctgtgtcatctcctgtccccttcagattcttctggaggccctgctgctcctcacccagctgtttgtagcagtcttcagtttgcttctcattggctttgacttcctcgacggggttggtggcattatccttctccacctttagcgtctgaattttcttattgatagtgtccatggttacagtggtggatgggccacctggcacgcagtgaggatggggcagattttgctggctccactgactgagattcacgctcctaatatgactaaagtctttcaataagttgggagattttttttcagaattgttggctgcttctgaaacataagaaagtttatttttatgattaggtaagttatatagcagaaaaaatatgaattttaaaaggagaataaaccttcaaagttaacaacaaaaatgactagagtaagatgccactgaactaaatgattaagagaatattttggaaaactatgttattatataaggatcttattttcattaacctagttattcattaacagccatttattaaacacccatactgagtcaagtgccatgcttcatcctagggtcacaaagacgaactagatgcaagggttgtagacttttttaatcaaataataagccataccaggttttgagtagtgacccagcattcccctttctctttaggattaaaagtgggagtgaaaaaagggggagttaatcaaggggcataaagtttcatttaagcaagatgaataagatctaaagatctgctgtacaaccttgtacccatagtcaacaataatatattgtatgtgtaaaaatttgttaagagggcagatttcatgttgtgttcttactacaataaaataaaattttttgaagaaaataaatgtttttgaattggttatatcctaaaatttacagaatttaactggcctttatgcttttttgaattatgcaatttttgtttctcattccaactacttagcagatgattgattagattgtagagcctaaaatattcccccactctcacccttgacttcagattgctggagcacaggtccaatcaaatgttgcatttaaaaaaaatacaatccatgcaggcaatttaatgaaagcatcagccatttttgtagttagattccttcctaaaagtatgggtgtgcttatgtttatcacaattttctcaattcagttaatttcaaggttaatctgccaactgtctgaacatatggcaaagtattttaaatgggtttaagggaaggaaatgatgagatttcctcagacatcaatcttagcatctgatattaccttgtatatttattttccccaagttaccatatatagatgatttttgttatccgtatctgagggtatttatataaagttgaatgtgtaggaagttatacatctccaaatttgtgtttacaaaacatggataaacccaggtcaattaatatttcacctgcttaaagcatctgccttttcaatttgattcgtgtcaagaaataatttttataagatagttttatcctgaatgaatcatgataccatttagtattaactgctattatccatcttcaccctatgatcaatctgatatttcaatatttatttaaaataagatgggatcttttagaccccacattctgaaatgaagttataagactgtaaagaatctgtttctaatattaaaattgttttaatgtatagtttagtggaaaagacagtctgaaaaatcaaataatcatatgtttccaagtttaccacaacatagtacaaagaaagattgaatgtgaactgttttttaatatacttatacagcacagacttgaatcgcaaggcggccttctaaaaataggacgtgtgtacttacacaaatataacctaagtcaaattgcatagtgacctatcatgttaatgattccccatttataaaccaggaagatctcaatattatatgtggtttcaagtgtatgtgtgtttgtgtgaatgtgtacacatcccacagaaacatacataatattggaataattcatgctgaagaattatggttaaaagtgcattcattgaacaattaatggctccaaataatgattgtggccacataccctgggaaactggtgcacagtgaattgcacagttcaggtgaaggtgacatatgacagataatgatggtggcaggaagagctgtgacaatgagatagagagcattttctgagaaaatataatgccacatttgaagaatttagctgtccatgagaataaagtgaatggttctgataaggtcaggaaaacgggtttgagaggataaatcagaagcagagtgcttgctgtttaacttcagtgccttttccttgttagggagctaaggatattttaagtgaatgaaaaagaaaatgtaaattctgtgggagcaaagtgtgtcaggtttttaaagcatattaagtctaaatgtggtaatgcattcctcactttggaggggtcacctggagagctgactcctttcagaaatgatggcacagactgcaccaaagtgagcattattggttagagtatgaatttatttttttttcatttgcttcttactttcaagccacacgctatgctgccactgcatttggcatcaaatcaaaagaccaactctgcttcacaggaagaaatgtcaccacaaagttgtgctttttgtgaaaactgtgctgttgctatttttctgaaatgctgtggaattgtgtggaacagaggaaggcctcatcagaactctgggccaaaacattatcagctagtcatgaaggacatagaaatggatagctgtagtagccaagagattccctacaatgacatcgtcagataactgaggtagtatcttaccagtttcatacactcttagctaaaacatcacactctggggctcagatgtcatgcataagcttggcctctaatatagattctgcgggtaatgctcctttgggcttcacccagtaggctgtgaggatggaaatcctaaaggtttagtctgaactgccaagaccctcacccaggaaaataaattgtgagagagactagcctaagcagaaatgaataccatggaatggacttcaataaacatgagatgatgcccactccaagcagtctagatgctcatcttgatctaatttctagagctgtacctcttacctgccctgttagctaatggaagggatcttacagatttctactcaaattctttatctaatggttggatcacctctgaatcatcctcacgtgctttcagcagtagcaattatgtagccaagataggtcataccttcacatccaaatagagagaacttcaaatcctagtgatttgaattggtagactagaaatggtggcagaaaggctaattaagagatagatacactataataagaaagaggtggtgagcctgaaccaaagtagttgccattagagttggagaaatgcaggaataattgggtaaaaagttccaggagaacttggtgttggcgtggatgtgtggctcagagagagtgaagaaaaaacaatgagtctgaggtttcaagtcttggttccttaataaacagaggtgcttttcctagaaagaaataagaaggaagagttagtggaagttgtttagccatgtttcaaatattaagagtctgaggtgctgaaaaaacatggcattctgcaattgatgctttggagggggcgaaaatttgaggagaatggagtgagtaatacataaaagtatgtgagaccaacaaggaagagcatgtagatagagaggaaagggagtcagggatagaatccctgtgaatacttgcttttagtgcagagaaaggaaaagacaaagagcaactaggaaaaggaggcagggaacagtggtcagaaaggtaagaagaaaactaggacagcacaatgtcatagaagccaagatacaagaggagttggccaataatatcagatacttaaaaaaattcaaggaagtgttccttttaggacatctggcaagttggccaaataggaacagctccagtctgcagctcccagtgagaccaatgcagaagatgggtgatttctgcatttccaactgaggtccccagttcatctcattgggactggttaggtagagggtacagcccagcaagggtgagcagaagcaggatggggagttgcctcacctgggaagtacaaggagctgggaccctacctcccccagccaagggaagccgtgagggactgtgctacccggctgacatactatgcttttcccatggtttttgcaatccacaggccaggagattccctcgtgtgcttacaccaccagggccgtgggtttcaagcacaaatctgggtggctgtttggccagacactgagctagctgcagtagtttgtttttgtttttgtttttgttttcataccccagtgatacctggaaacccagcaagagagaaaagagagaactgtttactcccctggaaagggggctgaagccagagagccaagtggtctcactcagtgggtgccactcccatggagcccagcaagctaagaaccactggcttgaaattcctgctgccagcgcagcagtctgaagtccacctgagacaatgaagcttggtagggggaggggcatccaccattactgaggcttgagtaggtggttttcccctgacagtgctaagaaggctgggaagttcggactgggtggaacgcaccacagtgcagcaaagcagctgtggacagactgcctctctagattcctcctcactaggcagggcatctctgaaagaaaggcagtagccccagtcaggggcttatagataaaactaccatctccctgggaaagagcacctgggggaaggggcggctttgggtgcaggttcagcaaacttaaacgttcctgcctgccagctctaagagagcagtagatctcccagtacagtgctcgagctctgctaagagacagactgcctcctcaagtgggtccctgaaccccgtgcctcctgactgggagacacctcccagcaggggtcaacagacaccacatacgagagaacagtggctagcatcaggcgggtgcccctctggggtgaaacttccagaggaaggagcaggcagcaatctttgctgttctgcagcctccactggtgatacccaggcaaacaggacctggcatggacttccccgaaactccagcagacctgcagaagaggggcctaactgtaagaagaaaaactaacaaacaaaagcaataacatcaacatcaacaaaaaggacgcccacacaaaaagtcccattcgaaggtcatcaacatcaaagatcaaaggtagataaatccacaaagatgaggaaaaaccagcacaaaaatgctgaaaatttcaaaaaccagaatgcctcttctcctccaaatgattgtaactcctcttcagcaagggcacaaaattggacagagaatgagtttgagaaattgacaaaagtaggcttcagaagatgggtaataacaaactcctctgagctaagggagcatgttctgccaatgcaaggaagctaagaaccttgataaaaggttacaggaactgctaactagaatagccagtttagagaagaacaaaaatgacctgatggagctgaaaaacagagcaagaactttgtgatgcatacacaagtatcagttgctgaattgatcaagtggaagaaaggatatcagagtttgaagatcagcttactgaaataaagcatgaggataagattagacaaaaaagaatgaaaaggagcaaacaaagcctccaagcaatatgggactaagtgaaaaagtgaaaagaccaaacgtacgattgattggtgtacctgaaagtgacggggagaatggaatcaagttggaaaacacacttcaggatattatccaggagaacttccccaacatagcaagacaggccatcattcaaattcaggaaatacagagaacaccacaaagatactcctcgagaagagcaaccccaagacacataatcgtccgtttctccaaggtcaaagcaaaggaaaacatgttaagggcagccagagagaaaggtcaggttacttacaaagaggagcccatcagactaacagcggatctctgtgcagaaaccctacaagccagaagagagtggggtccaatattcaacattgttaaagaaaagacttttcaacccagactttcatatccacccaatctaggcttcataagcgaagcagaaataaaatcctttacagacaagcaaatgctgagggattttgtcaccgccaggcttgccttacaggagctcctgaaggaagcactaaatatggaaaggaaaaactggtaccagccactgcaaaaacatatcaaaatataaagatcaatgacaatatgaagaaactgcatcaactaatgtgcaaaataaccagcaagcatcatgatgacaggatcaaattcacacataacaatattaatcttaaatgtaaatgggctaaatgccccaattaacagacacagactcgcaaattggataaagagtcaatacccatcagtgtgctgtattcaggagacccatctcatgtacaaagaaacaggctcaaaataaagggatggaggaataattaccaagcaaatggaaagcaaataaaagcaggggttgcaatcctagtctctgataaaacaaatttaaaccaacaaagataaaaaaagacaaagaaggccattacataatggtaaagggatcaatgcaacaagaagagctaactatcctaaatatatatgcacccaatataggtgcatatatatgcatatatacacacccactttcataaaacaagttcttagagacctacagagacttagactcccacacaatattagtgggagactttagcaccccattgtcaatattagacagatcaatgagacagaacattaaaaaggatattcaggacttgaactcagctctggaccaagctgacctaatagacatcaacagaactctccaccccagatcaacaaaatatacattcttctcagcaccacataacacttactctaaaattgaccacataattggaaataaaacacggttcagcaaatgcaaaagaatggaaatcataacaaacagtctctcagaccacagtgcaatcaaattagaactcaggattaagaaactcactcaaaactgcacaactacatggaaactgaacaacctgctcctgaatgactactgggtaaataacgaaatgaaggcagaaatgaataacttctttgaaaccaaagagaacaaagagacaatcttccagaatctctgggacacagctaaagcagtgttaagagggaaatttatagcaccaaatgcccacatcagaaagtgggaaagatctaaaatcgacaccctaagatcacaattaaaagaactagagaagcaagagcaaacaaatttaaaagctagcagaagacaagaaataactaagatcagagcagaactgaaggagatagagacacaaaaaacccttcaaaaatcaatgaatccaggaggtggttttttgaaaagaataacaaaatagatggaccgctagccagactaataaagaacagagagaagaatcaaataaacacaaaaaaattataaagaggatatcacaactgaccccacagaaatacaaactgccatcagagaatactataaacaactctacacaaataaactagaaaatctagaagaaatggataaattactggacacatacaccctcccaagactaaaccagggagaagtcgaatccctgaatagaccaataacaagttctgaaattgaggaagtaattattagcctagcaaccaaaaaaagcaaaggttaagacagattcagagacgaattttaccagaggtacaaagaggagctggtaccattccttctgaaactattccaatcaataaaaaaagagggactcctcccgaactcattttatgaggccagcatcctcctgataccaaaacctggcagagacacaacagaaaaagaaaaaaaaatcaggccaatatccctgatgaacatcgatgtgaaattcctcaatcaaatactggtaaaccgaatccagcaacacatcaaaaagcttatccaccacgatgaagtcaacttcatccctgggatgcgaggcaggttcaacatatgcaaatcaatcaatgtaatccatcacataaacagatccaatgacaaaaacctcatggtttatctcaatagatgcagaaaaggcctttgataaaatacagcaccccttcatgctaaaactctaaaaaaactgggtatttatggaacatatctcaaaataataagggctatttatgacaaacccctagccaatatcatactaaatggacaaaggctggaagcattcctttgaaaactggaacaacaaaaggatgccctctcccaccactcctattcaacatagtattggaagttctgttcagggcaatcaggcaagaaaaagaaataaagtgtactcaaattggaacacaggaagtcaaattgtctctatttgcagacgacgtgattgtatctttagaaaacctcatcatctcagcccaagaactccttaagctgataaacaacttcagcaaagtctcaggttacaaaatcaatgtgcaaaaatcacaagcattcctatacaccaataatagacaagtagagagccaaatcatgaatgaactcccattcacaattgttacaaagagaataaaatacctaggaataaaacttacaaggtacatgaaggacctcttcaaagagaataacaaaccactgctcaaggaaataagagaggacagaaacaaatggaaaaaaaaatccatgctcatggataggaagagtcaatatcgtgaaaatggccacactggccaaagtaatttatagattcagtgctattccattaagctaccattgactttcttcacagaagtagaaaaaaaaaactacctttagtttcatatggaaccaaaaaagaacccgtatagtcaagacaatcctaagcagaaagaacaaagctggagccatgatgctacatgacttcaaactatactacaaggctacagtaaccaaatcagcatggtactgataccaaaatagatatatagtccaatggaacagaacagaggcttgagaaataacagcacacatctacaatcatctggtcttcagtaaactttacccaaaaaaaagcaatagggaaaggattccctatttaataaatggcgttgggaaaactggctagccgtatccagaaaacagaaagtggattcctttcttacaccttatacaaaaattggctcaagatggattaaagacataaacataaaacgtaataccataaaaaccctagcagaaaacctaggcaataccattcaggacacaggcatgggcaaagacttcatgactaaaacatcaaaagcaattgcaacaaaagccaaaattgacagatgggacctaattcaacttaatagcttctgcacagcaaaataaactatcatcagagtgaacaggcaacctacagaatgggagaacatttttgaaatctatccatctggcaaaggtctaatatccagaatctacaaggaacttaaacaaatttacaagaaaaaaacaaccccatcataaagggggcaacgtaaatgaacagacaattctcaaaagaagacatttatgcggccaacaaacatatgaaaaaaactcatcatcactggtcattagagaaatgcaaaccaaaaccacaatgagataccatctcatgctagttagaatgacgatcattaaaaagtcaggaaacaacagatcctggcgaggatgcagagaaatacactgttggtgggagtgtaaattagttcagccattgtggaagacagtgtggccactcctcaaggatctagaaccagaaataccatttgacccagaaatcccattactgggtatatacccaaaggattacaaatcattctactataaagacacatgcacacgtatgtttatcacggaactatttacaatagcaaagacttggaaccaacccaaatgcccatcaatgatagactggataaagaaaatgtggcacatacacactatggaatactatgaagccataaaaaaagaatgagttcatgtgctttgcagggacatggatgaagctggaaaccatcattctcagcaaactaacacaggaatggaaaaccaaatacctcatgttctcactcataagtgggagttgaacaataagaacacatggacacatggaggggaagatcacacaccgggcctatcggcgggtgggggacaaggggagggagagccttgggacaaatacctaatgcatgtggggcttaaaacctagatgacggattgataggtgcagcaaaccaccatggcacatgtatacccatgtaacaaacctgcatgttcagcacatgtatcccagaacttaaagtaaaattaaaaaaaaaagaaagacacaaaacttactaaaaaaaattcaagaagaatgtgtcatctgaaacaaagtcattggatttgatggttagaacatcattctctccctttattataacatcaatactgccaccaccaagtctttaataatggttcacttcaccaacctcagtgatcagtgcttgaaggacactggagaagtaaagtgattcaactttaatttattcctttaataaacttttgttggactttactgtaagccaggcatcatgcaaggtattagctctctgttgccactgaggtataatattagcagtgcctgctccctgctttatagctgggtcttagtataatttttcatagttcttcattatatcttcaaaagtatcctgatttggacaataaattatatttatgtaattatatttattacttatgggccagtccagtcctacatttcttttagcatgaacttgactggaatgaaacatctatgttggccatgtggtctatgaaaagaaccattttcaacaccattgtctttccaacataggctgtgtgttcctgaactcacctgtcccagacctgctatctatgtgttatctgccaatcaaccatgacagccattcaatttggattgatcttgatgattcagagtaactctgtcacttacaggaataacttatagtacaaagtatcctaaaataattgtgtattttagcactgttttgtgtcattgtgtttattgtaggactttttgccaaattatatagtgtgaagaatgagtaaggctagtagaactgacctggttaaactaaaatttctcctctatagaagctagactcaggatatttttagctggtcaataaagagttaagagtgttagctagaggcacttgggaatccaggctgtgcttatttctcaggtttatgaataacttaaacctatgtaggagttaattaatttggctccattccacctacagtttagcttcttgagcgaataacttgacccctcctatactctgagttcgtagttataaagagaactcccaacagaatgaataaaacctcacttggattgtctgagtttaacttcttgcatactttcatggagaaactataagatgtcaggcacagcacaaaatgtcaaaatacctcttcagttaaggacaaacacaggcattgtactatttctggctagagttatttatgattctgtttttttctctcttaaatgactgacattctgaagagggagttaacctgtgacttggtaacagtgatagagactgttaaaagcacaccgaattttgctcactgcatcctgacctctcctttccctagagaatagttcaaaacaaattattacctttgggacgataggtcagtttccttacctttgatgttctccgcgactaaataagaagttacaggtattttctcacttgtcagaattttaaaaagaccacccattaggttggcagatcttccttgtaatacctctaaaaggacatgagagatcagactggaggtaaggcctgttaactgagtgaaacagatgagctgaatcatatgatgtcgcaatgtaaatgtcacaatgtaaatgaagtgtgacttcatagaaagtactcatgtcactaggatcatccaatcttcatagctactcaagtgcatgccttcactgaacatcatgacattctagagtatagcctattagctgtgatggcaacttgtatagttttgctgacttcattaaaaaaatttaatccttatgaatcattcatttcataaatgtgactacattttatcctgagttgcaaaaaatactggctggggacaatcgcattactcacccaaacaattttatcgtaagatctgagaaacaattaccagataaggtgagaagccatcacctattttcagagttataaaatatactggatttcaccatttcccccactttgagaatttgttccaggatggaggggaggctgttgttctgagccatcttccacttaaattagagcattgggcatgggagtacagtccctgccccttgctcccaaaccacctggaggagaggatggcaatgttagagctgcagcctgaggtctcattactgaatggagcagcaactaccatttagtgagcacttattttgtgtcaatgatattgcatgtaaaattgcaatattgaatttaatcctgacagcatctcaatgagttagttattgtcactatcccaattttacatacaaggaaactgagaagcttctagtcatgttagctcaaaataactgtgaccttggacaggaccagaattctaacccaggtttttaggccaaagcccatgtggacttcactacatcatgaatcttcagatgaagtttaaaggcagggcaaattgacctaattgaagcctagctgaagccctcacacgtataggttaatacatgttgtacggtattaattcctcctctgttagaatttttacattcagaattatcaagaatttactgacacacatattagaccaggagatgtttccaatcacagggcatttactaggtcctgactgccacccattgattccctatgccttgcagtccaagaagtttggcctgcaccctgaatgctgaccatcctggaatctgtagctggggatttgtaagaattaaagtactcagccctagaggtaaatggaactatcctcttgtgtatctagaaatgaaggtaccttaaaccatgctcagagcacgtagtagtttcctgtggttgccgtaacaaattaccacaaatctggtggcttaaattaatagagttttattctcttgagtttctggaggcaagaaatttaaaatcaagttttcaccagggcactctctctagaaggtctagaggagaattcgtttcaagcttcttgtagcttatagtggccccaggcattggtgttccttggcttgtggctgtagcacttcagtctctacctgtcttcgcatcacttcctcttcttatgtgtcttctcctcttctgtcttaagtattcctatgccttccttttataaagaaactgctgtttttgaatttagagcctatcagataatccaatataatcttatctcaaagttcttaattacatctacaaagaccccttttccaaacatggtaacattcacaggttacaggagttagggcagggacatgtattctgggggaatataactcaacccactacaggggacttgacatccccaactgtgctctgaaatacaggaaaccaggatgtacagggccaaattggaccactaggaatatgaagagagaattatggctgccttccattcctactttttaaaatatcactcctcactcatcatgccccatcagtctccagattctcttaacagcctgtgggatcagtctcaggccatcctaggtccatttgttcactgaaacaaagtagtataagagaaagagtataaatttaggaatatgacagaagttggttaaaagctactccaataattcttggtgatatggccttggataagttattttaacctctctaggactcagaatgctcacctgcaaaatagaaatgagatcactttggtcacatgctctagggagaaaaaaatatctaggctttggagacaaggagacatgggtttatttcctggctctgccacccactatctagccatgcaatttggggcaagacattgaaactctctaaaccttagtttcctaatctgaagaataggcgtaataacttgaagagatgtcaagatttaattttaaaaagtacagaaaatatagttggtgtcaattcatgtttattaaatttatcgttgttattgttgttgatgtcagctacaacttacagagtacctagtctatgctagacattctgccatgcatgatggagcaatgcagatatgtatctcagtcctcctatagagcagattgatcgtaagggagaaagatagtattattgtgagaagctagcaacactactcagctttttggccactaaaattattttctttgaatacagttaagtcatctttgctcttgggtaaaattgcataaattttaggaatttagaagggaatgaagaagctggaggtgaattaaatattaatgggcaaacattttaactatggttaaaattttgatatcaagaccacagatcaaagctaatgtcttttctgtcaaaattcgtagattttaaatatatcctgggggtaagttgagaaatgttgatgactaacaaatgaaccttttaaaattgcatttacttttctagctgaatgctcctggagtttttccaatgatgttcattagggtgacaaaaccagcttgaatgtacataaatatcttgctttgtacagaaattaaagtgttggtacagacattaagatactaccattcaggccactgagagagccttccaggacaacaatctaggagttattacttcttcctttgattgcagtttcatacaaagcagtagctaagtcttctgtgatcagttcaaatgcaacagcacaaccaatggtagaagaaagaactttccaaataaaacagccaattaacagtttgacataaaaaggtgggcctagctatcattctagagattaggtaaaggaagcacaactttttggtttcatgaataggcaaatccaggttttgaggatccattgttgtgttcgtttattcaacagacagtgactaactacagccatcagttggtacttatgaaggattggttctagaacccccctccacaatgtggataccaaaatctgaggatgccatagtgccctatataagatggtgtggtatttacatatgacctacacatatcctctggcatactttaagtcagctttagattacttaaaataccttatacaatgtaaatgctatggacatagttgttatgctgtattggttttcttaaagttttggttttctttttgttaaatttttatctgtacatagtagttgtatatatttatggggttcttgacatatttttatttgtattttttattgttacacagttttttattgttttttctgaatatgttttatgtgtggctggttgaatctgcagatatggaactcacagataaggaaggttgactgtacttgagtacaccagccttatgtcaggtgctggcaatatatagataacaatgacttagccttaacaggtaaatttgaaatattttggtacactatggtgcattttggaaagggtatggcaaatagctttgaaagtacagaggaagtaaagcatgcctatgtcttagagagtcaggtgaggcttccaagaggaggggacaattcagctgcatttgagaagatgaataagaagcaaacataggattagaggcagacattttactaaaggcagaggccaaaggcataaggatgagaaaacacaaagaaaccataaggtagatgaaggtgatgagagaaagagttggctctttaggtctgaacttatgtgggaatcatttctgaggtgggttcgccaggaccaggtgatggataggctattgaaaaggaaaaagactgtggaggcaggcaagccatgaggttttagggttggatattggatgggcagttcaggtttgctccagtgccatggatgaaatattgtgtcctcccaagattcatatgttgaaactctaatcccaatgtgatgatattaggaggtggtgcctttgggaggtaattttgggagggtagagtcctcgtgatgtgattaatgcctttatgagaagaggctagagagatagctagttctctttcccccatgtgaggatacaatgggaaattggctttctgcaacctggaagaaggcttcaccaggatccaaccacgctggcatcgtgatcttagacgtccagcctccaagactgtgaaaaatagtcctggaggctggaagtctaagatcatggtgccagcatgtgtgtgtgtgtttgtttttttttttttttttttttttttttgaatggagtctcgctctgtcacccaggttggagtcaagtggcgtgatctcggctcactgcaacctccggctcccaggttcacgccattcttctgcctcagcctcccgagtacctgagactacaggcgcctgccactacgcccggctaattttttgtatttttagtagagacagggtttcaccgtgttagccaggatggtctcgatctcctggcctcgtgatccacccgcctcggcctcccacagtgctgggattacaggcatgagccaccgggcctggccgtgtgtttgttttttaaggccactccatctatggtcctttgttacagcagcctgaactaagacagaaattggtactaagaggtgggttctgatacaataaatacctaaaatgtggaagtggctttggaactagataccagaaactggaggaattttgaagtgcattttggaagaagctggtggtgaagggacttttaaagatgattctggtgagagctcagaaaggaaagaagaacactgtagacaaaacttccatcttcttagagaacaaataaataatcctgggctgggcgcggtggctgacgcctgtaatcccagcattttgggagaccgaggcgggcagatcatgatgtcaggagatcgagaccatcctggccaacatggtgaaaccccatctctactaaaaaaaaaaaaaaaaaatacggaaattagctgagggtagtggcaggcacctgtaatcccagctacttgggaggctgaggcagcagaatcgcttgaacccgggaggcggaggttgcagtgagctgagatcacgccattgcactccagcctggcgacagagggagactctgtctaaaataaaataaaaataaacaaatgaataaataataatcctgtatagaatgcaggtagaaatatgaataaaggccattctgatgaaatttcagatggaaatgaggaacatgttactagacaatgaagaaaagatgatcctttttatgaagttgcaaagaacttagctgagtcatgttcatgttttggtgttttgtggaaggtggaacttgtgatgaaattggatatttatttagctgagcacatttctacacaaactgttgaatgagcagtttggttccttctcactgcttatagtaaaattcaagaggagagaaatgacttcaagatggaattatgcaaaaaggaactagaacttaaagatttggaaatttctcagtatgtccatattgcaaaaaaaaacaaaatgtgaaagtatgtttgaccaaggaatctttgacagggagattagcatggatgtcaaccacaaacataatcagctaccccaatagaaaaaactgacagtttgaactgaagggaatggagatgggaaggaatggaggaaggctgtcagacttcttagattgtattggacaggaccacagagttatttgcttgaaaatgtgctttattcctgaagacaaggcaagaaggatcctaaaggtgattcagagatcattagtgccactgcctgagtttcaaaaggtcaaacaatctccacccatagccatgacgtatgggatacccagagccttaggggcctgacccctgcccagcagagttgcaggggcaagatggccaccccagtgggtccagaagttgggacctctgccccagcatgttcaggagacgagacctccatctcaatgggtctagagggcagagcattaagccaaaaaggattattctcaagccttaagatctcatggaatttgccttgctaggtttcagacttgcttgcaactggtcaccccttctttctttcctatttcttcattttggaagggaatgtctatcatatggccatctcaccactgtattttggaaagacatgacttgcttggtttcacaagtttataaatagagaagaattttgcctaaggatgaattgtaccttgaatctcatccatatctgatttagatgacatttagatgagactttggagttgaaaattaagaatttgggggttggtttgaatggaatgaattattttgctattagaaaggacaagaattttgggaagccagattggaatgcaatgaactgaatgttttcatcctcccaaaatccatatgttgaaatccaatcccaatgtgatggtattaggaggtgtggtctttggcaggtaattaagttatgagggtggagccctaatgatgggattagtgaccttataagaagaagacagtgttctcactcataagtgggagttgaacaatgagaacacatggacacagggaggggaacaacacacaccagggcctgttggggggtggggggcaaagggagggagagcattaggacaaatacctaatgcatgcaggacttaaaacctagatgacaggttgataggtgcagcaaaccaccatggcacatgtatacccatgtaacaaacctgcacattctgtacatgtatctgggaacttagagcaaaataaacaaacaaacaaataaacaaaaagaagccagagaactaactggctgtctttctgccatgtgaagagacaaagggaagttggctctttgcaatgcagaagactactctcaccagaacccaactatgctggcatcctgatcttgaatttctagcctcaagaactatgagaaataaatgcttgtttttaagccatccagcctctggtaatttgttatagctgccccaaatgactaagacatccagtgtctgttatggggagcagcactctttctctgtgcagcaaaatctgggctgccaaagccaatacttccctgatgcttccacagccccatctggctgattaagggctaattcaaatatcaattaatcgttcctcatttaatttcttttaaaacattttcacagtgcagataatgaggaagaatattctgctttgaaaagtcaaacaaaaccctccactttaaagaaattagtctaaaactgttgcaaattgtaaactagtaagtgagcagatagtgacaatttggtccaggagcttaagatttctctgtttcacaagggaaagattaaagcgttgcttcactatgtaggatttcccaaaaagaagggaaaatgcccagttacagtttttccaaaatgacctattgcatttcctctccttgacttggtgctaatagaactggtgatatgttgtgacctgaaaagtagaaactaatgatggaattgtggtgttaatagggaccactttaacactatgaaggcacagaaaggttatgtgccttgcccagcatcacacactagttattagcagatctacatgggacctgaagtcgagaggccaaaaagtttctgttgcctttccttgggtcattgctgcctctggcttgctggtgaatgatcattggatttggctaagtgaggatacagtaggaggtgaagtaaagagatgggtgggggaattctgacaaactctgagaggcaacaagttgtctgactcactgtgacaccttgaagaaataagcatgcttgaagcaggggctttatattagagaaatttggaaagtagtcccccaaggaaggctctggaggtggcagactgagtcatccttacttggaaaagagctgccatggtcttttgatttcctgccagtaaagcagcttcctcctcttcaggtgcagatacagagtgggtatttatactttagttccatcccaccttggcccaattttttttttctggggagtgaagatggaaatccctctgtggcttttcctacaggactagttggaaaaataggcagaaaaaggagtttggattttattatgtctgttgggtagttcctagaagatcttaagaaaaggagtgaatgctttgatttatttttttaaatagattactctggttctgagtgaagaatggatgctacaaagttaacgaagctaagaaagaaaacatctgaagcaattgctttagaacaaatgggtatagtggatcagattaagatggtaatagtagcgactgacaaaagtagacagaattggtatgtatatttgaaagcaaagtcagaaggacttagaaagaattgaacatgatgtttgaaaatgagtggaatcaatcctagctttcttatgtgagcaactagaaattgctgggagagatgatttgtgggtaagaatcatgagtttgcatctggaatcctaggtttgaggtccctatgagacattcaagtagagatgtcaagtagtcagttggacatgagtagaaatataaacttgggagtcatcaacacatacatagtgtttaaatctgtaggactgaatgaggccgaggtcatttagagtgagaagaaaaggagctgtaaaaaatatttagaagcaaagaccagtggcatagaaatagaactatgagaataaaatgtcctggaagcccagagaagaacagatttttttaaaagattggctagttggctgtgtcaaatcctgctgggagctcaagtaaatgaagagcagagatcactgactttgattacctgaaggttgttgataactttgataacagtgatgtctatatagtggtggagaaggaaaagctacattagagtgagtcaaggggagaaaaagaatttagggttgaaaatagtgatggtagactacttatgaaagagatttggttgtgaaaggggacagagacatggagaggtagctggaatgcagaggtgagttaagatatttgataaatagggtatgcctatctgctgatgtgggcaatcctgtaaagagggaaaaacttaagatgcaagaaagagaggaaagcccttgagaaggctagatgggttgagatggatactgagcacagttggaggagttagccatggagcgaagtaaggacatttcactacagtgctcctcctggtcaattgagtaaaggtcatcatatgtgactgaaggtctggatgttggatgtacatgtaggtttgagaatagaaaaaacactgtaacatcattgtgttggagaatggaagtgtgaacattaaagggaagtgtagtagactgttcaggcaacacagagggctcatttgaaatgtccaaccatgattttaaagtgaaacttgttaacactgctgtgtgcttttctcaagcaacactcacctgctaaaatacagcagtgaagtaggaagagagtagagttaactagagttggggctttgcaaggcagatgtgtgtgatggagggaaagagaaattagggagttaatatttggaaaatggtgaatataatggattatcaaatataaggtctggatagagagacttgaatacatgaggtagatgacgaactgtgagaaggtggtgaggtcagtaccttgcaggtcttgctaaaattagagaattaatagaatgagattactctggcatatgaactggaaggaaaagaagtaggctaatagagaaataagggcccaaaaatgagattaagattggccaatgagataggaggtggaaagtatttccaaaaggaaagagcaggtaactagtcaagatatcaagtaaaatagggatagaaaggtaaacattagacataatgacaagaagatcattgttgaccttaacatgagccatttcaatggaatggtaggattcattgtagtggattaaagattgagtgggcaatgaggaaactgacacaagagaactcaggacaccttttctttttttttttttttaattttttttttattattatactttaagttttagggtacatgtgcacattgtgcaggttagttacatacgtatacatgtgccatgctggtgcgctgcacccactaactcgtcatctagcattaggtatatctcccagtgctatccctcccccctccccccaccccacaacagtccccagagtgtgatgttcctcttcctgtgtccatgtgatctcattgttcaattcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgtcgcaatagacatacatgtgcatgtgtctttatagcagcatgatttatagtcctttgggtatatacccagtaatgggatggctgcgtcaaatggtatttccagttctagatccctgaggaatcgccacactgacttccacaatggttgaactagttgacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttcttccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagtaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattgtgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttgttgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttccttcctcttttcctaattgaataccctttatttccttctcctgcctaattgccctggccagaacttccaacactttgttgaataggagtggtgagagaggccatccctgtcttgtgccagttttcaaagggaatgcttccagtttttgcccaggcagtatgatattggctgtgggtttgtcatagatagctcttattattttcaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgaacatggtggataagctttttgatgtgctgctggattcgttttgccagtattttattgagggtttttgcatcaatgttcatcaaggatattggtctaaaattctcttttttcgttgtgtctctgcccggctttggtatcagagtgatgctggcctcgtaaaatgagttagggaggattccctctttttctattgattggaatagtttcagaaggaatggtaccacttcctccttgtacctctggtagaattcagctgtgaatccatctggtcctggactctttttggttggtaagctattgattattgccacaatttcagatcctgttattggagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcttttcaaaaaaccagctcccggattcattaattttttgaagggttttttgtgtctctatttccttcagttctgctctgattttagttatttcttgccttctgctagcttttgaatgtgtttgctcttgcttttctagttcttttaattgtgatgttagggtgtcaatttttgatctttcctgctttctcttgtaggcatttagtgctataaatttccctctacacgctgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgcgattattaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgtagatgtctattcggtccgcttggtgcagaggtgagttcaattcctgggtatccttgttgactttccgtctcgtggatctgtctaatgttgacagtggggtgttaaagtctcccattactaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttagttgatgcagtttcttcctagtctcgatggtcgtttcattttggcatgattttgcggcggctggtaccagttgttcctttccatgtttagtgcttccttcaggagctcttttagggaaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggttgcccttaacattttttccttcatttcaactttggtgaatctgacaattatgtgtcttggagttgctcttctcggggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtcttttctcatagtcccatatttcttggaggctttgtttgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttcagcacttctctgtattggttattctagttatacattcttctaaatttttttcaaagttttcaacttctttgcctttggtttgaatatcctccgtagctcagagtagtttgatcatctgaagccttcttctctcagctcgtcaaagtcattctccgtccagctttgtttcgttgctggtgaggagctgggttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaacctcagctgcaggtctgttggagtaccctgcagtgtgaggtgtcagtgtgcccctgctgggggtgcctcccagttaggctgctctggggtcaggagtcagggacccacttgaggaggcagtctgcctgttctcagatctccagctcgtgctggaagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccgggctgctttgtttacctaatcaagcctgggcaatggcgggcgcccctcccccagcctggctgccgccttgctgtttgatctcagagtgttgtgctagcaatcagcgagactccgtgggcctagcaccctccgagccaggtgcgggatatattctcccggtgtgccgttttttaagcctgtcggaaaagcgcagtgttagcgtgggagagacccgattttccaggtgcggtctgtcacccctttctttgactaggaaagggaactccctgaccccttgagcttcctgagggaggcaatacctcgccctgcttcggctcgcgcacggtgtgctgcacccactgtcctgcacccactttctggcactccctagtgagatgaacccggtacctcagatggaagtgcagaaatcacctgtcttctgcctccctcatgctgggagctgtagaccggagctgttcctattcggccatcttgtctccactttggatgtaagccattttaactgggatgtggtaatatctcattatagtgttgattagcatttctctgataattatgttaagcaccttttcatatatctgtgccatttgtatgttttcttttgagaaataccactgtctggcactccctagtgagatgaacccggtacctcagatggaaatgcagaaatcacctgtcttctgcgtcgctcaggctgggagctgtagaccggagctgttcctattcggccatcttggctcctacccccaccttttcaataagttattgctgtttaaacatttttatgatagctgctttaaaatccttatcaatcaggtaatgctaacatctaagtcatctcaatgttattatgaactgagtatctttttttttttcatttatgttttgcgtttcctggatcttggtatgacaggtgatatttttgtttgtgtcctggacattttggctaatatattgggagactatggatcctatctaaatcttgtatttttagcaagaagtcactccattgagatttggcgtcaaggttctggcctactttgtgagttgaggctacaatggcagtttaatatttttagagctttcgcggtgctattttggtcggcatggtttatctggtgccttgggaactcccactggtccttgcttgtgctgcctgagggagcagacagggttttcccaggcccacagaaataaagaaccttccttggtaggccacttgtcgtggctgggcctttcccatcatttccacccacctgctccagcatcctctggcagaagaagggattcttgggtccttttttctcctttgttgggacaaaaatgcttcacgtacagggcaccctcttgtggtagaaatcccctggttgctgtttcctggatacctgatgtctctcaaaatgggagagagtgtcaggtccgtagaaacaaaaaacctttttggacaaggtctgcttgttggggcaggatacccattgccagtactgcctggctgcctggtgtttcacagtaagggaagagagtcctgggctgtcagggaaggagagtgcttcccctggctacttattattagtagggctcccaatcatgtccccttgctgccattcccaggttcacctgatattgtgagaggaattaccatttgatccagtaaagaagcaagcctacctgggctgccatctgctgttctgtcagggatcaggaaatgctgggtctgtgtcaccttgttctgttggatagggggaggatcataagacaccctgctactgtgctatttatccaatactgggatcctaaaccagttagccagccttttaccaccttacagagttttcctctagttgttgcttgcattattcccagggttcatatttgtattaatactttgggcagaggagcagggagaaatacatctacaccatcttgtctggaccagacatctgattgtagtttaaaggcctaaaatgggaagcaaagagagggagaggagagtcaacagagcgaggtcccaaaaagtgcttagagaaaagaactcagaacacagatgaggatataagtattagcaaaggacagagaggaaagaagatgcatattcagataggtttataggtttggtagcaggaatttgaggacattcttagccgatgaatctacttactttcctgtgaaacagagaggcaacataagagcccaaactcgatgttttacatttttggttatgaaccccagttgcacttcttaccagttgtgaggcctttggcatatcacttaaatccctgtgtgcctcagtttcccacaaaatggaaattaaaacagcatatatcctcataggaccgttatgatggttaattgaagtgagttaatatttgaaaatgcatttaatatggtataagtgtttgttatgtaggcaaaaatatctcgtaaggttcttacgagatattaaataagataagctctacaatgtgtgcagcaaactgcctggtatataacattcagtgttactatgattttcaaaagtattctttgcaggcttaggatattttcttgaagtaaaatcataggtcacaatttgccaatcccatgtttttgtcagagagggtctaggtgacagtgggcacaaatacataatatcagtcttggtagaaatagtagggatggggaagctgcatatgaggaactccaagatgcagttggagcatctatttccctgggaagctttaggcaagtgcccaaggcccactgagcttctccagccttagcatacattttgctatgttgtatgcagctttctgccctccttttcttgaagtctgagtgctcctccagggtagagaccggcaataggaaaaggtttcaactccctcacatcacaacatatctccatgctataatatacaccctctcccaaagtaacatttgaaagtccctgagaaagccaaatggactcaagtgtctggaatatgttaatatgggcagtcagctgcataaattgcaaaacagaagtcatgcttctatgtattctgtgacagcagaaaaatcgtaggatcttctatcacgatgggaaaggaatacaaagaagaattagtgccatcttgtggagtgatatatcattaccacttaagagtcgccagtgagaactgggttatatttttttagtatctcccgagtcctggtctgcaagaaatgcttgaaaattacttgcagaattaaatgaataaatgagagacgagataagaattggatggagactttgttaatttaaacatcaccttgataaaatgtttgacgcactgtccattgcgatttggagacctttaaaaatggtgttgtagacaccccaagtcattattatgtacctaccataaaggaaaatgaagaataaaatatttgcattaagaaatcaagaactatgaactttttcttgtcctggccttatcagtagtaggtgagtaaactttctaatggtatttttctcttcctgattatcaatgtgctgcaaattaataaatcattcaaagaacacgaagagctggggcacagtgactcatgcctgtaatcccagcactttgggaggagaaaaagggtggatcacttgaggtcagaagttcaagaccagcctggccaacatggcaaaactccatctctataaaaaatacaaaaataagccagcgtgatggcgcatgcctgaaatcccagctacttgggaggctgaggcacaagaatcacttgaaccttggaggtggaggttgcagtgagccaagattgcaccactgcaccccagcctgggtggcagagcaagaccctgtctcaaataaataaataaacattttaaaaataagaaaaacaaagagcatgaagaatatgggtagcttcggagcaggtgggtgttgtccatattctattaagtttaatgaaaataaattgctgacaatcaactattttgacctataacaatgtcagtttcttatggattggcctaatattttaaatcagttcacttaatttattctgggtatatgataggtcaggatattgtagtaggccctagatgatacagggacaaataatacatgggccttgcctttaggaatcttaccatttggtgtggaagtgggcacttagataccatgccttctattttaataatttctgttaagtgccaacagtgtggagttaagccaaattttgtggaggtgctatgagaggtctaggaaagcataatggtttggaatggtgggtaagagcaaggactctggcaccaaactctctcagtttgaatgttaatttcactacttactagatgggtgactttggccaaagtgctatgcttttctattcctcagtttcctcatatatcaagtgagatcacatactgcccacctcatatgattgaagcaagggttaagtgagttccaaagtacttggaataattcctcatgcatagcaagttgtgtataagttttagctgtcttcgtcaccatcatcagtcatcatcatcatcatcattaccatcatcacctctattcctgcagaagtattagagttgtgttttgtaagctgagttaaatttcattattcgttttttcttttgaaaacgttgccaataatttatttattgagttcctatttttcccagttcctgtgaagaatgggtaggaatacccttacctacttttttctactagatcatcatttttgtaaatctgggcctgaggcaagagctttacaggcaaaagcatgggacaatgaaaggacagaggacagtaagactgttgtcattggaatgaatggctcatgggggcttgtatcaagttatggagaagataagccaagacttagattatttgtatctattcacgtgtatatttgtgaaggcaaaacctgttctcggttggctttaacaaaatcagctgaaatagctggacagaagctacataaggtaagggcaaaggcatgctgcattgctggcatatagtaccttaggcctattctgtggatacttggttgatgctgaatgctctttgtccccaagttgtaaaatcacccctccttgaaaattattctctaataaattttttaatcataaattaattttgtgccatggcaaaggtattgacagctaagaagtaaaactgtaaaattaactgctatggactaagaacggctaaaatttcactttgtttttaatgccttaaccacctgacaacatattgtagcatgactttatgaaacatggataacattcatcatttgagtctggagatccaaattcagtatttcagagtgggatcatgatgggctgtagtcatgagtgtttactatgttgtaaaaacgtccaagtgggaataatgacatgtttgcactccctgtgacttgatcactgaaatctggaaagctcatcaacttcacccattgtcaagtccacctttgctcctttgtcctctgaggacccagtgagatcagcatttttctggaagggctgcaagtgaccccactggaaggagcagcactgtgcatcaggatggattcccaggcacactatacattgtggggtcacaggccatatgggtggactaactgatttcatggctgtatttgaattgacttccctcctggaatcctgatgcctcttttaattttatgtggcaactatcatttgcttttgctgatcattcattcaatcacctctatcatttctcaatgagggcatttttaaatatattatttatatatttttatttttttttttttactaaatatagaccagccatcaacttgaacttaaaaactgacacaccagttagttcggtcaatagtgcagaaatattcttctatgctactatgatttgagcccactatagatacttttatagctagttatgccagcaagactcaatgaatgatacttgtccagattgctatcaggagctaatcatatgaaaggtaacaccagctttatgtaggatctgtttatacttagggtacttcctggattttgacggttttcaaagctaatggcctattaaataggtcccagaggtaaaagaaaaagtggcttggcctaaaccatggtgaatcatcttatggtagagttcaggtttctaattcataatcttgttagcagaacgtgcctttgaatggaaagtaacgtacaacctctgccaatctttgcaactcactaacaaaactcagcaaagtttgcccaatgccaatgtttaaaaaaatggatgaaaacagcatggattgaagaactcacatacaaaatatataaggaatgaagacaaatggcatcaaaattgtatctgggtaaaacatttgctgttgagtgtgccataatttgagagcacaaacacagccttgagggtaaagttcaaggtacgggtgtccccttttctaaggggacataacacataagcacataacagtcctcctgttatgtgctaaaagaaaggaagctcatattagattgctccagatgtagaaatcataacaacaataaagatgataatattaacaagtctaatttctggaacatttagcctaatgtttaggcatgtttacatgcctaatatgcattatcacgtttaattcttgctttttttccagttgaaatcttattttattttttacattcagtatattaattttaaaataaattttgtgcatatttaaggtatacgacatggtgatggatatgttcatttgtcccactatagagatgattttactatatatatatatatatatatatatatatatatatatatacacatatgtatcttaatatttgcttttatgaaatccttgtatataaatatttttattctcctcaatgtaatattttaaaaacttcattttaaagaaaaaataaatttatatgctctcttaaagcagagagaacaaaacctaacaaatcaacagcaaaaatgaaggcactctttttcacttcaaatggatttgttatcacagtctgtacagaatttagcagtgacaccttggtgttctaaatccttctaaactgagtttcctccttttttttctgcaagaagagcttctttatcttccagaatcatgactgtattcttttccttgtatactctatcttgcagtcagggaatgaccggagagcgttctcatgtgtctctattaattactaccccaaatatacctttttctggaggggaagtaccaggaaaatcttccctgtttagctgttgcaggggtatcacatgttgggttttcagatgtagcaaacaaaaatagaggccagccagttaaatttgacttcagagaaacaacaacaaaacaattttagtataagttgatcccaaatattgcatgggacagacttgtactaaaaaatgtatcatttatctgaaattcaaatttaaattggcaccctatatttcatctggcaaacctatatactaattataatttccagattacataattgagttacagcagtaagaccaattttaacttgtttcatcatagtgggaatcctgccgaattgtcttcacttccttagaaacaaatgagtagcagatgtctgatttggtgaatgggttatcagctgagtacaaccaacttacataataatttaagcaggagcaaggatgcatgctaattatatgtaggcttgcatagaaatttttctttagtttactcattttagatgtatagtatttcagagtctgaaaaagctgtggaggtccatcggtgtaatgtcacctccaaaatcccccaccgtggcctgggaccccattctttacactgtagggttgctgacaaaatgttaccaggccagaggggtcagtcgtggccaaagaccaacccacattctgcttttcaaaccttgcacccacagaaggcacttcccaccttctccaccccacaccgacccagacatgtacatacgtgccttgcacttgccagatcatgcactcccagtttgtgcctcctccgagctggtgcctttttatataatttgcatgaaggcagtagactcttggccctgattcataaaaacatttaatgcccatttgcaaagtcactacccagagccaagcaccacattaagttctgggaatgcagagatggatggggcatggtctcttctttctaggaaattagagtctggcatgggacagacaagcaaagaaatcatttaaaaacgtgccacgatagtaggtgtgcataggacacgatgagagcacagaggacagaaagctatctcagcctagtagcatggaactaggagggattctcagaggggttggaacttaagcaggatgtaaatgaaagaatggggttagtgagtcaagagggggtggaagggagggagaaaaggcattctaggttgagggtgacgcagcaccagcaaattcacagagatctgaaattgagtgccctgcttgggaaacctcaagataactcattttagctggggtaaaagtggggggctgagggtgtggcaaattataaagggtctttacagagagaatgatttgggaaacactgaattaaacaatgccctgtggggtaacattgctcctgctatattccccccagtgccgaaaatattgactagctaatagtaagtactcaatatatgttttattaaatgaatgaatgaacaagtgattgaatacatggcaggacttgtcagagcctttgatagaacaatgtgtgttatagatctcaagagaggggcatagtatgcagaattctcaccttatttgaccacataaccgtttttgtcactgaataatacatttctaaaatctattatttttgaaacacacttggggaaatcatgttctaaaggagacatgaaaatgtaaaactacatgaataaatagaaagtgagagaaatctatgataaggtttcagggcttatgcttacatgaaatggtgctcaattttttctctatcgtcttcttggaactaggtgattcattgatagtgggcagcatgagaggccggacacaaggtgggctggcccaaattccagggggctttgcaagtcctcttcggcaacaataatttgtattcactttttattttcccttgtttacacgttcagattgttctatagctaatcagaaaaatattcactttccctgtgggcctaatggtcccacaccaacgctaatctcagaaactgtggtcttaaggtaaaaacatgtatcaagcgctaactttacaccagacactttccacattttaacttactgattttccatgatggtcatggttataatggtataataataattacatattgaatgtttactctctgccaggcagtgggctaagtacagtttacaattgttatctcatttgtccttcgtgacaacccaactcatttataacaatactgaagcacagagaggttaagtaacttgtaaaaagttacacagctggtaacttgcagattagggaagtggacctgggtctgcctgatgccaaagcttacatattacatgtttaaccaccccgccatgttactgttaagcttactataaatcctttgcagtgtataatcaaagagaagttcaatttcactcctatgtccatacaaatatatcttcaagaaaacaatcctaacctcaatgactaccattaaataggatccatttatacctacttgccaagtagtcatggatcagttatgtatcattgctatatatgtgaataggtcaagcgtgttacagtgttattagaacagtcaaccgaatcatgttaaaccctgattcataacttgtacttgatgcaggatattaactactcacagcataacacaattagacacccccagaacagaacaaaagcagtcaagagtatgctgtgctggaccccaaactagtgagttccccactcttccctcagaggctctagggatccatgaatctgcttcttctatcttctcacacatagaccaaaataaaacgaagtaggctggttgtgaggcttaatgaaatgtctcctcctaggctgttggcccagagactggccacttgtgaaattatatatatatatatatcatatatatataatatatacttatatatatatatataatatatacttatatataagtatgatatatatatatactacttttgactttacattttgcacttgcatttaaaagtattcattcagatcattgcatagtccttgtagttgcattaataggtaggaatgacatattttaattttgtcgtaaaatataacatacatacaaaagagtgcatgtacaattaatgatgaatatttacaaactgaactcacctaaataatgagcacccagatgaagaagtagaacattaccagcacccccaaaaagagccactgtggtcactaacccttaagggtaacctctatcctaaattggaacagcataaaagctagaagaactgaaaccgtggtctagctactaaatgacagacatacttggactatctgactccagagcttatacatcagacaatgcatgcttaaaactacaagcctttccacatttcatagagggaagaatatttttagttcaaaaaatgtttcacgatgtttgaagttaaaatgacgagtttctaaatagccaggcctgaaagagtgaccatggctgtggagaggggagcccatgatgatggctgactttcatgatgctgccccctggatgggttcatgacagtagtgatcaaaaagggctaagggccaagtcctaaacctctgtaactttgcagtcccttcggggctctcttttctgagaagatattcccacagtagaaaactgccactgacaaagtttcattggccaggtagtgtgagtcttaattgcaaccagattttatgtggcggaacagacaacactttgctctgatgatgtaattcctgccaaactctgtagtatatctctggtttctaattctccaaattcccccatggaattgttattcccttttcacagatgggaacactgatgttcagaaagtttaaatgccctgaccaaggtcacatggctagtaaattccttggccaggatgaaaagccatgtctgttttgactagaacttctgcctgtatccgttatatatcaagcttgaaacactccatagcttcaccaagagttgcttcattggagatagtttgactatggcctccagaatttcagatagatgtcctgaatttctactattttgagatgattcagaaggaatttgcagggcctcagaatgatcattaatcacatcagttactactgatgatatcagaaccagactaaagtattgcttgtttctcaaagtttgatccatggaccagcagaataaaatgaaggatctcaggccacatcctagacctcctgggtaagaatttgaattttaacaagatccccatgggacttgtgcacacattaaaatttcagatgcatcattgaatgcctggaaacaaagtttagtatattctgcaaaatgggctatgtggattttatatcttggataaaagacataaaaatatgagtgagattatttattttatttcaagaagaagaagccagcaccagtgccttgctgaggccaagaaactcaacttggcaatcccaattcctgaatcctgtttccataatcgctctccaagttctggtcccctctcacctcacatcatatagcagaaaacgtagattcccctgaagccgcttagactctgaaaacttggcccacagagcctcgtccttgagcacctgggcctgtgaatcatctgggcatggatgctctggtgagctttcccggccttggaacctcacctacaaccatttaatcgttgacaaggttgacaaagacaagcaatgggaaaaggacttcctagtcaataaatggtgctgagataattggctagctatatgtagaagattgaagctggaccactacccttcaccatatacaaaaattaactcaaaatggattaaagatgtaaatgtaagacctcaaactataacatgaggagtggtgagaagattctaacaggaaggatctctctccttcactttggtctctttgcaggcatgttctatcgttagcattaattaggtttacagtattcacacacctgctagggaaaaatagactccttaatttgctgcaaggtaaggaaacatcagccatctcagctatgcctttgtagacattataaatcatgtgcaacatcaaaaagatatttaagctccctaaatatgggttgcgttatttgacttctaatagcattctgactagcaatagcaaagagaaatgggtttgcactgaaatcatgtcagcagggaggttgtaactgctactctgaaaacattcttcctgcttcccaaggcattttgtcattagtggaacgaccactgtgcaattgatagccttccagaacttgttagctctgtaaagttgatgtcctctaaaatttcacattagcaagagcacatcacagagtcattcattcatttatacaacaagcatttattgaccacctactatgtagcaggtgcaaatctgtgtgctacagataaaatggtgaggaagtccaaactcaatggtgagctctctgggtgagacagacatttaacaaataatgctcaatttacactttaaaaaatgtaagtattggtgtcaaatgctagtacacaaaggtacaggctacagtggggatcggtgagaaagaattaagtcagttatgtagacatggaggatggagtcagagaagattttcttagagaaatgacttttaagctgaggtgaggtctgaaagatgaatgggtgtcaactaggtaagatgggcgagagagcagagtggaaataggggcttcactcccagcagaggaaatagcaagtacacagtccctttggtgggaaagagcatggaacattcgagaactgaaacaggcccagtaagacttgagagtaaagagagaggaagagttgcacacgacaagtgtgattgtgcagggccttgatagtcatgggaaggatggtgatgttttctctagtgcaatggggagacctcaaagggctcggagagattgagtataatttgttccaggcctcacagctgtaaaggacacagtggtgattcaaacccaaggccatctgactgctgagacagctctttcaatcacaatatagctcctgttcatttttatgcaactacactttttctgaaatctcctccaggccttaaacttcaggccatctctaattcaaattgtgccttgatttgttttgaaagatgtcttgggtgttttctactacataacaaatgggcactgggacagagtgcctgttatagtaccagtgagataagtgagtctagctttctatgtcaaataagctggtggaatttataatagagaacaggaccacagaaatctatctgaagaaaggcagtatgtgtcattagattctgtaaagagaagccgtgcctaatagatctggaattttctgaaggggtgactaagcaagtgaatgagggagagacagtacatgtaataataatcacagctgcatgcaaagcatttttgcattacaaaacactttattaataattacttctctcactggactgctgtgaacattacatggaatgatatattattgcctcatttcacagatgaagaaagaggctcagtgaggtcataagacttttcccaaatacatattaaggaaatgatagaactcatatccaaagcaagatccctccaactcctgagttcttaaccattttattgccattcagaggcttagcacatgtttattgtgttgaatagatgcttgccattattgtggaggaacttattgaaaagaagaaataacagccatttctctgatgaccccagatttctttcctgcctctgtgttgcctttcaaatccccaagaaggcatgtttatatgcatcacctaattggatccttacaaaagtctaaaaataaaggtaaagttaaccacattttataaaacaggctactggagcattaagaaaggggttggcaaatttttctgtgaagtgctagacagtaagtacttaatattttagggtttgcagcctctgttccaactactcaactttctggttagaaaacagccatagactataaaacaaatgagtatgattgtgtctgtaactaatggcaggttctataactatagttacagaccttgacattcgaatttcacataattttatgtatcatgaaacagtcttcatttttatttctttaaaccattttaaaatgtggaagccaccctaaacttgctgctgtgtaaacatagatggcattgggccagatttgaccttgcggccacagtttgcctttaagcagcctacactagagtgtatgcctaatagctgttatactatttgcaaaaagttgagtgtttacatcatcgggggttagaggattgctccatatccaaactttatttcgggcagaaaaatagaatgtgattttattcagctagagtatcacagggttaattacacatgctttcatctggaaaagcagcccctcgtgttgaggtttatgccaagagtctatggcccaggttcagagatggcatgcttcctcatcacagtttgttcctgagatgctggattcttctcatagttccctggatctgaagttctttaggaatggaaggggcttctcagctcagggtctaagctagaaacacagtcagcaaaggctactcatgcagggggaagtaaagccggtttggaatgattggatcagtggaactgccagtgcttacctttctactacgcctcaggcacagggtagttggcaaggtatctagttgacaacctcttgcttctttctaaggagcagccagctggtgtgtgagcacttattgtcctcatgctgccctggtccagccatttccctggctctgttttctcactatctgatatgtaaatgcaagagtgacagctgtcccattgctgaagatgtattattaacacgggatgtagcatataactgcaacataccatgtggagaaagagctaaaggccatgttttacagctggtgacttaaaggcgggcagggggtagtgcacaaagggaagaatgccaactctttagtatccactgaagcagtccctcatgttgaggttcatgatttagggtagaggataatactgtgcatgaagatgctaattaactgttaccagaacactcaatccaaaaacaaatgttgactttagggtcttagcatctaattatcttgcttgcagtgcaagagacacagtgtctttgcatatacaacaagccacgcttttgtgcacaggcaaatgtgttggatgtgacaatgcaaggactacaaacacttgtggagtgtgttctctatcggtccccaaaccagcaaggacatacatgatttcccagctggacttgtaggtagtaagtatccacccaaataggggaaacccctccatatatatagaacatgtatatatataaaatatatatagtttgtgatctgcataatatattatatatttacataagatgtgtgtagtgtaactgaaacaatggatccctttgcttaactcacagcatgctttgaaatatatatatgtatatataatataaactatgtattatcttggtgtatatgatataatacatacacataaacataaacattttttcccaagtttgctgtgagctaagcaggtgtctccattttctctacttatagtcaagtatggtaaaaacaaaactcagccattttggaaattatgtacaagactgtgtctactcagcagttctgctaacttagattctggagtttggggacctccttaagggtatttcatttggacctgagatccagcattcctgggcttcccaatggatcacatatccaagccaaatgtagtgaacacaggaagactgtgattcaggtaaatattagctattattatcatcattattatatgctggatattgctttaggtgcaattttatgcatgatctcatttacttcttgcaatatgcctatcaagtaagtactactattattcccattttacagataagaaaacttaggcacagagagggtaagtgacttgcctattgttgcatagcttgttagtggtacagccagggttcatacccagacaatttgactgtcaataccaagatcttaactctaacactatgcttcctcctcataagacagaattgaagcccataacgtcctaaatgtggtggagaaatataataaatttgaagaaagatgtaaattttatctttgaacaaccagccaattaatttcttctttgtctaaacagtcttcctctcagtccaaaaaatctagttctcacaaaaatggatgaaattaaaattacctatcctttgttcatcctttcattaaataagtatttattatatatgctagggcagtaagtagagatttcagtggagttaacggctatgaaattcttccacatacagtggttatcaggtcaaaggcaccattgggaagttggtatcaagccaaatgacattgaggagtcataaataaagttgctcctgaaaccataggatgagatgagattgccacatgcaaatgtctagagctacattagccaataagataggcacctgccacaggcagctagttaaatttaaacattaaaattaaatgaaattaaaatttcagttcttcagtcacactagatacacttaattatcaatggtcacatatagaaagtggccactatactggactgcagaggtatagaacctttctattatcacagaaagtgctattgcatagcacttacctagagaaaaaaggcaagaagagaaagaaaaaagaggtgttgacagacctctgtcaccacctgcaattaggagtcagaaagtggaaaacgacgcagtaaaggagacaaaggaggggatggatttcgtggaaagataaccaggataatgcagagtcaggaaagtcaaggtatgggaatatcaaagaataaagtgtggttctcaatgtccagtgctggcaagcagtcttttgaagttaaaggtcaaaaatatcctctggaggtggacatatggggcaaacatgatggacactgatgatggggcagctttgttaaaccggcactgtgctggacagtggaggtccctagtcacagtcgctgctttcaagtccaatggggcagacatcatgaggaagtgcagtattgatttgctttttgagcaactgacttgccactggcttactactggctttaaccctgtggatggcagcatggctccttacctatctgctgcctcagtggtcctttcaaagcctttgaccttaaacattcccaaagcagttccaggagtggtgaagcactcagagctccgggagagcagtactactcagttcaagggtgttgactgagtatagtaatgagagtaaaaaattgtgtctgtgacctttgtgaaattcatcagtaatcattaacaagatctgaatggcaagcaagagaaagagcaggcagcattgtagagaatattaaatctcaagaaccataaaaaagtatcgtcaaaggccttttaagttgacttgaattaaacccctgaagttctttcaggcacatttaacatggtgattctgctgagatcagggccggagaggaacataaatctacatgatatgacagtatctacatccagtatctacatccatgtaaatctacatccagtatgacagtattggattttgatccagtacctgatgtaatgcaatttgtgaccagacacatgttcttagaagctgggagaaagtttagctttcattttgacctgtccttacttgattgttccaggtttgtttttttgtttgttttcacttgtagctttctaggcacctcttatggtgagatgttagagaacctaggttaacagtttagatatggattctaatctggctctgtgttgacccagtgacctgtcaataaagtcctcatggtacattatggtacaagaggaaagaaagctggaggacttgacagtaagctcacattgaagtggaatcctggctatgcctcttactagccacatgaccttggacaaagtagttaaacttgctgagcttcacagggttttgtggataaggaggagtggtatggacaaaggcaagcctgctagccctcagtcttctaacttgcaactaattgtctgtaaatgttttcctttgttttggccagattccccacaacaccctcccctgcccaccttggtgggttccagaatctctcttctctaactttgtaaagtggggctaacaccgaggcaggcttgtgtcagctttgtggtcctttttccctaggaatgaacactggaactcaaacgaaggggaagagggttaatggaaagaaactgctttttaagcacttgcaaagggattttattccttgctttctctttggtccaagtatgcacacacaggtacatgcacacatagacattcaaaccacacagtggtgcctttccacttattctgtttaggatgactgcaaagaattgttgaaagatggtaaatatgtgttaggtgcacgacaatataaataacatcgatctgggttaacggtgcattgtttaggaactctggcacaaacatctttgagcttaataatggttgctaaaggtgacaggagttcagaaagcagaggactcctttcattgtaacaatcatctccccacttacccccactacatcctcatacaccccaacaaggcatgcatagcatccagcagagttccaggcatatagcaagggtttattaaaggctgttttcattcataaaatcactggtgctaatcgttaggtatagagaagaggtgaaatataggatcttgaccttcactattaacagtaacaattgccatttacagaaggcctatgatgtgtcagctgctttactgctctagcctcacaacaagcctacacagctccaagttacagatgaggagctaaagttaagagaggtgatgtaattgtcgaaagtcacatgacttctaagtggcagagtggatttaggtctcttggattccacagcccataccccttccacttttccaatgctgcacttgagaagtaggccagttgggacaatgcagtggccagacttcagctacagagtaaggcaggcgggactgcactgagaaggttaaagattactgcatctcccctggaaaccagggcctgagaacagcaagctgatcttttgtagctgctccacatattttctttctcctcagccagcattagaacttcattcttcccttgtttgcttgttcagagaaacaggtgatgagaaaagcacacttgaggtgtctggagagcaatgccctgctttgcttactataaatagctccctctcagccagttgccataaatggcattttacaggggaggcaaccagtttgaaataagccctaaggagatgtcggggcatcaatattcgcttggtgtatgcagtgttcccaatctattgcagaaggttaggagtgttgagttcttgaagcaaaagtggttttgtcagatacgtgatgccatcccaagcccttggtcagggaatctgcaattacccagaaatctgcttttttaatttatgaaccaaaagccagcaatgactcagaccaacctgcaatggaaaccaaatgtggactatgtgcagtaaatatttttacgctctcagcttccactcattactttttgctaccctgttggccttaaggagttgtcgttcaaggaaaggacctgcctgctgttccggcaaacctggaatgtgagcacttttgtattaaaatgtgtgcagaccatcctaaaatgattaaaaggaggagcatgaatttattcacatgagtcgctttcattattttccattagtaaatagccaaataattgattgtggagctgttatttaattagcataaatgaaatgactgttatatggaatagaatgtatatattgattttggctgtgtcctttaacaaggataaattttcttacttctgacagtttttgtaatcaaaactctttttttgctgaaaagcaaaaagagctgggggaccagaaagcttcagggtaggctgcaggagccaagcagtttaaggaggggacacatggtatgccaagggccttgcatttcctgtgtgagaggagccagattggactcatctcaaccactagctagtggtcactgagaagagagggtcgaagatccagagcagagatgagtggagagctgcaatgccaagcatgaggacctaggaacttgctgtgtttttcttgtcagtttcagtggtccggttgctgaggtcttggctgttgattgctctagctgggatgtgtctggaaaagaccatgcatagaaatgtacggtccttgctttgagaaggtaacattctgggactaaaacctgggtgcaagggaagtgcactgagcatcaggagacatgctgtgtgaacacatgacaggtccttttctcttccccagagtacattcccccggtatgtacattgagggaggaggagaggactaggttccctgagctcagatgggaggaagaagtgtagtagtagggacatttagggatcactctggcttcccctgcatttgtttctccccttccaacttgactttgaggagcagacacagcttccttattcccgcctagtaaaagttaacttgccacagatttagagctgaatttcagtactgcatgtgctagttcagcacagtgactaacagtacagtccctgaagtacaattgacctgagttcaattcctacccttactacttttttgatgtgcagctctgggcaactcaattatccttgattttcgttttgtcagacatggatgtaataatactaccaattcacagggttgctaaaggaactgaagtagatcatccatgtaaagcagctgtcacagaatctggtgtatagtaggttctcagtaaactttcctcattttctattcctttctgccttcctgatggtcccacatctccttgcctgtccctcattgtagcactcagtatattgtcttccttattcgtctaaacaattcaaggtcagagatcctgtgttgggcattttttggtgtcttccttcctgtgctccgttgccatgtctcatatactgccagctcactattggttcacacacatttctaggcacagaaaaaaaaattcacagagaaaaaaaattcacagagcagctagctcttccttcaggcctttgactgacattttaaggatggcagaaaacacagcaaaatagttgtttttagagtttcttggaaattcacagaggttccatgctggatttgaattcacctctaaatgtctattcagcaccaagttcagaaaattgcaagccacttgggagaatatgccaagtggcatgcagaaaattgcatgccacttggaattcagcgacatacactataggtgatgctcaaagggtggggaggtgggaaaggggtgaggttggcagggaaaaccctgaggcagtagtgatcaatgcacatgatatgtaatgtgaccaagagtcaaaccaggatgctaggtatgttcctcaggcagcatgggattaggtaccaagccagtaaatggcatactaggtgcacagacagggttgtttctcatcgcacccatcccctgcctctgtgtaccttttgctcaactccttcgatgtggctccagtataggtcccttgtcactatgcaccattacacttcaggaaaagaagccttactgcagcttgtggtgcccaaggaaggcttcacagataacagaggtataattcagcttggaagtaggtaaaggactggaattagatcaagagaaagaaggagggtgttccagatggagtatatagtggacatcacctggagccagaaatatggatggcatgttggggaaggaggattaggaggagggacagaactgtgagttcaacaggatgactggagtgggaaatttacaccccagactgacaatgtaatgtacaattgtcccccaggcagcctggtattcctgaaggctgcggtctgacaaagggctggggtaggggaattgcaattagctaagagcaaatggttatttctaaaagcatttctagggctccccatttcagttagaaacatatggcactggcaagggtccttgctttatttgggcccgttgcttagccttccctggccacaaattgctatggaaaaaagcagaaaggcagctgtcctgcctgaaggagcaatcattagctaatgctgccatctccaggagcctgcctgctaatagccagcacacagcagtcctgcttcaaactggctgcccaggcagactcctcccacccccaccgcagttcccagtgactagtttggcttctccagcctgaaatttgactggacagctggagagagggagaaactgcccagggcttctggaatccttgactgccagctgccttctcttttctctggtttgacaggaattgtagcaaaggttttcatctggaggatgagaaactccttttgttagtttgctagagctgccataacaaaatacggggtgacttaaacaacactaacttattttctcacagttctggaggctagaagtccaagttcaaggtttggtttcttctgaggcctctctccttggcttacagatggacaccttttccttgtgttctcagacagacgtttctttgtgcatgcatccctggtgtctctttgtatgtcctaatatcttcttcttataaggacaccaatcagattgaagtagagcccatcctaacagcctcattttaacttaatcacctctataaagaccttatctccaaatatagtcacattgtgaggtattgggggtatttcaacctatgaattttgtgaggacacaattcaatccataacacactgcatacagttatcagagagccctgattcttttcctctctgaacctttgtctccccatcattacaataatgggttagagcaagaagcttggagttcttgtcaaacaacaagttttgcagaaaagaaatgcaagtttgtgatgacttgctaatgaatggtgtttcacagttcagggtgatttcttattctgagaataaactaatgtaatttcattatagagtttgaacttgctatatattttcatgtatttgttatttaataaccatgtttattgccttatgcaggccacatactaggctaaatgtgagaaagaaaaagctgaatgcattagatcatatttttgaattagttcttattataagtttagacatgtattccacaagaaattgttggaccttgaagtgtaaaaatcaaaaccaatattgagtttataaccattcctctaactattaacaattggtttgtaagtatagactttgattaacttaattccctatagagaattctctggttggtttattgattgattgattcctgaattccaatagtatttttaatatccacaatgtgcaaggcatggagttaggtgctagggatatggtggtgagtgaaaccaggaagattactgccctcataaaacttactgtctagattgaatctgaggctacttgtttatttcatgaaatgtgatgagtgtatagtaaaagatatgttggaggcttctaagatcacccccaggtttgatgattcactctggaacttgttgggctcagcacatagtcatgctcctggctaagatttattacagcaataggacacacagcaaaattaacaaaggggaaaggtgcatggagagaagtctggaggaaactacacacagacttccaagagtccgctcccagtgcaatcacacaggacgtgcttattttccccagcaacaagtatgacagcacacatgaaatattgtctaccagagaagctcattagagaatcagtgcctacggtttttgctggggactgatcacataggcatcttctgcctgggatgtaccaaaattctagatgcccagaagggaaacaggtaggggtttggcataaaccacattgtttgtgcaaaactatttaaacatagtgaggcacttttaccatttagcaagttttgtatcagtgtaaagaacttttgccagccaagttcccagacaccagccaagggccaaatgttgaagcagtcctttctaaggacagaagtctcaggtcctgagactggtgaagtaatgtgagtggggctagtattctggaaattaagattcccaatggcagcagcaaaagatgcaaaagcctagtgggagagagagcctgacttactcatgaagctgaaagtagtttggtatgcccaagagaaggtgagggagtcaaggtaatcaaatggacactctttgtgatactcatatccatttattttttcaaaaaatgtgcattgggtgttatataaggaactgaggacataacagggaatcaaacaaatattcatgtccttatggagcctccattttagtgcactttatatgcatacactgaattatgtcacatccattttactggaaattctccagtctcgagcaaaacatcaacatttacatatatttcgcacactccttgataagaagaaacacaagaagatgccttctactcaaaattccagttaagactgtgtattagtaacctgtgtgtattaaatgctgataaagttgattctacttggaaactatttgttaccactatgatcagaggccttggcattttgtcagttgtgagtcccatgatcagaaacccatttatgtgctggtagtgtgatttttttgttgttgttgataaccataatgaagaacaacctgttagctatttagagagcagtaagacacaaccagttcagtaaagagatcaatcagctttattcaaacaaaagagcatcattagaagcctagcatcagatcaattttgattaagtcaacaagaatgctgccatttagtagactagaactattcttgttaactgtcaagtgtagtcagccaggacacatctcaatcctgtctccatattataccactgagagttcctcttggcttaacttgaggcatttcataaaagaaacatctactttcacagagttcagtcttacactcagaaatttaccagatttggccacaaaactgaagaggttgggaaggttacagcatttatacactcatctcatgaatcttatagattgacattgtttattttcaactgaattagtctctttcagaactccagtacactgataaggtagaaagttgattaatcagatctatcctgatgtctgtacgctaaaaatccaaagtgtagctcatagccatgaaaatgggaaaccacttttggaactgttactttgtttctaccagtacaataaatttctatatatttgctacgtttttatctgacaaagctgagtaactgacagtgcttccctgtctgctgtaggtagctaagaatcagcaaggagaaaaacacagcactccagataagtaaagcttttcctagcatttagctcttggaaatgacaaaaatttcgagacatgctgacgtacaacttgaatcactgcttgaattccttagtgcctagaacaacagaacagaggccagaaatcagcatgctctcaataaatatctggtgaattaattattgaaagaatggattaattaaatatataaacacaaaatagtaattagggagtgtgcaaaaattgaaactattctgtaatatggttagttatctgggtttctatttcaaattttaagattcatttcatgtttcaactataaaaaattcatcatcaataaaaatgagttatggaaggtgcagattcaaacatagatacctttgatttttttctgacaatgaggaatggcctcagagataaatgtctggaaaataaattgttcacaaaaatatattttagattaaacccatggtctgtgctttggtccaaacaatgtgaaggatttgtgtacttcaaggcagtataaaattgagagactcaggagcataggctcagaggacagacagtcctatgtctgaatgtgtgaactccaggaggtcaggggtaatgaggtcttgtttcccactatcactagactagccatctataaactttctgatcacacacctctgcctgagtgtgcatatttatgtatgtctaaattatacatacgtatatatctactaatatatttcatatttttatttgttgtattatagagtatacgcaaacatacacagtttaaaagttgagaaaaacacatattccaatatgctctttccatatctaatttttttttcttttttgagatggagtcttgctctgttgcacaggctggagtgcagtggcacaatcttggctcactgcaacctctgcccccggtttcaagcgattctcctgcctcagcctctcaagtagctgagattacaggcatgcaccaccatgctcagctaatttttgtatttttagtagagacgagatttccccatgttggtcagtctggtgtccaactcctgacctcaggtgatctgcccgcctccgcctcccaaagtgttgggattacaggtgtgagtcaccgcgcctggccgtccatatataattgtcttgcccattcctgaggctcatgcatcccgctttggagaacacttgtctagcatgtagtccatcataggtgctcaattaataacatttgttgaattattgaatgagtttaaatccaggtttttctacttactgtgtgaacctgagtaggttctgctatccatattctaggcctttgttttgtcatccataaaatggtataaataataatagctgtgttggggggttgttgtgaggcataaattaaataatatagcaaatgttaataataattgctgtgatattgatgatgatgataacaatggaaaaacatgtttaattctccacttcttagatgaaatgatttaggtcttgccctcatcacgtcattacttttgaccatggatacacctcatatattccagttgatacgatgcattccatacacaggattttgaagtaggatctgttcctgcaggacatctgttccagcctgtgaacataattttctggtaatgggcatagagaaaagcaaaaaaggaggaggtatttaccctctttaagcatatctccaaaagtagtgcctttcaatgatataagttgtgaaagaaagatgctagtggaaatgatataaaagcaagaccaagacacacttagaagagttgaagggtgacatcttatgtagtaactcccctatctaatcaactatgagacatagagttaccctccacctgcctccccaccctcatcagaacctgcctatgcctctgagcatggatcactttgaagtaaggcaggaatgaagccaggaaaagttctgcagggactcacatttctcatttctcttctgactccttagagcccagattctgctagtctggcgtatagtgcatgattatactgtgagttggcaatggggcaatagagggtgcagggaaagaaggaaggaaaaataacttcctcacctccttttctttcctcaccccactgtctccaccactttcaccaaggttgtcctaccaaggttgtcatcttctaatgacaaaagccagtggatatatacaatcctgaactaactcgacttctcaagagtgttttatttgaactctcaggaggcccttcttccttcctgaaactctctccttccttggtttgtgtgatatcactattttctactttgtcttttaccttttgtctggtcttccctagtctccttcactgcctcctcttcctctatcataaatgttagtgtttctcatggtttcatcctcagccttcttctaatcttgctctatgcattcttcctagagcagctcatccatctccacacccccgccatgactgtaaacaccatctctttgctcatcactacagaatctttatctctagaccaggtccctttcccatattccaggcttactacttttagattatcttcactgccttacccctacaggcatacctaacactgaatgtatgtgtatatgtgtgcgcattcacatgtatgcagcaaaacaattagttggcagagagtcaaaaaaaaaatggtatgtaggatgagctgtcactttttgagtgatgttgtgcacatttagtttcctcacctataaaaatgttaaaaaaatccatttcggtgatgggttcactagaagcccacccccccatttacaaatgtattacccatgtaacaaacaagcacatgtaccccctgaatctaaatttttaaagatgttaactaaagctgtcttttggaaagaaataaaattaaaatgtccctccattaatttgaattatttaaaactctgacagtttagcattgtaatatagctggaaataattattgctctaatagccaacaactgttttcacctaaccatagttatttaaatcacccatataattataaacctttatttatttaaaaaaatggggaaatgcgctccaggtttctaacaccgcaaccatcctgttgcccaatcagaagccctagaatactctttggaacctacctcctcttcccctccccattgcagtccataaccaacgtctgtagattgtatatccacagtggccctgtgttctgttgccttttctctagtcacagtgtcattgccttaattgaggctatcaacattgctcttgcacaattgacatgctctccgtagttctctctgcctctagtcttgtggctacaaccaccatactagtcttcatgctgcagccactgaaatctttctaaaatgccaatctgaccaagtctctcccttgcttaaaggcctagcatggttccccatggcataaaggattgtgtcaaatcctatcccgtgatccagggggtcacacataatctgactcctaacaccttccatcgttttatccctcatcctatctctggaaatctgtgctccagccattccaaactgcctgcatttctaaactgtgctagactgtcccaagcctgcatgtctttgtacttgtgaaatctgcctgcatttctaaactgtgctagactgtcccaagcctgtatgtctttgtacttgtgaactctgcctgcaattttctcagcccagcacattttcaccctcccaacaattgatttgactaatggccactggccttcaaaactcagctgcaaacacttgctctgagacaggctttcctgatcatccctgaggctagatttggtaggtaggcatgggtacccgcccccctgtgattttacaatgcctgtgccacatttctgtcattacacttatcaccttttaagataattatgtgtacgtgtgtgtgtgtgtgtgtgtgtgtgtgtgtgtgtgtgtgtgtgtgtgtattttggtctctcccccctgggactaaaagctcatttaggccagaggctttgtatgatttctctagagcagctactctcttcacctagttgcctcctgctcttccttcgtttctcagcttaatatcatcttctctgggatgctttccctgacttcaacctcccaacccccaaccaatggaaggttctgtgagatatccctcctctgtagcatagaacttctcctttgcattgaaagtgcctgtttattgtctgtctcttccagtaaacactgaactccttgaagaaagggactaggttttgttcacaattatgtttcccactgcaacctcctatagccaagcacagagagcagtacagattagacacttgttaaacatttgctgcttcacttttcttttggagattgtgattttgcctcttatttctttcattaaaattgctttcccatttttttaaaaaatatttttattgtggtaaggaagcatagcatgatatctactcttaaatttttaagtatacaatacaatattgttaactatgagcgcaatgttgtacagtggatttccgtttttaaaacactcctggttactttttggttacttttccaagcattatatagttttgtaagtttggactgctaccttgtcctctaggtggcgttgtttgaaaaagaaatggcaaagttgtatatgctttcaaataaatgagtactgtatttgtctgctagtactgacataacaaaataccacagattgagtggcttaaacaacacaaatggatttttctctcagttctggaggctagaagtccaaaatcaaggtactgttaggttggtttctggagaagcctctctttctggcttatagatggccacctcttgctatactcatatatagcctttcctctccatggaaagagattgagctctagtgtttcttcagcttatagggacaccagatctatcagattagagccctgccttatgggccctaatgtaaccttaattatctcccttaaggtcctgtcttcaaatacagtcacattgggggttagagctttagtatatgcatttgggggatgcaattcagttcataacaggtatgcatcccaagattatcaaaattttgtgcaattatatgaaacaatatatttaaatcaccttggagcaaaggagcagaattagttgtaaccaatgatcaaatgttctgagtgtcatttaccttatatctcaaaggagggggattatgctgctggagcagtgcagggactagtggaagtcccagagaacctttgggcttgagaaacggtatttgaattctctcccattccatcccttcaggttactattcctgaagcctagaatctcgttggcaggcagagaagctccattctctccaggtcaagcggacgtcttcaaggactttaattttaccatttccaaggtaccaggcctccaaaagctccctcaaagaacccttgcctagaagagaaccaaaaatactagaagcagtggagatggcctcatccttggaaactttatgacctcatcccgctctggccatctgatagatgggttgagaatacagtgccaactgagattaagacctttgagaggccatgaagaagggcctttctgagtgattctgtcagtcctggctaaagaggcctgtgcccaggagacatcagcctggcgtgcccttgaagtgtttttcactcaatgctattattaagggaccttagtagctactgtgggaaataaaggattctgaaggcaaattagtatgtttattccggagtttctcacataaaatagatttatttaccgtaggctttagttgaacctttagcaagccaaatacataatactaattaccaatagtttggtgtgctgtgcagtctttcacaaactcactgatcacaggaccttttcagtcagagaatcttgatcagattattattctccaagactctcttttaggaagggtaacaatgaagaaaatcatgaaaaaagcgattgctgtgagatgcactttgactcaaataattcctccaggcctaccctgctctctccctccctgagccacctacacattggcccccagtaatgccaaattcgtttggcctcctatcttggctgggctgccttctcctgttagcatgcctttttcttgactgacttagaatttccataggattctgttgtcagccttgtttccaggttccattctttctgatgagaattggtgggcacacagatcaggcccttgggagtgtcagaacctggtttgttcctaactctatcagggagcttagagtctgccctggttacgagggaaacagatgaaatcacttgatacctttcaaatagaggctttgcttacagcccagggtagagtgccctagggagatactaagggacttgcatactagccatcttacaaaaggctaatttgcctggccacactggccaaggaagaataataagaaggaaaccaccccactgcttactgtatgctgggcactgtgataagtgctttgcatacattattcgagttcttacaaccaacctatgagatagacagaatttttggatccactttacagagcaggaaactgagtttcaaaaatctgaggagacaagcccaatgaagcatagcttagcataagcagaagagcacaggactccagtctatgcccttgtggctctagggtccctgcttttcactacttttctctgttgcttccgggtgaatctagggaggtggtgaggtccatctgcattgtgttggtcaaatcaaagagtaccttagatagctatttgaaatagtctctttctgccccctcctgcaagagccaattacttttaggaaatagctctgtggtcaatagaactatttttttttttatagacaatgatctaggttctggtagggaacctacaactccagtcttcatcctcacaacgaggtgctaacttagatcctcatcactgtcacctgtgtctcttaagagagctccctatatcctatcttcctctttccccctcatattctccactctgcagcccaggtcacctttctgaatgtcatttgattcctttctggtgtaaaacctactcaccattgagataaatccaaactccttaaactggcttcctaaattattccctgcctatttcttcagtgtgtacctcccaaaccctctcctctgtgccaaatctcaccccttagtctgtggacatgccaaacaacttccagtttcagctgtgtcctgtttagtttcaggtaatttcacacttctaaatattctccctcaccaacctcatctgccttgggaacagctgttcaattttcaatgctcagttcaactatcacctgctgtgtgaagtttttctggttccctctcaccttctctgagtcttgccaggcctggtacagcctcagagccttatattctttaagatggcactgattgccttctgcaggtatctctcatctccagacaagctccttccccagcagggacttgggattatttattctcgtgtctcaaacacccagaacaggcctaatccataatgggaacccaggaaatgtttgctgaataaaagaatggaaaggaagttttcctgaaatagagtaagaatttgacattaattttgaaattggccaagagaatcttcaagataaatgaaatgaataaggattgtaatttgatttgttttgtccctattgtcgcgagatgctaacctggaaaaatctaaatatttaatttatctttccatgaaactcctgagaggaaaaagaaattgttgaagccggggttggtgccttgttgttgggaggattagcatgcaactgaaatacgttatttctccacaagggggtgctatgaacacatacgaggccattctcttattcttcctcagagagagagaggaactgcacaaaccaagtaacttttttattttccctgcattgtatacaattgtgcaagaatggaataactctccaccgttgccagaaaattatgtatgcctcggacaaggcttcctactaataagattcacactcacacacatacccctaactcctttaaaaggttcaggcatcaagtttaaagatgtatgatttgtggtatatctggaatttgttcattgacagatttagatgttatgtagtatgatgtcagaaacacaactgaacagaataaaagcatgcactatgctgcttttaactctcgtataggatagaccattttagaggaagactcatccaggtgtcagagatatcagtcagctcttgtcagtaataacacgtagatatagtagtaccagctgtgtacacttgtttagatttgtttcttatgaaaccatgatgggcagcacacataacacagtcaatatttgggaaagttgtactttgtgtaaccagtggcttaagcaaatcaaatcttgtcttcaacatctcatctccagtttctaccttcagcatattttgatggccttggattctgagtaatatttttgaactgtactcatgtatgtcttcccatttagactcgttcctttaacccctgggctctgtgtgtatgtgtgtgttttccatatttataactcctgcacatgacaaaggtcctgatacattgtaaggactcagttaatgtttgtggattgcttccttattgatctgttttcacaaaaatgctgccaaaaaatgtcaagcaggataatgatgaggttacaagagagacaagtgaatgggcaagaagagactaagggtaaagtaagaggactaacttccattgactgcttacgaaatgccacgcactgtgctgaggactttatataaatatctcatttaattcttataaaagcccaataaagaaataattatcaccccagtcccaccacctgtttttgcatgattgtggccatgatatcaaaataatcaaatagatggtatttggaggtatataatagtctttacctatgccttccatacatcagggcctcaatggtgcttgactaggatttgcactgtgggttagtatagttcatgggttgttatttgaagctgactcttgtgttcatgcaggagggcaggaatcttcctggctgttctgtctgcccctgttaccctcagtgaaaatgaaaggaagcacagtacatagtggttgacaggaatgaaggtttccaaccttctaactgtggttggagagcttcctgtgtggcatttcccctccttcctggaactctttagtattgtaggaaatgagtgacttgggcaattgcgatagacttcaagcaattggattcactgaagaacattttatggaggaggaggaggaggaacacaaaatcttgaaagctctgggttgagagaaaccatcaagggtatccacgttaaccactaagcaagcttttgaatcccctgatagtattccaaattgccatctctgtgaccttgaacaaaaaacttcacctctcttagtgagtttccacataggcaaaaacaaaaacaaaaatgaaaaaaactaaacaaaaccttctagggttgtcgtgaagatcagagagaacgtactcctggaatatattaggtacccagtacaagttttaaaaatagactttatttttagagcagttttaggttcatagcataactgatcataaggtacagagttgacatataccctgtgattccctggatggcctccccactagaaatatccacccactggagtggtacatttgttacaattgatgaacctatattgacatgcccttatcaccgaaagtccatagattacataagggcttgctcttggtgctgtacattgtctgggtttggacaaatgtataaaaggccattatagtatcatacagaggagtttcactgctgaaaaaatcctctgtgctcctctaattcatccctccttccccaccaacccctggcaaccactgatccttttactgcctccatagttttgccttttccagaatgtcatacagttggagtcacatggagtaaccttttcagattggcttctttcacttagtaatatgcacttaaagttctatgtattttcatggcttgatagctcatctcttttagccctcttttatgccattgtctcgatgtaccacagtttacttattcattcacctactgaaggacatcttggttgcttctaagttttggcaactatgaataaagctgctataaacattagcgtgcaggtttttgtgtggatattagatttcaactcatgggtactcagtattttttaaatgaaaaatatatctgtccttactcccataaattcctcctttccatcaattcttcccaaggtgagggatcagtgcatacaagaggcccaatttgcagcaaaatgctcattaattagccaagaggctgcggtggcacagcaagtaaacaacgtactacaaatctgtttacagcggcttctgcagacattttaaaacaattaaactgtcaagggggcctggagacaagagctttgcattttaataggaaatgattaaatctcaggcattattgccttcgatgtgtctaggctttaagaagagggcagagtattgattgaggcctccaggaaggcaggaagcttacttgtgctgcttgaccgcaatgcagtgaaagcttggagatctgtaactccttgggctggaattaaaggccagtagccaaaaatttaactggatttgtcaccttctgtttagttggactctgcctgtaggaacagatgatagatcatgacctccggggtattattcgtcaattggcagagagagagagagagagagagagagccccttgctgatggcatctattagaaaaggctgaatgacacagcgccatgtggtgacctcagtatttacactatctggattaaaaccattgtaaagcaagtgaaagccacccatgtagtcactgcctgagtcaactaatgcaaactgcactctaacctgtgaatatgtgtgtgccacagttatgacggacacgcagtctcaaacatctagtgtattcaccttctctattgatttcatctattcacaggtgctggtcagatcacatgtggttcttgccctctagctactcacagtccagtaaatgagggaacatgtaagcagctgggtacaatccaatacagtgatagatgttgttggctacagtgaggggaccaaggaggtcacattcaaattgagagatgtggaggggctggcagaaaattctttctagagaaggttctacttgaaagattagtaggcagacaaggggacaaggacacttcaaactgagggaagttcttgaacaaacctgtggaggtgtgaaaaagcctagtacattccaagaacccagtctggtagtgtggaacgtgagtcctctggtactttttaaaggatggggtgaccttagtcctcaggtttaaaaacttaatcaataaatgatgacgttattgaaatatatcaccacataatgctaaatagaacaggtgagcactaccattctctgtgcctttctattgcttaaaatccttccatttgtcatacttcttaaaagtatgccaattggagaacaagacacttgcttccaaaatgagaatacctttgtgaaaattgacaaatttgtgtgaattagcttaatcagattgctttcttccacaacacctgaccaagaccagccactctgatgacgaggagaatagggggatgtggaatgcaaaagaaggtaggagcatggggtactgagggtggagagggctcctcttgcagtggaattacaggcagctagggagcagcacaaaggccctgcatggctgagaattagtttaggggaaaggaaagagaggatagcagaaataaattttacctgacttgcaatttggctccatgtcggctctcattttgtttatttctgtgctgtctagacatcaacagattgagctgctcccatccctggggacccccttccccactacactgaccagtgcagccccctgcagggccattataagaagctatggcacagctgaaagactgagtctcttgattagacctgataagaccactcatattaagatgacttaattttgtcccttgagaaatgcctttttaagagctcccacattggccaagagagactgcctccatattaagcttttctatttttgtttgaaggaagttggcacctctcctgtgtaaagagtttgctgaagcctaaattcttccattagccattttggtttgcaaacagggatctgaatatatgcagctttttacctggtggcctgagcacttgctcagcttcccaaccagagaacaatggggaataccccatggccacattctgaatctgatcatctgtgcttctaagcatgattgactagttaaaataatggttttctgggaaacaggactggctacagaatttgcaggggttagtgcaaaacgaaaatgtagagatccttgttcaaaaaattgttagtttcaaaatggtgacagcaaatcattaaacccagtgcagggcccttctcagagcatggccctttgccgctgcataggtcatgtgtccaggaggtagccctaccaaagaacagctattttgcctttttgggttctaaaggctcctgttgttcaggtccctgggctgtggatggctattggggtataggggacggtgtttgatttcagggcagaacaaattttctccatcctctgcctactgctgaaatcccatcctcagagctaaagcaattttgttgaggctggatccctttgggaggggctaacatttgcagctgttgtctgttacacgcttagtgttggatggaaaagtggagggagagagcacaaggcaattttgattatgcagagaagcttatgaaaaaatatgtaagtttatggaatgcttttggatatacattatcttcctttccatatagcactgaatatgggtactggggcttaataaatatagctcctcgtgggtgttggtaattcttcaatattcattgatagtgacaatattcagaacttgagacagatttcctttctctctgactcgagggcagttttcccagagccacacagaaggagaatccagtctgttcaaaaggaaagactcatttgatcccagaataacttacatttccatttctatttgaatttttaacaaaaatagtgggtcttccataaagcaaaaataaaaagcatggcaattttgtttcagggtttgctttttcttaaaattttgattcctatattaacactattgagtgcttcagtaacgagtatggtgtaatgctaaaatagtctgtttcttgctctttgttataattagctaaaagccttttcataggctgctcatagattttctgaatttttaacaagggactttgatatgaaaatataattttgtggcacagaactaaaagttctggtagaatttcaacattttacgtgtaattgttacagaggattgagcaactataattcttacaaatgtctattttgcttgtagcgttttctattcatcaataattcaatttcaaaataaaagacacatttcaacatcccaaacactatcggggagactttcagattcctgactgtgggagaagtctaccaaataaggcagccagctccaaaaacttctctaatgtgctgagggatcctgttacagaccgtttttcataattctagaaggcaaaataaaattttatgcttggaaataataagtttaagcaaatagtataggcaaagcttatgtctgagtccaagcaatggtctgattactgccagaacaatactgctacatgatgaatcattaatgatctgggagagccataatggtctgtcactaatgcccattaatgatctctctatactgagagtatgggcttgatgtttctggccattaccttggagaatactttagatatgccttaaactttctctgatctcctctctctctgtgtctgctccaaatgtagacagcaattgtctgggtaggaccagcttataaagaagcatggctttgttaaggaagtcgtattcaggtaagatttatttctgcaatgtttttgatggacatagatttgaatgtttatcctggacattaatgcctttgtagaaattaacaaaattataccagggatctttctgctgagatatttttcgttctggatgggacaggggttcttgattccctttactccgggatgtttgacgttaagaatggattcttttggaaaaatgcatcatttttttttttctgggaggaatttaaaatattaattgttataggaaactgaatgtgtatttctgaccatttaaaactctatttacatttagaaaatggtggcactaactgattcaagagagatttcctacttctagatttgcatttattctatgcatacagcacaaaacattaattttaatttctaaagaaaaaagagaataagtaattataattggcttttaatgtatttttcttttagcttagtgaaagaaaggaaagaaagagaagatgacacttagctaagggaaggtggacacaatcacactttaattttgacaaacttattaggtgtatcttcagggaaatcacagaagataggcactctataatgtctcagcgaaactaggagagtatctgttcctccatggcggcaaggcagatgccgcagatagctgatggaaccaacgcccaagagcttccagctcacggagaaaaacaagctgagagaaggttgccggagcgaccagtttcaagtctctttgaaaagagcaggacagggattcttttggaggagtgaaatcactcctccagctacatttttaatgggaagtttttacatgtaactaataaaaaaatggttttgccaatcttcatattagctgaataaagcaacctcatgaagcaaacactttcattgaaaccctttgcacttgctttattgttgaacctgaaagaatcccagagaactcttaaccttgctaaatgttttattttgctagaacattttgtccagatgagtaattattcatggtgattttctgtttcctcaaaatccttctctctgtcctgaaactgctgagtagcatgtgtttattcatgtaattaactgggattaataggctttctcttctgagtacttcacaggatatcctcagctatttggagttctcctagagcatccccaaatggagatttggattgatctgtcatgttgcatgagcattgtttatctgattgtttttaattggtttccccataaaattgagagagaaaaaaagcttatttgaaagattagtacatcaagggcaatattagtgatgaaaatcgttacagaatttgtgagattagttcaacatttaattttctgattatttccacaattcatgtctctaagaaacccgttagagttttcaccttccaggtggtggacagcttataatcatcattaaaggcaggagctacagactatatgcctctttactcaggatacagtatatgtggctgaaacaagtacactcatcactctgcttgtaaagtatttgagtgaaacacacacactaattatttgctgagtaagatctgtgacacaggaaattctcaccaaacaattattttattgacatgtgagtctatgaattggagactgtcaaattgccatctaagctgtttggttagattcaagcacaaactaactttatgcttacaatagacttataggttgattgatgaaatgttataaatagacatgtccatttttaataaatgtatgtttgtgggaaactgagcccctttgcagaaatgaatgcaagctgtgggacagattggtagtgattgaaaatgctgcagttgctcctctgaaagaaatattaaaatatctgatatagcataggctctgagttcatggtagaacaatgcaatgcaaatgaaatcaggagaaaggatatgcagccaaagaatggcgagtcgcaagaaaggtcacatggtttatctcttagccttcatacgggaaaacacttcaacccttgtacacagatgagactgtcccagccaccgcatccacaagctctctaaagaactcatttcaaaagctctcaaggcaagaacatccatcctaagttctccatctccagttaagtctgctgcctctcatttgatcctcagggaagctaaagaatagacagcagctgtgctctgtgtaacccttcccagcccagaagctctcatgattatgcttatttaagttaaggaaccctagtttctttagtctaccctttcaatcttgtttttaacctaccttatttagctcacccatttacttctctaaatgtttttgtccttgttgtgttcccctctgcttgtccacaattacttcttcagctttttaaggtcctttcgtgttcttttctaagtaattatgagtttttctattcagtggctattcctacacctgcctagtactccatgtatcatattgacttagagtttctcaaacagcacatgaagacagattttcttctctcggggaagaaaacaatatatttacatatatatatttgtgtatatatataaaacagtatatttgttaatcatttccttagctgtagggacttaggaaacaatatgtttactaatttttttttatcaataatcccctgtccatttttcaggggttgcaaatgtgtactttcagctgttctatagatcactcattccaaacattgagtccattatcacctgggcagtgcctcaaagtgctttctcatgatatgcagttccaactgcctggccctgggcttgtgcttagtatatacttagtttttgttgagtaactgtatatgcccaaaatggctgtatagaccactagaaaatatttctttatattttctttgggaaaatgattaaacaatctagctgatcttataaaacaaagcataaatgaccatcttcaatttgggtttctagaatgtatagcggtagtctatatttgtcttttgccatttgccttagaaactggaagatttgaactgagaaaactattacaagtgaagacatccagggtggtagaaaaattcaccccagcagctaagctcttgagaaggaaggagagtattcaaaaggaagtgagtgcctcctgggtagaaggagttctgtaagtcccccttgggagtaccagtctcatgggagaaaaatgtgccataacttttattttcattccggcagggccactgggtatggcctaaaaatttaggcatatctcaattggcagtataagtgtctctcgttttataaaataaaattgtttccagaaaattatatgtaaatcaaatcccacgtgaaatccacatgggatatgcagtaaagaaaggagcctttttgtgagtgtttctataaagcgaagacttataatagacgtattaaaatgattactctttaatttatccatttgaaagtctgagttctaaaatgtcagaatgaaaacaagatatctgcattctattcagaagaaattatttgaccaaagcttgctaagcttatgtatgctttaatgtaataatgcctcatttgtgagtatgttaaaaatggttacatttaagtctgcttactttgctttggaagtttctgaagagcttattggtgtttcttactatttagcagctttatctgatatgacattatattattgccttctaaaatagaatttttaaaaacttcatccaaaggagccatgaataactggcatggccacttacttatgtaaatagggtatacacatatctcctggacccaaaactctaatctgttaccatgccaattccctatatttagttcaacatgccgctgaaatgtctaaatattggctgtttcccaatgtactccatcctttactctgttcttagagaatgaagagttatgatacaggaacttcgccttgtacaacagagtaggtgttatttaggcacattccaaggctccagagcagtcagccttggaggtgtttactaggactctttctgtggttggttagtgcatgcatctctgcgtaaatacaaaatataagtgttctttgtagtattcattgttccactaatgcttaactgcatagctgaatgagaagatatttttccagctctaatactagctaatatgataaaatctaaataaagtctctaaataccacattcattatgtcccttccttatatcaaaacttttactggcttcactttgaatgccaactagttggaggcagtgtttgatgttattctgtaagcaaagcctacagtagtctggctcaacatacctttctagtcttatctccttcctttcctacaagaactacttcagccaatccaattgcctcctagaggaatttgcccaattcattaatgtataatctatgcagtgctctctctgtgatgtgctagacaccaaggaaggtgccaagatgaaagaatcatggaccctgccttccaggaaggcacaggctggctgcccagctagcttctatcagacactctgtgatgaatgctataaccaaaataacacaaaagcagcagaggactagaactaggaaagatgctttctgctggctggatttgggatagcctcatcgaggaggtataaattaaccagggacttaaatgtatgtgaaaatttggtttgtgtcctctgagatacctttcctctcctgacaaccaaatgagatttcttcacctctagaactctcacagtacttactggctaaaccaatcatatgacactcatccaaaactttcttacattgtttttacctttgtgctcattttcccctctagattattatattcctaggaggcaaggcccatattcaacactttatttccctaactgatagcacagaactactaatgagagtaactacacatgtcatttatgtgaaaaaaaaacctgattgggttctgagaattccttgacttagttaaccactgctatacagtagaataccaagataataagacagatgacaaaatgactcaaatttactactactggctgggaacttcattccaaaccttaatatagtctcctgggaaactgcactggattgcatacaagctgtgaagattcctttgccttctttcattcactcaacaaatatgcagtgagaacctacaataatagtccaggcactgtgctagcttctaggtatgcagtactgaatagaacatggaatatatagtctagaagcagttcaaacagccttttggtccttttcccccaagtcacatcatgaccctgtcctatatagcttttctaaatttttttgtccccttgcgctgagcatctatcctatatatcttagtactccaaaggaaaacagtccaaagacaaaatgtcaggttttcattttttttttcctgtccatactatttcattctcagagtatgtgatctgcttgatccttgttaaacagtctcttggctcctcttcattaaataaagtagtcttaaataaccaccctactggttagactgtgtgatcaaaaaataaaaactaccgtttgttaagtgtcaactacagcccctttcccagcttgtacactgcacaggtgtaactcattcatacagtaactgcacaatgtagattattgttttcctcattttaatactgaggggaactgaggctcagagaggttacataacatgaccaagatttgtgattaatgaacactgaagccagtctttggttcatgtaatgccatcctatcccagatatagtagattttcagcaagttttggtttgttcattggttgattgttaccattctgattgaaagatctttatatattttagattacagtataagaggttgttagtctttggtagctattaatcccaggcatgtgtgtttatgttcctaatagcaattacatgaatgctttatgcttaatagaaacaaagctattattttgatgcttaaacattctttaaacatttttacatgaatacatattgataattcatgtataaataacacaaaaagatttagaatcccagttacagtttctgtaagatgcccagtttcaaagatccaactaaaaataagtgtcagctcattgcaataaaataaaataatctgattttatagacatatgaaagctgactcataacactcataactcatgaaaatatccaaaatcacattttgagcattagcttcaatgttgtctaactacattatttctatatgggaaaattctgtattctgggctgaaaattctgcagcccagctgttcccaaactttagtgtgtgccatcaatatcctctgtgaaactggctaaaattgaagatttcaagctgagttggttggaacccaaggatctacattttaataagcactccatgtgattctgatacaggaagaccatccacatctcacttctgtaagtattcttctgcaccagtgactcactagtcttcattgttgtcgtcccctcgcccatccatacacaagcagttgtgtattgcttttaaagtttttttttcaatttaagtgtaatttatataaaataaagtgctcagatgttaagtacttttatcagtttttcaaaatacacatactcgtgcaatttattcctctttcaagatctggaatattttcatcaccccaaaaaggttccacatgccttttcctagtcaacatttctctgccaccagaagaaaccacttaatttacttctatcaccataggttcgtttttcctattttagaacttcatagaaatggaagcattacattttgtgcttttttgtgtgtctggctactttcacccagaatactgtttgtgaaattcacctatttttctgtgtatatcagtaagtcactacatgttatggctgactagtatccattgcatgaatatgccagtttgtgtatctattctctcattcagagatatctggattgtttctagcttttagcttaaatgagtaaagctgctataaacattttttaccaatctttttgtggacaaatgtttttatttcttttggacaaaaacctagcagtgaaattattgggtcataaagttgatataagtttaactttttgagctactgcctaagaattttcccaaatggctgtaccattttatatccccacaagtgatgtatgagagttctggttgttctacataatcatcagcttttagggttgtcaattattttcattctattcattcttgcatgtatatggtagcattgcatcttggtaataatttgcatctgcctaatgactaatgatgttgagtgctttgtcatgtgtttattggtaatttgtacatattctttaaggaagtatttgttcaagtcttttgccaatctttattttcttatcttattgagttgttcacagtagctctttagtatctttttaatgtctgtagcatctctagtgatatctccacttctatttattatattaatgattcatttttttctctcttttcttggtctatcttgctagcggtttaaaattgtattaatcttttcaaagaaccaacttttggctttcgtgattatctccatttgttttctgtcactgatttcctttctcatttttattacttctttcttcctacttatttggggtttaattagtttttttcgtttcttaaggtggaaacataaatcatttattttataactttcttctgtttgagtgaaggcatttaaagctacaaattttcctataataacagctttacattaacttcattgttttgatatattgtactttatcattcaattcaacctattttctaaccttctttttgattttttttttttttactcatgacttatttagatatataatgtttgatttcttattgagggggtggtctatgtacattctggatgttaattccaagcttgatatttggcagtcagataacatactctgatttcttatgaatgtatttaaatttgggttatggctcagcttatggtttacttggtgaatatttcacgtgaattaatgtgttatttgctgttggtcagttctatacgtttatatcaggtcaaattgattgacagtgttgtacaattcttccatattctgactttgtatacaatttctgtcaatttttgaaagatgagtattgcaagttccaactatgattatggatttacctatgttttcttttagtgttatcaattttttgcttcaaatatgtagtgcctttgttagtaggtacacacacatataggaatttgtatattattgattaattgaccattttataattatgacatttcccccattatctctgataatatccttcaccatgaagtccaccttatctgatagttatacagccacaccatctttgttaggattagtgtttgcaatgtgtatgttttctatcttttgactgttattgtttatgtgcctttatgtttaatgtctgtttcttgtaagcaatatgtaattgagtctctcttcttctagctcccaaattctgacttttatttcgtttttcagtccattttattgtaattgttgatgtgtttggatataaatcttccattttagtatttgagttctatttgtcccatcttctctgtgtccctctgtttttcttttttaatgttttgggagtgaatcaaataacttttgtattacattatttttattatttttggcagtttctcaagattacaatatgcatctttaaattatctctgctactttcaaaacatattctattacttcacaaacaaggtaagacatttacaacattattcttccaattttcttacaaacttcatgattgttttctcatattttattctgtatgtgctataaacctctcattacaattttattatttttaatagcagtcaatactcattgatgtaatttctatatacatgcacacattattattatttttttattattatactttaagttctagggtacatgtgcacaacgtgcaggtttgttacataggtatacatgtgccatgttggtgtgctgcacccattagctcatgatttacattaggtatatctcctaatgctatcccttcccccctcctccaccccacgacaggcctggacatgcacacattgtttttaaaataaagatctttaatattttacaaatttatttactcttcgtgtttttcatttcttcctgcagaattggatttttatgtgatataattttccttcattataaagaacattttttgttcatttcttttagtgtttatctgctggagaaaaattctatgtttctttttttctgaaaacttatttattttaccttgatctttgaagaatatttttgctggatatgtaattcaagtttggcagattttatttttctttcagcactttaaagatgagatattccattgtcttctttccctcattgttttggtcagcagttatatatctctcttattgtagtcccactgtaggtagtgtttctgttttctctgccagcttccaagattttctcattatctttggtttttagcagtttgactatgatatgcttagatgttttttgtttgtttgtttgtttgtttgtttgttttattaggcttatttgatattctctgagattcttagatacataacatgttgtctttcattgattttgaacaattcttggccattatcccctcatatacttctgcttgattctctcttctcctgagactccaaattactcatgtgccagatggtttcctattgtcccacagatatcacacactgttccaattttttttgactgttttctttctttctgttgcatttggatactttgttttcaaatgtatccaagtcacaaattcctttctctactatattcagtcaactgattagctcttaaaaagaattcatctctgacattctacattttatttctagcttttcaattttttctctatttgtactttccatcgccatatgtaaataatacatttattcaagcatgtcatttgcttttctcactagaccttttaaaatatgtatcatagttattttatggtccctgtttgataatcccataatctgggccatctctgagactcagatctatcacttgagtatgtttcatatattcttcctttttttgtaagtcttttcttgttgtttatctaatttctacttgaaggcaagtcactatgtgtaaaagaacagaaactgaagtaaattatgtcaatgtccaaaaatgagaataccttttcttctattaggccattagtattttgtttgggatcaatctactcttatattgatctagatctgagctttagtgacattcagttcaccacagactttaccttatttaggagcaggatcaccatcttatctacagcaatgctttagctctgagtacctggatggtttgtctctgttctcttaacgccatacttctgcaagctctgtgttccataacacaggcaggagggtgttttctctcttatattttttacacttcacaacagtagagggtcaatgggtggtaatcagtgtactgaaggtactcaatgcccatggggtgtctctcagatgttattcctagccttcctgtactatgcacctaggactgggagaggaggtctctctcagccctccttcccctctcccaatagtagatggtcactatttcccactcattgtaaagcctagagtgtgggagggttttaactcatactttctgaaatttgtttactagcatatattagacttgtgcctgaggaccattatcgcagaagtatgtgaactcaatataatgtaaataaaatatccaccagccacctaatattccaaaactctgtgcatacttgagtaagcaataattacacacattgcctggttaaacccagtctccaatttggataccagagtttgttcttggtaaattttaaatgaaaatagtctttaaagtttcaaggggcaatggctcaagggatggagtatttgggaatgggagatactccccatttaaatgctagatgagagatggattccactctgaaactctggagaaccaggagttataacccacggagccaaaacaagaaagttgcaaaaattatatcacttagagtgaaatattatcaaataagccattccatgatggcttatggttcataaaaggctttgatctaatataaatgtgtttatattttactgcatgtaaggatcctcttcagagtattaattcacgcatttttctttagtttttgctaagtttgactttggaaaggataatataatatgaaaatattggatgaataaaagtcactgttaacatataagttttcccatctgtcttctttttcatatttattgttacaaccttttgaacttgggagacattttttgcacaaaattgaaatgagttacatgaaattaatgtccaaagatgaaagcatgaaattgcagaacatatatgtttttccatctctttattgttcatgttcactgtaatgctttggggagcattgtttatgggctatatattcaaacacctaatttaaagacaagaaaatattaatcattagcctagttccacgtttttcctaggtatattttcttagtagagtatgaagaatgtattagcttcacattgatatcctatgtatttctatggtaaatctagaactgttctcccatataattaaatagggtggatttgttccacagttattttctctatgcatctcattgtatttcatcgtgtagaaagtaatgtgattatgggctttagtcagaatgttattttgttcacttaagattcattctcaggaaggttgaacaaatttgaatttcatatgatagctttctttatgtgcttcagtaactctctccctttatataagagaaaatcttcttgttgaagagatctacagatctccccagtgcctggggggcctgaactagcagcagggggggcttcaatgaaggctactgcttcctgtgcctcattgataggggtgctatgcatatttcccagacagaatgttggtgttgcagttactaacccttctagatatttgatacagagtaaaatttgccttatttcctaaagcctctgagttaaaaaaaaaaaaatgaatcttattccttttcattatgtgatgtcgggcaagttagtctttctgagcatcactttccatatcagaaaaaaatgagatacacataatacctacttcgaaggattattgtaacgattacagatatggtttataatgagcttggtacttggtaggcacttaccaaatatgagctgtcattatggcagcagagcgaagtgttaaaagtagggactccagagccagactgtttgtgaccaaatcctgattctgatatgtactagctgccatttgggcaaattgtttaacctccctacctctcagttttatcatccaaaagttaggagtaataacagtacctacctcatcagtaggattaggttaattaatacatgtgtaagaccagtgtttggtgcatagaataagtgcaatataagtatttgctattattcttctccatttcacacagcccatagtagggcaagctgaggagatgggaggccattagaggtctcaactgagtatcagtcgtctcagttggtctacagtagataagagattatgactttttgtcaaaatgtatgtgcagataaagctgtctttaatagtgtatgtacatcaacaagaagaataacaaaaacagcaactacaatttattgagtctgtactacatgcgaagcacatgctaaactctttacaaatattaaccatttagttctcccaattaccctaggaggtagacactaaagttatttaaatttcacaatagaaaaaattgaagatcagagaggttaaatagcattctaaagtcacatatctaatgtgctactggatcaagattcgcaattaagtttcctagttataaagcccatgctcttaaccactctgccatatagtcctcttctgcactaagggggaagcttaccccagggcttcaggattcctgtgctgcatgatttttttttttcaatttgatgtagcaaatgaaaaccctcaaaactattgtctttttgattagtggtggactaactaaattcgaagaactttcatgtccataggccttggaggtcatgtaacttagatctgtcattttatcggtgtggaagtagatgcccagagtatagatggagctttcctgaagtttaagacgagttggcaggaaaactgatactcaaaccccaggatgttttttttccgacattccaccaagcctgtagtttgaaaaatggcaatgacaatgcaacttttatacaactcgatgctgtttctagttatgtgcaaacccataacaaatgttgccttattataatgcctagtccttacttttgcaaatgcaaagtcatgctttgttcattaccaataatataatatttttacaggagggttgtgggggggaggaacttcaagcttcctgagtacctataagtaaatatcagtagaaatacatgccaaataccgttaggaaaaaatccattatattatcaatactcattgccctaaatggcatttctctactgcaatcatgaacaccatctgcagccagcttccctgaagaagtacagacttgaaattcataatgtctggtgctggcactcttaatgctgaaaaatcttaccgtactgcttaggaagaacaagtgtgcagtttctgattgaatgagacataaaggaactgttcttgacccattttgacttctcgtgcactggctcttagatccagggagttttatcccctgggtaaataaccatatcatggccttcagtagtctttacttgttgcttttctattagcagtgacgaaggatgtgcatgcttctcctacagacctgttggtgcagtattattcgtgtactcaagatggtccccttaactccagaaattataaagttagagggaaaaaaagactgagtgaaaaataggccttattttacatacatcttttccagtcccataataccgcattacttatttccccatagttcgaattaagtagaaactctgttcagaccagatggttctctgaggtggtttccagatcaaggtaagaaatgaagtaaactgtaagttgtaaaacatattgaaccatagctcgcaaaatagataaattgaagccaactatgatgtgaaagacaaatgaaactccaaatatttttaataaacttataaaaatgttttgaataattttaagtttacagaaaagttgcaaatatagtacagagaattcatatatacccttcatctaggtttccctaaagttaacatactatggtacatctgtcaaaactaagaaatcaacactggtacattattatcaactaaaccccagactttatttggatttcaccaggttttccactaaggccctttttctgttccaggattcaatccaggatagcacagtgcatttagtcattatatctcctcaatctcctctggtttgtgagagtttctttgctttttattggtttttagctcagactgttttaatagtaattccacatggcttatgtgtcctaaagataagaccactgactattccagcaattcgcctagtttacaaattctaacctgcgttgttaagcactatacttaaaaacttctgtcctaaaatgaattacctttgactaaccccagccttgaaaaccctgtaagtactctttgctaactcctcctttttaacatagtactgagactctgtcaagggggactttctcttgcttagtgtgtttcacatacccagctttgtatgatcagcaggtttctctggtagtctttgtgtgagggctttgacaaaagggtctatgatgataccattcaatcatctactaaatgcaagaatcccttccacaacatctgattggtactggaataggtctgtgtgatcccatggcccttctatgaacattgccagtgacaagacattgattacctttcaagatagtccatgctacctatttttatacaatccctattgttggaaatgtcttcatcaaaatgagccctaatctatttccgtgcagcttctcttcctttgtcttatttctgtcttccagaaaatcaaaatattggatggaaagtaagctccgtgtacagttccactcaagtggtatgcaaggagtcggacacgattgggtggtcccagctttgttcacatagtgtcacttgctggttgtgtgaatttgggctaatgactcaacttctctgggccttaattttcttacctgataaaaacaaaacaaacataaaaacaccctacctcataggagtgttgtgaaaatgaaagaaataacatatgttgaagcacctagcacactgacaagctcagagaattctcttaacaaatgatagttaccttttggtcagatgatcaccccctgagtacccaagatgaaatgtaccatttatgttatattgcattattgtgttattagttctgcttcacagcagtgaattgtaacgttcccttcttgttaactaatttcttaaaaggtttaattttatttttctgttgacctttttttcccctcgagacttaattaagttgttactgaacagaattgaagtgttaaataacctaagatgatgggtttctagcattcatgaattccacgcatcgccaaccggtgagattagtcatggcagtggatgagagagcttggcagggattagcaaatactcctgttaatcagcagaatgcgcaaattaggccctggctcatggcattgatataaatctccatggcaacaccagggtgagctgtttacatgtgaagaagtgatttcaaagctgcaaaggatgatagaaattactgcaatgaccataaataggaaaaaactgaggaaaggagaagtattcccacttcttaaagaaattcatacaactttctataaatttagtggtagttttaccatctctgagcctctactactggaaagttaattgacagtgatataaacagaaagaaagtaagagggagtagaagagggtctgaaatcattcataaaatatacaatccatccctctgaccaaataactataaatcaggattatttgcatatctgtgtgtagcaggactgtctgagttagtatcctacttccaccatccattagctgtgtgaccttaggcaaaatttttaatctcgtcgtatcttttctcctcacctataacataaagctaataacagtacctacctcagaaggttgttatgagatttggataagttaacacatgtaaaacatttggaacaatggttggctcagagtaaatgcttgggaaaatgttagctgctattattattatcactgttattattattcctgttagttggccataattcttgaatatagactacctttctattttataccctgtaaagaaactacagagtgggaaaggttatatttttcattttctaattttgtttgtgctggaaaagagacttggaaatgtcagcactagagaggttttatagatattatcattttcaatttcagtacaacacttaagaaaatgatagctgtgatactagttgaagcataggatccaagtaaagccactttattatttaaactctcatcaaaacccgggagcaggtggatatctataaaatgtgatgtgatcaaaattgaattagattatctcagaaatagagctacctttttaaacatatatgtagctctgaaaattaaacccaggcccctgtcctctcatggaccaattttctctgtggtttcagctcatttcaccttacttgtgtctgttggttgattaggcttctaatccaagcaggataattgccgtaattcaagtttggattcaattttcagtgcttacatttgatgggagattattcaaatagatactgggctgtttgctttgtgaggtcaaaattgttgctacttttttattaatgccaacaaatctcttgccagtcaccacccagtggttcaaaagcttttggaggcagcctaatggagctgaaagggagtgagactaagagttagaaaccttggttggaaaccctgctggcctcctctaccatctgactcttggtcgttcactctcatgtttctttatttgtgtttcaattttattttcttgtgcacctttttgtaagccacttcaattcttctttggaatgaggtaggtcagcagtgacaataaccagagtaattcatattccagaaataaggcaatatgaaagaggctttaacataagtgcataagtgtgatcaaaatgttcagtaagataaaggaataaaactcttaagatatgatcagaacgttatgaaaaaatagacatattatcaaacaccaaacagaaattgtaaatatatatatgtatttaatatatgtgtgtatatatattttatatataacatttgtgtgtatagatatgattttgtatgccattcataaaatattattgtataatatatagtatttctaccaatgaaataaaaacaaaatcaacagataaatccagctaaagaggggatcagtgaagcacccagattttgcaaagaaagatacagagatggaactaggaaagagaagtaaggaatcatgagggagagactaaataaaatgaatattttatccgttatttctatgttttatggaagaataggtaggatgcacctaacagaagtttcagtagaacaacagagatttaaagagaggcaataagtaaagagttgatagctaaatttccagaattgaagcacagcaatagaaaaactgattaagcacaattgaagaggaatacagtgagcagggaaattttcaatatgttttcaatatattcaaataccaaccaaatcctagttgttcctctcctataggaatactgaaatctatatagatgaattactggcattacctggcttggacagtcttttcacacaatctttaatttgttaccttaaagttttatcatcataaaaattatttattgactgcccatgtgaaaaatctctggtctccaacctcacgccagttatatcaggagaatggctgacttaccatgacatacatgccaatgtaattttcatttttattggcatctttctaaagggattacttctactacaccctctgctgttgccagtcagaaatcagtaacaactgtatacttgaacatcaatgttgacaatatgtactgaatgcgatcagtaggaaaaagaagacgatctctttaaagcaaggaataaaaacttacaaatgttcatcagaatatccacatagcatagtcgatttctcccagtccccagtggttgatgttcaaagggtagtgatataaaaatctaaggttttgcaaattctttacctgagggaaagtaatatggcctagtaagaagaatatagtaccagtagtcagttgaaatccaggtttgaagtctggctttacctaatttcgttccccaacttctgagcttcttcccatcctcccacattcatcttcagtgacaggttttgttttctgaagctggattcaattcctgccctcctgccctcctgcccacggagttagctgcaccctctttgggctctgaaaacactggatatttagtatcattcttaaagtgcttaccacacttgtgttttagttaactatttacttctctttctcctccacttgaggccagggacagtcactggagaggcagtagagtcattttttaaaacatgaaatataaaggcagtatgcacaaatttaaattctgactccaccactccctacactaatgaatgcattagcctttcttcatctcagcttcttaatctgtaaaatggagataagttcataaggttattataagtattaaaagagtaaacaaagtacaataagtcctcgcttaaatgtcataaataagttcttggaaattgcaactttaagtgagatgacatacagcaggtcttcaaataatgtcatttctttcaatattgtttccttataatgttgatgagaaaaaaatttggtttcgttatgtcatttcgcttaaaattgcagttttcaagaacatatcaatgacataagtaatgatttattgtactttgaatagtgcccggagtagagttggtgctcaatacattagagctattagtatttttgcatccttcaggtcttagctcagtacttgtcaaacagttatcagtaaatgttgaatgaataaattaatgaatgaacaaatgaacaaatggcccaagccaaatgtattcaacttctcttgcctcagatctcttctctaaaatgaaatcattaggtaagcatcaaggcttctgttaggaaatcagtttctaaaattgcttgaggccttcagtggttgcacgaaaagttactaaataatttcagtctgttgactgtacttttaactgtttgtcagaagagaaaagttagagcaaattagctagaatagatattggagaagctcctaattgcaaaaggatagtcatgggcttccgagtatggaagtgaatacactgtgtataatatttttctctcttttggctgaactcaagcttcctgtagctaaaaacagatggcacaaaaaagcttacagtgtggaaagccagtttttcctgtacgaaaagaactgagtgtttggagtgctttaacttcttgtctctgctaagtagtgatggagagaaaggccgggaagtgtcctttgggtctcatagcattccaaagtcccagattacctgagtcaaaacaggttctagtgttaaactatttcttgggctaggaaacatagaataacattaagtagtgctttataatcctataattttcatgagaaagttagcaatgttttctttaaatattgctataagaagttattgagtgttatgaactgtgcttataactaggcatagatcatatgtattatttttatttcataattcacttttgttaaagaaaaaaaaactgattagaaaaatcatgctatatttcatctcgttcagtcccccaagccaaaacatagtcacatccaggcaccactgttgagcaacccaaattccagacccactgccaatgaggaaagaagtagtatttaaaggtctggccttgtatacataaatgtgctttttggctcaggatccttagcttaaatacttgcacttccacttatgtactagccaggaaaccagagtcatatcacttagtctttccaggcttcacttttctcacctttgcaatggcaataatgataatacctaccttacatgttgttgtaaggattaaagggattaaggttatagcacttaacaagttgcttgtccaactataaccatagtatttattgagtgttatcaccatttccaaccccagttttgggaaaaacaaatctaaagcagaagggagagcttaaaaatcatctagggcatctgcacagttctcaggtgggttatcaacctgtctttcatctcctccttagaatatggaggatagtattttctctgaatataccaggttcttctccccaaatcttggtcagtgtctgaaaagagatgtgttaagactcttaatcctgagggaacactaaagtattttcccattacctctctgttgctttaaaaaatataaattcttgataggaaattggagcaaacagtgccattggcaagtaggaaatccatccagtgttccttaatgctggttgtgaatcttgcctccatatgctaaataataacagacactagatcatttgcccacactgcattcctttcctcaaatactgagtttaggtcaccttccagtaactttatttcctgaattggcttaaatccagaaaaattaggttgtctgccattgcctcaaatcctccatcattttttcccctagcttttcatttaggttacctagttcactgggcaagaaatgaacccagtgttacagatattttgcctctgattcttgtacatttttagcctgccataaatgtctcaccatagaagcacctcacttaatgtttgttagccatcacttagttcataaaatagaaattgttccttcaagatcttcaaatattattgagtaaaacagaatcaaattcacttagagaacctgatgcttttcttggctctagacactctgtcaccactgaagcaacccatttgattaataatacatttattgtgtctacaaagtgttttctgcaagttggatgagagaaacttcaggaaatgaatgtgactgccttgatccacatgctccaagttcatccagtatgatcttccaaaggcaaaagcactaacaattagctttgtgttatggctcacacctgtaattcccagcacgttgggaggccaaggcgggaggatcacttgaagccaggagatagatagagacaagcctgggcaacaaagtgagaccttagccttagaaaaaaaaaatagttaaatgtggtggcacgtgcccgtagtcccagctacttggggactgagatgggacatggcttgagcccaggagttagaggttacagagagctgatcacgccactgcactcctgactgggtgacagagagaccagatctcaaaacaaaacaaaacaaaccaacaacaacaacaacaaaaacactagcaatccccatgccctatcagaggggacctttgccttctcataatggtgttactgcccctttccactctcctagtgattacttcttggtggcaggtcatggttatacaaatagtcgtgtagattttatgacagaatgatagtcttaatggaaaccaacccacatacctagctagatagaaaaggtttttgttgtattcataaaaggttttatagaagaaaaatcagcaatcaatcatagtatttaacaacgctcactgaaaagaatgttttccttgtacaaaacttaaatccccacatattaaagcttaagctcatttccttgtattctctcctcaagattaagggagaaacctccgccccagaaagctgctatttctctccaggttttcttgattaaatggccaagcaggtaatcagaggccttgaactctcgatgttgcagctgccatggctaattaaatggtgaagtgctgaattcacagacatgattaataccatcagggcgttttatggctttaatgttcataaattatgactgaacaatgaaatttgtatgtgggttataggatttttcttcttaaggatcagaattaatcagtgttttctcaattgattttaaatataaatcagaggtagcatcagtaaattctatagcttaagtatttagagaatgatctcagaaacaggacataatgaaaaccaagccaccatcctagtgtgatgcaagcctaaggtcttgtggattttcattctaaatgcaattcaggaaggccaatcagtttctaaaaggatggttctggagacctttgtttctgaagtataactcccctaaatgatctaatctttgccagctaatatatgtgtcagggtatgtaacagaatacagtagtcactctttctttacctggcattctagtgtgacactaacaagatttccttaaattgcatttttcttcctggagttaagtgtctatttcttttctttcttttttcttatttttcttttttttagaggcagggtcttactctgtcacccagggtggaatgcagtggcaggatcatagcttgctgcagcctggaactcctgggctcaagggatccttctgcctcagcttcccaaaatgctgggattacaggtgtgagccactgtgcctggctggctgaaaagagcctattctgttagcttttctctaaactcctcatttgtatttctatccagttgtttctctgagcctttgtacataattagaccacaaaaggtggtacttggctacctcatctcgtaaatactctctctgctgccttacttagtgaatggggagatcccagtgttactcgacgttggtgcatttgaatctgccaacatttcctttctttgagctcatcatcagtccttgaccaggtaacttcccactcagatattttggtgaactgttagtgtagaaggagaacaaactggcaagtgattctgagtgagcttatcttcacataggaagggtgtttgaaatttctcattttcagaatttcagaaagacagccaattcctttctgctcagaatggactgaggctgctcccgattaggctgtctgagttctctcatttttactcatcacagtcacatctgtttgggtttctgtctctctcctggagatgcctcttgagagcaggtcccctcagcttccttacagctcctctgaggcctgccaaaagagattggcagagaacgatcagcattctatgcccagataactcacataactctctctgaaaagaatgctaaaacctagttctcaagtgaacccacgaggagtggaatcaaagggacttttgcattttttccttggaatccaatttagaatttatgttctcatggggtgggaagagaacagagagatgggaagtatgaagaggggaagataaagaagtaggaacaggaacatatgggaaaaataatcataggctcccagagccaaaaggactttaaggaacatgtcatctggaggtttccaaacgttttgtttttagtaccagaatcttttcatttttattttttacgtaagaaatcatacaatgagctccactatataaaacagatgaaaagagaaagagaaataaacagttgaatgaaaacagttaaaatagatgaaatctactgttgaaacattggcgagggaacttttattacttttcattacttttagattgctgaagaatacaaagtgaaaactgccaatcttgtctaagtattactttaaagatgggaaaattgaggcctgtaatatggagaaatgacatactcaaggtcacacagccaattagtggcagagataggattaaaacatatgtttccagcctgccaggctagaactctttgggagttgagttagaaaaaaaagctaagaatgctttctttctgaacatggtcaaaaagagaggttggtggacaatgcaatgggagagcggacacgtgggagaaacaacggagaatagaccctaccttagaatagagcatagaagagtttgaaccaccagggataagcagagataactgaaatttacaaatatggaggagatccaggaagttccatagcaaggccacaatgtgaactgctaggaacaaatcaaaactggagaaaaagggatttggaaataggtgtcaaaagagaattctttattacttcccctacacaaatgtcgtactattggcccaggatggcagtgggacagcaaagacaagcaaaatatgcttctctaggattggctgcaattctttcattataccttctcaagatggatgtgactttggcatagtttcctgttggagatttgaaagtaatattcacattcgtctctgaaattttaagcacctgggaaatagacatgagagttaggaaaacgcgaacatatctgctttgtgtgtgtgtgtgtgcgcgcgcgtgtgtgcgtgtgtggagtttcgctcttatcgcccaggctggagtgtggtggcctgatcttggctcactgcaacctccgcctcccgggttcaagcgattctcatgcctcaggctcccaagaagctgggactacaggcaggcgccaccatgcctggctaattttgtatttttagtagagacagggtttcaccatgttggccaggctggtctcaaactcctgacctcaggtgatctgcttgcctcagcctcccaaaattctgggataacaggcgtgaggcactacgcctggccaatatctgcattattaatggttaagttcattgagcaatatgatttggacccaatttcaaaatggttttctttcactttctgccccagattgaatttaccctctggtcacaggcctttgtgagttctctttgtggaagagagaggagaatgaatgaggtccgtagacagacagatcacagagagatgcccccttctcaagtctcattaataatgtgccatgcattttcctgttcatgaaaacaaaagattcaagggggtcaggatataaaaagacagaaatatcttttgtgggttggcaggaacatgtgacagagggagagtctcgttccccctcccccatactcttcatttttcaatattatacaatttaatcagggagagaaggattagagcaagaaggacatctacaaacacgtgtagaatcacctggttatcagccttggcccagtggttccatgagcttatgtggatggtagacaggagttagaaacaaaaggatgtatttacagtttgtgtttgcaaatttgtaataaatgcccccgccattcttattatatattcctgaagtcttctctgagtctgtttacctctaatatgtaccacagagtgtccacaccaataattctacaggcgtcctgaaaataccttatgaatggtgtttgcagaagcaaacagtgagagctatctgagaggagaagtggaggaaaaacggtgtgggaaagcccttatgattttctcaataccatctcttcttctaaggtctatccccttcctgaatcagaacttcatccttctttagcttttgcatgcctgctctgggtcaggatcccaagagagaaatgagagtaggaacaaaaggcccttggggttggtgcttggcagaaggtaaaaacatgcagagaataagcagagaccttgtacctgttcatcacccaccccaaatatttgggcttgatcaaagcttctcctgacccctctttatgtaagatatttcccttcatggtatctggaatttaaacaacaatcacaaacattttgaactaggaaatagcctcctactcttcagaatcaatatcaatcagtcattcctcagggatttatttttccctatgaatcaaattttaaagaagtggatacttgaatagacttgaggtgttaaaactctcgtctaccttgtcctcccttttcatttgggaaagccaaaagcacaaaagagtaggtagaaaatgtcagaccctttggcatcattctcctgtaactatcagtctcaacccactgcaacctttaccccagtctgccttgcagacacacagtggtgcttctgatggagcaagagacatttcaagattgcagagaagtggaaggaggggtagcaacagcttcccctgtgaagcaatggaatctacagaagggtccggtgattcagctcttatgggctaagaagcctgaaagcatttcagtgttgctgagtccgagcttgtttgttgggtagtcaggcaaggaaaaaagggctagagtctgaagataagctgagcatctggttttgcatctacattagttctgaaaagaggtgatgggggtgccatgtaggagtccagtaaagacggtgtagggctgccaggtagtagagctgctctattttgcttcctagttggcctcagaaatcaagtaaaatagtcaaataattgtgtctgtttgaaggtagggatgtagacaggccatttctctttgctgcatttctggcctcaaaacctcttctttcttttcctccagaataaaatataacacagggagaggacagaacttgttaatagactgaggccagcaaaaagccagactggttcctgaattggagggaaggaggctgcctgactttggaggagcagaaaaaaataagttaggagattagagatgggccacagcttaaatagagaggttcgactctgcatttcccaaatacgtaatgcttacggtacacgacccaagctctctgcttgaatcccaaatctgagcggacagatgagggggcgcagaggaaaaacaggttttggaccctacaaattggcttgaaatgaaaagtcagcaaaaaccactgggtggcagcgtggtgtgcgggcgcagctctgcagtgtctgcttctgctgctaccgctggggctgaacccgtctggggactctggcctcctcccctgaatggctacaagtgtcgccaagcaaaatacctctgcgcgggtgggtgagggttctccgggttgttggtgcgtccaagcctgaggcagggatctggcgaacttctgaggggctccagcccgagcacaatctggtcagctcaaacactgaggaaacacccccaccactccatcccccaatgccgagcaaacccccgctccgtcagcccaactacctcatctcagttcctcctccatcactgtttcctcccgaagctcctttcgggaaaaggaggggagaaggatttggacgactggggcagtgcggaagcccctacaggtgttagccggaacgggcggccggggacttgggggggtgggggtgggggtgggggtgggaggggcggcctgcggctccgagcctacgggctcagccccgggagggaggggccgtcgcgggagggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcctgtgtgcgtgcgtgggaaggcgctggctttcttgcctccgtaacagtaacacgcttgctgcattgcaactgccctgggacaggcgcagagcctgggggcatactctgccctgggtggcttgccctcagcttcggacatgtcacatatgtgcatgcccggtgggctctgggcaggcgtgacccagacatggctgtgatatgtatggcgtggaaattgcaggcgcagagctgggcagacaccatcctcccgtccccaggagagcctggggaatccctctcttgcttttatctctgcctcagacccttcccctccagcttccacctccaagggatgtgggcttctgctgtctaggcattgcgtttctttgatgacttttaagctttttgggacagacttgacttgtggtgcagcttcgaaatgtttgctggggcggggggaggggggatttctagaaccttgttgcaaagagctgagagatttggttagacttagtgtaatcggttacatgctactaaaatgcggtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaaccattgatggcaccaaagatgaggacagcacttacagtaagtgactgcaaaataaatagtatatgccagcatgttgttaacattctgtttttatttattttaaaaataaatacgctttcctaaatcctgaattaaatgcaaaatatattcacactacataatcctgtttacacaggttaacctaaaggaagttgaatatgagtctgtctaagatagtaaactagggcaaataatgttgacaccatctgaagaataatccaaatgtcatctccatggaaatctagatagatttatggctatcctttggattttattacttttttcccacagaaaatttactcacccacacactgatccagaaatagcatgttatctctactcttaagaaccggtcttaacccaagagagaggagtggtttcataccatgaaaattcatcattacaagctttcacttctgctccctgctccacacacacactgataactctgagactagtggaattttaacattgagatacctccgcaggtgggtaaagggatttcttttagttctttctttttaaccatggtttcagaccaaattggagactataatggtgagcctaaaaaagaaacacataaaaaataattaggttttatttccaattactgaaagaaggtgattccaagatgttacgtaacctttaattacatgttttatttattaggagtaataaaaatataaactcacaaatagtgcaggcttctcctcaatgatgattgatgttttcttgcaatttacagatttctggagacttactaaatgttccacaaggctaaaacacttagttctcacaattttttttgttttctccaatttctactgaatttctctcaaaccctttgataatttcgcattaatattccaattgtcggctgagaaaataaccaaggaaactaggtctgaatgctaagcagtatactctgcagctttttaagagttgtatggctacagcaatgccattgacgagggtctcaataagtgtaaagagtttcccaccttttaggaatgcttcgtgggctgatggccgatctataacctcgagaggaagtcacttttaattaccattgaagaaagctttgttggtatggaggatgaaaaaacctcatactgaatggttcttcactgttttgcaaaagttctatgtcactgttgtgatattaaagttttatagtaaatcctagttgttcttttatgcatagtcttctatttgaaactattaggcaagtgtaactagagggctttactgtaatcaaataacagacattagtgtatagtgatcatctgcaataaaacattcccataagttattgtgcaaattgatatttggggaaggaattaggggatgtaagctgccctgctttccagagtgcctcaggaaaatgggtctgttgagcattattgaaggcaagttcatgattagctgccagtgagcctatccagtcacgtttctttcccctttttaacatctccgggtacaaatcagagaagaaatattttggatctggtgttcacatgtgtttcctgaaaagaaataaaaaaaaagtagataattcatgtgctgtgtcctatgaacagcaatataccaaattcatcgagatcacattctaagtaatcattttaagagatacacacacacacaccacacacgcatatatcaaggctccatttcttactgtggagctttaaatcatacagtaggttttactcttcagttcctacatatgcatagcttctgcctttggttgtcttataactgactgatacgcatggcatttctgtgtactactaatgatattgaaagaccattaaagaacatagcctgataacaggaatctgtatttaggcagattaaaatagagaggtaagtcaactaaaggtaagtattgtcataacctgatgcatacaaatggaaagtatctcaatagaaatagcaagtcagtagagcttggatctgctcctgatgttaagagtgaccagaagctagtgagctagctcagctttgccattgaggatattgtggggcataagccatcatgaaacaagaaggtttaatgattaaactggtatatcatgaaggccagctatccaaatgtattctttttttttccttaaaaccaagccgttttattggtattaattgtttaattgtgcataacgagaatacaagttgtttttttcaactatcactcatgtatataatatttccctaatatgtattcgtgatactatgtttatatttttcttactcttcttatttttattaaccttcattattttcagcatattttctcatttagtttaatttgattgaattgcgttatttttattcagacatagtaagcaatgtcctgataaatcagttcacatttatccagatatatccatttctgaaaacatatgtttgatattatgcatttcaccttaccttacgtagatttattacaatgataaatgtcagttcaataaaatctcatcatgaggaaatcagccattgtaaattatgtattttcccttgaaaaggaaaagatgatagacattccatggcagtaattttattatgtctgccctgggtgcaaggaaggacattttaaaagactagttttccctttctcttcaaactcacggtagcattatcagttcaacatgttgcctttccaacctacgttaatatatactttcattaattattctcttttgagaaattgaccttggccaactgatgaagaagcatggcttcagtgttgccttcagcaaacactgggtgccaactaggtacatggctctgattaagtggcccttcaaatagaaggtgtttgtttttatgcagacataacagagaacaaacaagaaacacaggcacatttatgttttaaaagcttcttcaaaactttcactgaaatggaagaagagattttaggtatttaatgaatgtgttttaaatccataaatgaagtcaactgttttcttctcatgtttatagtatttttatcctgatcaaaataatatattaaatccatgaggaaaggtaccagatatagagaaacaaaagcacataggaggatatttatttggtttaagctcacccctgatataatttctttgcatttttatctgggcagactgtccctttagacatattttaaacaaacccggtttatgatctatcttgaatgtttaaagaaatgaaaagatcgtagtagtatgatcagtcaatccctagattcgctactctcaacaagtttttattttggggtgatgttttttgttttttaatcaggcttcatggaaatttaaagtacatagtgaaaagtacatagttttgctatatagttaataccattattcaagattaaataatcacaggaatgtactgctgatgtttttttcttctattcctccttctgttttctgatgtttgaaatttagacatttcattgctcattaaaacctgagtcagagtgattggagaacacggtgaaaatcaaatcagttttttttagtctctctctgtttctttcttgtgcttgttataagctgcattaagagaactaagaaagttcataatattattttaaaaactgaagttctataaataattctgaatttcatttatcattctctgtcatttattactatgactaaactaggtgtcaagcatatactgatattatagttgtcaagtggtatgtagtgatatggcttttaaaccaaccccatgttggaagttttgctttagttttttagatctcagattttttgaagtatgagcttttatataaatgggattgtggtctcttacttttcaaaaacatagtatcatattttcaccatacagattgctatcaatccacaaatgggtgttgaacacctgctgtgaacaagacatcgtcaacagaaagggatatgacaaacatgacatgctcagagatgtcagacttcttgcctgtgtattgcattgtcaaatatagcatgagatcttggcttgcaatctgtgcaattacattcctttacctcacataacagaagggcacagcttttaatttgatgagtattgaatgaagtgccatcagtggcatgtggtaggaacacttgtcttttgaaccgtacaatatgtcctagctcctctttggtaacaccctggttttaaaggaacgatacgttgtaggctcaccaaggaatatttaggtcttcattagtatttctcatccatattaccccacctactgcagcagaatgtatatgcacagagataaacgatcccagaaaaactattcttacccacagggtgactcctttacattcttgttcacagaaaccataacagactgatttattatcctcaataaacttacaaaacaaggcaaaatcatcaacattggtctacgactcctgagagaaaggtgcacaggctattttcaaaagatgtgtgtggcaagcactacgttttaaaaatgtactgttttatttttattcacagtgtgggagggagtagacagctggtagtgggaggacacccactagttgtctccagtgagtggtgtgtggttgtgaggaaagcctgggtgtaagtttcacgcagtcagatcttcaaatggagaaatgaagtcctcactggcaccaactggctgcccacttgcaactattttgctaaaataataataataaaataataaaataaacctctttcaagttcattatttttattcctatgtcctttgttcttggagactaaaagctaggagccctctcaactctaatcttggaaaatgttggtcctttaagaaatactactctgaagccgggcatggtggctcacgcctgtaatcccagcactttgggaggccgaggcaggcagatcacctgaggtcaggagttcgagaccagcctgaccaacatggagaaaccccgtctctactaaaaatacaaaattagccgggcgtggtggcacatgcttgtaatcccagccactagggaggctaagacaggagaatcacttgaacccaggaggtggaggttgtggtgagccgagatcgggccattgcactccagcctgggaaacaagagcgaaactctgtctcaaaaaatgaaaaaaggaaatactactctggaaacataggactacaaaatgactttttctttttacaagacctgaatttattttggagttcttgtatttggaataacacagataatttagatgagggcattggactcttctaaaagtctaggactctctacccaacaggtagattttaaatatgactgtgagaatttcagcagttatcttggggagcagtttaaaaccttaatttgttgagaatgacactatttaatgtacagaacaattcttgggactgtatctttccagaagcatcaagattccccacctccaacactgtaaaaaccatgaaattgtgaccaaaagccttccattttctccaggctgttaaataatatgtagttacagctccagttacctggctgcaaccatgaaattaaatacactaaaaggtagaatgagacctatctgtctgcctcggggtatgtgtgggtgtgtttgtgggggtctgtatgtgtatgcatgtctacataaacagacatatatgcataccctcaccaactacacactacttttggaggaccaggcagtcctgctggaaacattgaaaagttctgaaattcagaattgtaacactgttttcattttcttttttaatttcagctctgtttaacctcatccctgtgggtctgcgagtggtggctatccaaggagttcaaaccaagctgtacttggcaatgaacagtgagggatacttgtacacctcggtaagcttttgactgtgtgcatgttttgactattctagttttcatccaatatgaaagaaaatgtgctttatatgtgttatcattacagatttctgtgatgaggagaagaatgttgatggaaatatttcattgaaaggacagattaactttctgtgaaaaatatatctattactaatcagttatttgaagcaagcattttagtatataatcaaagattcactgaacattttttaatacagtgtcatttgggtcatcttatgtagcatataatggtctgtcttgctgccttgctttgcagctgtgggaaacaaagtcatttctataactcagttgaacatatatttatccaggtttactcctaaaaaaacatgagatctctccctcagatcagctcgaggacatgaaaaccagttcttgaagggtttctagagttctatttcttatcttcagtttaattgaacaggattcctgattgcttctgctttaaatataagcactatttaacctttccttacctataaattcctgcttgtctttttcttgtaactttggagtgaacagaatgaaaaatggaactttttctcagatgaatgtataaacaatgtagattacaattcaatatggaacatggggccaaattaaactttaaaaaaagttaacatttagatataagcaaaatgatacagtattagggttaagattttattcttattggcagatctagtttcagattataagagactatttgatatatgaatttttattttaacttaattaattaattaatttatttatttatttatttgagatagaatcttgctctgtggcccaggctggagtgccgtggtgacactccatatttttagcagagatgggtttcaccacgttggccaggctagtctcgaactcctggtctcgaatgatccgcctgccatggcctcccaagttgctgggattacaggcgtgagccaccgtgcccagcgtaatatatgagtattttttaaatctttgttttgaattcatgtattttaataaaggaaaagaatgtttaaaatggagaaaattgcttgtcgaacttcttactagcaagtcttgaagcaggttgttagtataacaataaaaatctgttcctcaaacttcaggtgaaacactacctttaaccactcttgcttgcttgtttcctgaatttctttcaaagccaggtgtgcaggaagactcttggcagatatggtggaaaccatatgataaccctgttttgcagaggccaagatgggaaagaggtgggaatagagtaaggccccagagggcctgtttatttggtaaatcaggtagtttgtttcatatgatgagaaaagattatgaaaaaaagagaattatcagcatatacctcaaaccctggtcactatcagttttcctatcaggcaatttcagtggtctggttgcttaataaatatgggggtttgctctttttactaaatgaaaaatgtgattttatggcaaagttcatgaaatacgtcattttattactagagtgctactataaaagataggaaaggggattttattttagatttgtgtactaaggtaagataatttaataatgaaggattttaagtaatttcctttagatcaacagactgcctcagcaggaccagatacaaaggtaggttttttaataaaatagacgctttctgaaaatattgtgaaggcatgataaggaaacggaatatactgggcatacttttgagaaagcacatgccagatatcatatgaaataattactgataaatcatccagaatttcaatgggttgcagtcaccgttatggtgccctgatgagaaaagctaactaaatataaattttgcaacatcacaattgaagaacgtactttggaaataatatttaagtaagaatgtggaaaattatttaacttgggttatatgtcaggtgcccccactcaagaaaattagggcactcagcattacacttaaggaaccagcgttgaaaatgcatagcctaccattcaaattaatcattattccagcaaactggtaaatgtcaatgtgagctcatttctagaaaggcttcccagggaaatgaggactgtagattggtgaacttcctttccgtgatgggtgggccaatatacatccaaatgtggcacatcttgtatgtatttcctattaagaaaaaagaagccttaagtaagtgtttctattagagaaaaggaactatgtttttgttaaggaggaaatatgcctgcttgatgatcctggagttcatatatggaaagaatatccaaattagtctgctccaggaaataaatcagaatcctctttagaattaattttccaattcttccaattactccttattaattgtggctgggaatccattcaccaagttgatcaccatcctcagtgggcacttcattttgttgtcatcttatttaaagtgtggtgcccagattacttaggatggagttctatcctaataacttcagcaacttatattgctgagatcaaaagcttaatgaaatatcatgtttcatcaagaagagacagcaaccaaagaggaaggatcactcttcccttgcgtaaaaccatggcacttctactacaaaatgctatatgcaattttgcaaagtgcctcttagcaaagagaagacagaacaggacaatgacctaaagagaaagcaaaagtaagcaaaggaggtaaggggctactgatgtgggcaagttaaaaaaaattggtgagggatgactacagtctgcttaaaaagcagttgcagtgggaatggctaaaaggagatggattgctgagatattttagaggtagaatcatcaggatttggtggctgattggatttggaaggaaagcaggaccaccatacatggttaaacatgtatggttgccattcactgcacagatgagaatgaggtgtcttcaggtaagaattaaaaaaaaaaccttcacagaagtcagaagtgctcagtggattatcaggcgtcatgagggagagggggaattttgcctctggcatttaggctgaataaagcgggaaaaagcagatttgaggaagttacctgagtatagctttcaagggatatttgaaaatatgaacctagcacttgagaaagggacatgaactagaaataaaactcgggagttatcacatgtaggtagcagtccatgccatggaaatagttatgaaaatatgtagcataagaagaggagagagcttgtcaaataatgttagaaaataacagcatgaaagtgaccagcagaggaagaataactaattatggcagatatagtggtattgcaaaagctaaatggggaaggagttttaagaagagtcagcaatgtgaaatgtttcatatgttgtgggtgatcttaacaaaaacagttttggtggaatattgggaacagaagccagattctagtggcttgaggagtaaatgggatgagaggaagtagaggcaacaggtatagaatttctaagggaagggaagggaagggtgggtgtgtatttagggcagaacacagggttgaggaagactgaggattctttggttaaggatgtcacttgaacatatttgttaagtaaaagaaatgaacaaatagaaagggagtgattacagacataagaaatggtattctttatggagtcgagctgcagaagagatggaagggtgatggaattaagtataagtgaaagaattacattcatcttgaaaagaagggacactgaatctctaataggagacaaagagatgaggacagatgcagacataggtttactgagtctgcaagtaatagacaaggaagtagaagaattttctaccagatgatctgcatttttccattaaagtagaataagaggtcacctactgaaagtcaaaggtatgggggtaaccacaggtaaacaggggtgggaacaactgttttgggcaaggggaatggaaacagtttaataaacaggagtaggtaagctaaggccgtgggtcaaatccagcccactacctgtttatgaaaataaagttttattggaacgcagccacacccattcatttacttattgtctacggctgcttttgcactgcaacagcagagttgaatagttgcaacagagcccttatggcccacaaagcctaaattatttactaaataacttgtcccctttacctcccagaaagtttgctgacccctagattgtaatcagataatgattctcagccttaggtacccatcagaattacctgaggaactttaagaaattccattctttgtgttacatttggaccaattatatcaatatccaagggtgggatctacgcatgaatattttcgaaagctccccagctaatgcttatgaaaaccactgatctgagcttaagaaaaatggttgttgaatagcactgaggcactgaggacacgccactgaagtcagaaaccatgagtttatatgcacttaatcatttgttccaaattcctgataccaatgtttttctgttcttgcaagcaaattgcctttacatttttgaaggaatatttcttgagatgatggaaaatgctgatccctggaagagcgttcttattttatctctttttctttattctaccttcttttgcatttctacttctatatccctcaattttgggggggttgaattcaactttatagtttttgccatttattttctcccttttgtccattaaataaagaaacgacacctccacattgttattgttacagagatagcaatttactttccatgattaatctcagaattcttgcactgcaccctcccttccccgccctttttttttcttgttgccatgggggacagacttgatgtaggcacatctgtggcacagagaatcataattagccattatttcataacatatttacttttgtccatgatatatgctgagtctttctgggactgcaagaaagttgttatttgttgtgcagagataattttgttcttacctttggttttctttagcaataataaggagttgtacacaagcttttgagagttcctcaaaacttcacagtatgaatatttaataacataaagctatttgtaataaatgttttaaaactgcttgaaataaataatcattgactatagaaagtcaagtgtcttaaatataaaaaaaattcccgttctatgtctactttaataagaaataacagatattagaaacaggatagcaaaaactcaaagttaaaccaaaagcattactattattttttttattttggaatgttctagaactcattagcagcagttctacccatataattacttacctttcaaaaaattctagttttcctttttcacaatacacagtattgcttgggttgaagttggggcagacaaaacgtatagacaagtagaaatcctttgacaagcctttttcattcatggatttccagggaaaacttgtaggagtgattttactgtcacgttttgtagtcctgggactaccatagcaaactagatgcaagaccagaaagcagtcctctttctgagagtcagcttgatgccatgggaatgagacagcttgtgttactgatcccaacggctcagtcagattgcaatctgaactaaggggacatatttttcttctctactggattattttcacataccttaaatttaccgtttcttctctcattacatagagttgttcttacctatcactcagaacatctcataatacaatctcctttgaaggagtcactatcagaaatagtgacaaatgaaacaataccagccccttagcagttgtgacaccttagcttcacttgttttattctttgacaacttagatttgctttcctttaagaatgttacatgcctaagttaatatttaggttatatttaatgcatttagcttggtttttaaaattttataatttttcaacacatattgcaaatttttggccattgtaaaatcagttaagaattactgttttaaacaaactaaatatgagaaatataaatattaaatggaaaaattcttcatttgaccatgcctctaaacacgttacatttagagagatgcatttgattactgaggtgtgtgatatatgaatacatgcataaatattcttagaatgcttttgctgatgaatagggaaaagcccgagatggcagcccaagatgcagcatttgctacagataattcaattagtaagtgttttgtcattttccttgttctcaaagacactgacattgagtttgtcagtcatatgttaacattcttggtaacttcagaatccctgagatgacccgtccaacaaaactggtctcaagttctgtgaccttttttagctgtaaggatatttttctattcctcagccttatcaatctcatggccatactcttggaccttttcatattccagactattgaccgcttttccattatctattacctccttctttttttaaacagcttgaatgagatatagttcacagatcttaaatttatccatttaaagtgtgtacaattcagttgtttttagtatatttcacaaggctgtccaaccatcaccactgtgtaattctagaatacttttatcacgctaaatgaagaaattataccaattagtagacacaccttatcccgttccccagtctcaggcaagcactaatttactttgtctctctatggatttgcctatttggaacatttcatacaaaaggaatacaatatatggccttttatgactgtctcctttcacttagcataaagtttagaagactcttacatgttgtagcatgaatcagtacttcattccatctgatggctgagtaatattccattgtatgttcctacattggtttattcattgtcagttgatggacatttggattgtttcccccaaatacctgcatagctgcttccttctttgttcacgtctcaactggaatgacattctttagaaaggccatctctgaccaccttaactaaagcagtacattcactatctgtattatccacatttatcttcttcaaggcattatcactatttaaaattattattttgtgtgtttttcatcttccccaactagaatttaacatgttgacagcatatattccatttttcttatacactactatatccccagtgccttgattaatgcatgctgttgttttctcaatacatatttactgactttgttgtcttcaaaagggaaagcaaatatgtacttatagtccgattttagttgcgttgcttaaaattttttatttggaaacaacttcaaacttatagaaagtttgcaagaataacactagtacaaatgactccatatatcctatcctccgattcattttgctccatttgctttatcatttgttctttctttcccacacacacacagttttctgagccatttgagagtatgtaccctggcactttacacctatttcctaagaatagggatattttcttatatactgacagtaatgaactgcagtaaatgtaacattaatacaatactttagctaatctactgtccatattccaattttttaagtaaaaaatatgttcattttttccttccgtagagaatccagtctagggtcagttacagcattggcatgtcttcttagtctcttttaatctagaacatttccagagactttctttgtgttttatgacattagaatttttgaagacaagagtccactttctaattttaaaataagcattcacaattttgggtttgcttgatggtttttcttaattcaattgagattaagcattttagccagagtactgcttaggtgatagtatgtccttcttagggtatcacatctggaggtatgcagtatccatttgcccctcattggacgttaattttgatgataaaatcaaggtgttttctcattttcccctgtataactcttggttttctgggtttgtgtgtgtgtgtgtgtgtgtgtgtgtgtgtgtgtgtgtgtgtgtgtttcaactagtaaataatccactgggagacactttgagaccatgtaaatatcctactcctaagatcccagtttttaatgttatgttttcagcaatcccaaacctctttagaaaagtaaaataattagtccataaattgagaaataaccagtgattcccagatatgtcatataagtttactgatagctaaactgaggtagaaaaaattaacatggccgggcacgtgggctcacgcctgtaatcccagcactatgggaggccaaggtgggtggatcaccaggtcaggagatcgagaccatcctggctaacacggtgaaaccttgtctctactgataaaaaatttaaaaaaataaaaataaataaaaaaaaaattagccgggcttggtggcaggcgcctgtagtcccagctactggggaggctgaggcaggagaatggcatgaacccaggaggcggagcttgcagtgagccaagattgcgccactgcactccagcctgggtgacagagcgagactccatctcaaaaaaaaaaaaaaaaagaaaagaaaagaaaaaagaaaaaattaacatgtatttccaaaaaataaaaaatgtcataaaaaatatgatctggcagcaatttctggattccgcattctagtcactgggcttaaatacaattaatggaaaggttgtttgcattgtttaggtgcaataaaatcgattctgatatatgttttaatttcataccatgagtagggggttggttcatgttaagatgcctcagatgttcagtatgtttacctgtcaaatgcagggttacacttttgctgatttgtttacttcctgtgattttaatgtgtgacaatcgaagacctaattttcaatggtatggctttgcatctttagctcttattctaatacagaaaggatgtcaaactttagatgaactcattgatcaatttacagtgatgaatgtacttctagcaaatatttgtagcatgtaaaatgtttgaattatattagatggtatatcagcaagtacatctaatttaaattctagggttactttttagaggcttaaaaatctaatagaattaaatggagagctttgtttaataatgaaaactctttaggaaagtgatatggactcaattattgaaggaaattgatctaaaataaacacaagcagcatcacatccaatattgaagaaaatgatcattatcaaataaaatcaaaaagcataggcacaaaggtattttaacttcagattaaaacttttgcttattgatatatatcagttaattaacaaattgttgaatttggtttatttaaaattggaaaagtgtttactatcaaaacttaggttcctaattttggtgtgtagtatacatttgataaacttttttgatgaatcatttagttttatgggattaaacatttctgatgaatgttttcagttcacactaatggtttgtatgggtaattatacaaacacatatatttctgaatgctatcactagaaatggaaaatatagaaagttaaatttttacaggaaaaaagcagagaaaataagcaaattttatttattaccaaatggatctgctagctcaaagagctagattttatgttttaaagaggtgtccagctattgagttggtgttattaagatgaaagtctttaaaattattgcagtgaaaaatatacagaagtagcagtattcatcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaagtatgtttttaacacatatttattgaaataattaatagagatgtatataataaagcataaagactgatgatattgtttctgtcaggcctattgaatattttaaataagttacagagaccaattatgaacttttgtgggtcctctgaagtgttaacatttcaaaattacataagaaagtgaattactgagacacaagaaaaaaaattggaagctacagcactggtttcagtgactacaccacttaaagggaattgtgacttctgaacagggaagttttgaatgaaagcattttctgatcattataatagctgtaaccaaggttaataacgggcaagcccctgaataatacagttaatatgttttgtccagctgaatgtgtgagtagataacacatctatgctatcattctgattaagttattcatcagataatctgatgctaactacttttgacagttctggaaatagaactactgtgaaaacctcaattgatttcttggatatataacacctccttttaaaagggcctcagatgtgtataggaattctggcatatcatataacaaaagtaattaaaattaggtgtgatgttcatttttacccaagaaaaaatgtcctataaagatttggaagagtcaaatgtaaataacaaccccaaagtattataacttagactgtaataatacgaagagtgaaaaatgtctgatagaaagagatgtgagtcattccataatactttcataattgtcaatgagataccaggaaatgaaagtcatagctttcagaaatgaaattcgaaaaggtaaaaacttcattgtgtatagtaaatactataacaaaaaagcctgtgtgtaacaaatctactgctatatcctggccacaaaatcagcaaggctacaacaacaaaagtcctctttagagtgcttggtggttgatctgattaaagacttcttaaaaatatttaaagtattcccgggctccttcccatgtcataacagtgattcactgtaattaacgtgttaatgaaagagcctctttgcagtgttattttcactgaggaagatagagcctatgggagacctgaagctgagagcttttatattgtatcataacctttgaagcagaaatttcctgaaaactcccttcattgctcttcaagtctcagagagcccagtcacacatctaatctcccagggaagtcgaagcataaaatggtccacaagctttgccaaccaattgattagcatatacctgttgaatatccataagatactaggcaccccaaaccatgatcatgttgatccattcatactgtcaatgtctggaatttatagtatacataaggagattcatcccaaattcagatctgtaattgttaatagttgatctactacaggatcagcataaactgtttcatcctgacttctgcagcttggcaatgctatttttagcccagaactcactgtaagaagattccatatagggaaacaatttgaatgccttgggatgggggtgggtgagagtgcatcattatggaaatttaccagttatatcaaacaatatatattggttgcttggcaccacagactttagcagatcacactaagatcatgcttctatgccatgaggaggtaaaattgaatacactggacaatggttttcaattatatcaagaaatgatgtaggataaaatgctttaaaatttttatatatgtgtgactcagaaaaaaaaaaggctcccacttgcccagcacaagtggattacagtagattcaaccaaccaaagcttttagatgtatcaaagtccacctcacatgtttggccaatgacacagggatatatttccctccatttttctataatttcaagttccaatagtaggcataacaaagagaaacaatgctgacccatagagatataatttcctgaagctataacatgcaatatatattaacacctgatattttgaggaacagaaagtgcttatttctctaaaaaaaagagttatcattttctactattgactttcatgagtgatgaggaaagagcaaagttttgaccctcctatctcctccttctttgagatccccattactcatttaccccttctctgtgattagatgggtggttaacactagaagcaataagtggatacaaaacacatgtattaaagctcttcattacatttatgttcctcatatctttaccagtaagggaagcgacctggccaactcattatgtttctctgtactcctctagtcccaaaaataattatttgcttgaacaaaaaagttctgctttcagtagggctgtcaaaaaatcaaagctcatgtacattacaagggtatttcagtcaaacgattattaaatttcacataagaaaatacactcaacagacactttaactgctatctctgatcaaggcatgaaactgttcaaacaaataattaaacttgaaaatagggtgtcaacagaaccatgatgggtggttttgctgagttattttctttgctgtggaactcggccttaaatgtccacatggagagcaaatagagcagcattttattttatgttctcttttccaataccctacttacttgaggtatgctttctcttcagattttgaggttagacttttcttctctataactcatctttttgcctcctctgctcagcggcagctatcttgaacctcagaagccttggtgagactaggagtttcagcatcaagagaggtgtttggtttggtttggttcatttgtttttcagtatctgtaacacattctagtgatgcctgtcagtttgctggaaccactcatggtccttgctgtcagaggcaaggctctgccacttggggcgtgagtgtaggtgtagacccatggagaaagttgttttgcaacaaactgcctggatagtagtgttgctttgtaattatgtaaaatcaaaacattcaaaagatgctggcagataaatgagagataataatagtaaagaaatgagaattccagaaatgtaaaacaattctgaattagatttatttcagacttagctacctttctttttggcagacagagcaccattcttgggagtttcagggaatcaaaatgaaaatgaaaggcagtttcttccacaaggtttttagtattctctgaaattctgactagcctctgcccctcagggttcaacagtgtgagagctcttggtccagatgcccagtaatctctgtatcacctctgtagtaagaaatacagtataaaaaggagtaaattcagttatttagtagtggaaattacatgatgacagatattttcaaagatgcttatcattgattttctctccatctgtgctaatattcacatgcatacctatgcaaataggctttaaatgatttgatttcatacccaaaagtcagattctcctgttgttcatttagcatttttctattaggatatttgaaaaaagtattttttatggtaaatatagaagcatttgagcagtcttctttttatatggtcagttttccattttgaaggggaaacacttgtccttgtcagaattattgtgaactgccttagtttaaaaattggaaccaaaatgagatttgattgttactggggtaggtttttttttaagttttttactgatatgtaataattgtacatatttagggggtacacgtggtattttaatacatgtattcaatgtgtaattatcaaatcagggtaactgggacatctgtcacttcagacatttctctattctttgtgttgggaatgtttcaaatcttttcttctagctattttgaaagatacaataaatttttgtaaactataatctccctactgtactgtcaaatactagaatgtattccttctatctaactgtatttttgtacccatgaaccaactttgctgcattccccctcccacctacttttcccagactctggtaaccatcattctactctctacctccataagatccaatttttggggccgggcgaggtggctcatgcctgtaatcccagcactttgagaggcccaggtgggcagatcacaaggtcaggagatcgagaccatcctggctaacatggtgaaatcccgtctctactaaaaaaaaaaaaatacaaaaaattagccgggcatggtggcacgcacctgtagtcccagctacttgggaggctgaggcaggagaattacttgaacccgggaggtggaggttacagtgagctgacatcgtgccactcactgcactccagtctgggcaacagagcaagactccgtctcaaaaaaaaaaaaaaaatccaattttttagttcccatatgcgagtgagaacatgcagtatttgtctccctgtgtctggcttatttcacttagcataatgacctccagttccatccaggttgctgcaaatgacatgattttattcttttttgtggctgaataatattgcattgtgtatatgtaccacattttctttattcgttcatttgttgatggacacttaggttgattccatatcacggctattgtgaatagtgctgcagtaaacatgagaatgcagatatctctttgatatgctgatttcctttcttttggatatatacccagtagtgggattgctggatcatatggtagttttatttttagtattttgaggaacctccatactgtcttccataatagctgtactaatttacattcccaacagtgtacaaggattctccttccttcacatccgtacccagcaactgttattttttgtttgttttatattagccattttaacagagttgagatgctatctcattattttgatttgcattttcctgatgattagttatgttgagcatatttttcatgtgtctgttgaagagttgtatgtcttcctttgagaaatgtctattcaagtcctttgcccaatttttaattggatttatttatttatttatttatttttgctattgagttgtgttcattatatatgctgcttattaatcccttgttaggtggacagtatgcaaatattttctcccattctgtaggttgtctcttccctctgttgattgtttccctgctgtgcaggaactttttagcttcatgtattgtctattttttaaattttgttttctgtgcttttaaggttttacccaaaaaatctttgccaagaccaatgtcctgtagcattttctggatgttttcttctatttcacagtttcaggacttacatttagatctttaatacattttgagttgatttttgtatatgttgaatgtggtaggttattgtactagtgaaatgctgacaaaagcatgctgaaggaagatagatcattattttgttttggattcttacattgctttaaccacccgtgcttaattgttttattattatttcctgaaatattattatgcatcattgaatactaagtcagcctttaagaggctttatatatacacattctaggctttttctaagtataactaatcatcaagtataggtgtcatttacacagtttgtttgagtcactcctttaatatgatataattttcttagctgacattgtatagattttatcaaacctaaaattgagtaatacaagaaattctaccaagacatcagtgtcatttgcatagaggcgtaagtatattaagatctctgtatgaaatgtgttgtaagagtatgaaatattatcctactgatttattgaataaataacatgtattaatagttaaatcttgctttttatatgtctcagagccctgaaccttacagatctcaaacttcatatagtatttgcaagtcaagaaaaatgaaaattgggcacattgtgaaaaatcctggaatgtattaccaacaaattgttcatttctggcacattaattatttcacaaattgttcgtcatgttcccatttcacttttataagcacagtaacactctcttttacagaatgttgccaacatttaatttcttaatgaatcaatgactctttcatacattataaataagaatataggttcaccttaccaagtggctaaacagcattctctaatatttgttggagcattagggaaaagctgatggcaaccagtatcagttttgcataaatagtatttttttcccttagaacgtaagattaaccttttttcttaaaagttagcagcaagatgttaaaacgtaatattattcataggaagtttaagtacagccatagtaaagaatttttcttttttattagattttattgaacgtttatttgctgttactgtggtcacgcaacctgttaccgtctcatcacaaacagcatttcatttagtatattgagaaaagtgctgtttcaggaagccacatgcagtgctactagatcagaatacattgagggtcaaaagtttatagggacccttgataaaaaaaataataaatgttctcactctatatagggggatctcatctgagggaatttagtttgtaacatgccaaataaactttgctataaaaatagtttccatttaaattgcttctaggattctaagagtaggattatagagacagctcagtgtaataatattaaaatacatacttttaagtatggcaattcatacttttaaagccctattgcctgcattatcttacatcatactgtgtgcacttgtcaagtgatcgagaaaagctgctgtatttgggttgctattttgaactgttgaattaaatataaagtccaagtaaatatatttgtaacagtaagtaaatcgtgataatgtgcaattcatcattttgtccatttttttttcatttatgacagtttttttatggtgtagggtcacactgaaagggttatttcattctagaagttgtagatgaagtacctttatttgttaggggtgctggccaagaaaccattaattggctttcttgcaagatacaataacttttctttagttgtttgatgagtctcaatctcgtgtagaattctcaaatcactgcccctggtatgatcttgtggcagatttgtatagattccggaagtcttagaaagtttctcttgctgttacgacattgctggtggtccccaaggcaattatgctcctttagtggtcatcccacttaattaaagggagaagtgttgctctagatagttttattatatctccttgtggttgctaaacgaagcataccagctcaacagtacttcctgcttttaattgaagtttcgttttctaagaatatttagtagttcattttcctttcaggtgtaacattctaaattcaaatgagttaggatcttcttttggtttgtttttgctttattgtttgttgttctctgcaattattccctttcttgaattgtttatggaaggactcactgccttcatatttttatttagcaaaaaatctcttgagtagaagaagttggattgcatgcccatgagaccacataccctgtttgggcttcattaagtccgttgtaaatacagatattagagataagtaatattggctaatatcaggctattttcttgtgatgttacaacctcataaaaagcctgcagaggcatcactgtgcctcattttgtgttcttgacgcacaatgtgtgtaatattttctcatatctcctttatttccaaatgtttgttgcatgtaaatctgatatttcccaaaccatattttaacctatttgaatataagaatggtgccttccccatcttttatatttcccaccataccaaattcattactaaataccaagtaaatattttaccaatatttagtaaataaatgatagaagataattttactatgtacgaagccaaagacagaaaaaaaatgagtgatttttctctttcacataataagagatgactggatcaaaatgatacactttagtaaggaagaatttggaggttcaaattatgtgtgtttcacaatatgggcacaccgaattagaaatacaggagtgcagtttctaacccctgttcaaatgaatgtatgaacttgagcagctcccttcctttgtcaggttatcaattaccttaaatatcaaatgatagtgtataatatatttctttgacctcttaagtctattttgcaagtaataaatcccttaactttgcatgcattattaaatttttaataaaatctacagcaatgaggttatgtagaatatagatctaatgagtgctctttagtactgagtagccaggggatcatatttgaaatagatgggatatacctagggaaatgaacagttatttcctgctcgtgattacaacagtggacataggtttctaatgagtctttcatgacagcattcttttattttcctctgcctttcattatttggtttatttatataaaagtaacagaattccactggggcataactggacttgaccaataaaggatgactctttgtgccttctatttgcctccacttaattgtcctgctcgtcatcccgctgaattatggaaaatgtcacatttccttggcctatgactcatataacaaatgaatgtgtgaatagtgtcaaaatacagcaatttgctctatgtaaagggaggtagacagcttttgaaaatggtaaggtatataactagatatttctaaactgaagaaaattctcatttgggcttagacgtgtgcatctatggtgcaattagttgttaaatcatttaattgagggctcacttgcctagtctgtatacttgcctcactgatagtgactcaggaagcaaatcaagtggacttaaaactaaaatatcaataccctatacaacaagagaagagacatgatttctttattaacattggagctgtgtgtgtgtgtgtgtgtgtgtgagagagagagagagagtgtgtttgtgtgtgtgtgttagtttgtttagcttccatccaagcactgatggtcctgcaaattaagtggattcagaatcttcatagttcctgaccgataatccccatcttcaaacatttttttgcaggaggaacttggaatcattgatcttactgtgtttctctaaaatataataatttgtgcataaataggaattttatgacatactctatgtcctctaatagttttgtgtaatttcattgccatttagtgatcaacaaaaggagtttgtaaactataaactagctttttcctggctcgcttatgagggaataggacagaactccttgggtttaattttcagaaatcctaaatatcaacattttttatacttgatagagttaaatataaaggaataaataagcaaaactaaggccaaccttgtgcattagcccttccactcacttcagatcaccagagcttggatgtttcatctgctaacaattcctctgaagcattctcaagcatgttttcttgccagcaaaagtaatataagtcctaggcaataatagcttgataaattcatagaagatagaagattcctatgaatataagcttgctgacattttacagtaatacaaataaaacctgttaacatagtaaataacaggtactttcgggggggtaaaattattttaatttgacctatgattacatgtcttgtctattctgctatgcccagagatcctttctgatgaagatcaacttttctaatactattttactgagtttggaatggaactatagattggataattaccatccgagggagtaaagcctctaactaccacaattactcacatttattcacatgacatgaaaataaaaataacaaatggtttggaagactgcactgtagggggcaaattaaacaaaggtgcgcacacgcacgcacacacacacacacacccctctgatattaacagaggaaaggaacttattcaatgatgtagctttccactattggcactttttgttttctgttttagagacatagctcacctgaatggcacaacttgtgtgggtactgtaaatatttcctagacatggcaatgcattatattttccatttcaaaatatacttatagacagctatgggaaagaattacagtggtagctacacacagccttgttttccttgtatacagagttagaaaatagagatataggggaatccactcctgataccaaatatagccaccataagcatgtacaggcataccttgtcttattatgctttgcagatattgcagtttttacaaatcaaagtttgtggcaaccctgcatcaagaaaatctatcagcgccattttttccaacagcatgtgctcactttatgtctccaggtaacatttggtaattcttgaagtatttcacattttttcattattgttgtatctgttatgggtgatcttgtgtaatcagtgatctttgatgttactcttataattgttttggggcaccacagatcatggccatataagatggcaaacttaattgataaatattgtgtgtgtgctgactgctctactgacaggccattcccccatctctctgtttctacttaggcctccccattccctgaaacacaatattgaaattaggccaactagtgactatacagtggcctctaagtgttcaagtgaaagtaagagttgcacttctcttactttaaatcaaaaactagaaatggttacacttagcaggaagggcatgtcaaaagctgaaataagccaaaaactaggcctcttgcaccagctaaccaagttgtaaatgcaaaggaaaagttattgaaggaaagtaaaagtgctacaccagtgaacacataaatgataagaaagaaatagccttacggctgatatggagaaaggtttaattgtctggatagaagatagaaccagccataccattcccttaagccaaaggctaatctagggcaaggctctaactctcttcaattctgtgaaggctgagagagatgaggaagctgcagaagaaaagttgcaagctagaggtggcttcatgatgcttaaggaaagccatctctgtaacataaaagtgcaaggtgaagcagcaagtgctgataacagaagctacagcaagttatccagaagatttagctaagatcattgatgaaggtggctacacaaaacaacagattttctttttttctgattttttttttttttttttttggtctcactctgttgcccaggctggagtgcagtggcataatattggctcgctgcaacctctgcctcccgggttcaagagattctcctgcctcagcctctgaagtagctgggattacaggtgcctgccaccacgccaggctaatttttttgtatttttagtagagacagggtttcaccatgttggccaggctggtctcaaactcctgactttaagtgatctgcctgcttcagcctcccaaactgctgggattacaggggtgagccaccacgctcggccatacagattttcaatgtagatgaagtagccttctattggaaggagatgccacccaggggtttcgtggctagagacaagtcaatatctggcttcaaagcttcaaaggagaggctgactctcatgttaggagctagtgtagctgcagccaatgctcatttaccattccaaaaatcctagggcacttaagaattatgactctacttctaatctataaatggaaaaacaaagcctggatgacagcaaatctgttttcagcatagtttattgcatattttaagcctacttttgagacttactgctggggggaaaaaaagattcttttcaaaatattactgcttgatgacaatgcacctagtcacctaagagttctaatggagatgtacaaagagattaaagttgttttcatggccactagcacaacatccattttgcagcccatggatcaaggagtaattttgattttcaagtcttcctatttaagaaatacttttcataaggccatagctgccatagatagtgattcttctgatggatccaggcaaagcaaattgaaaacctgaaaaggattcatcattctagatgttattaaggcattcatgattcataggtggaggtcaaaatattaacaggactttgaaagaagttgattccaatcctcctgatgactttgatgggtttagggcttcattagaaaaagtaactgcagatgtcatggaagcagctagagaactagaattaaaagtagggcctgaaaatgtgacagaattgctgcaatctcatgataaaactcatgacaaaatggatgaagagttgtttcttgtggatgagcaaagaatttcttaggatggatctattcttgaatggtgacgatgctatgaaaatttttgaaattacaacaaatgatgtagaatattccaaaaacttagttgataaatcatatacagggtttgagaggatataatccgattttgaaataagtttttccgtgggtaaagtcatatcatacagtatcacctgctacagagaaatctttcatgaaaggaagagtccattgatgcagcaaacttcattattgtcacagaaattgccagaatcatcctgaccttaaatagccaccatcctgatcaatcagcagcaattaacatccaggcaaaaccctcaagtaggactaaagatatgacttgccaaaggctcagatgatcattggcatattttaacaatgaaatatttttaaactaaggtatatgcactgaatgtttagacataatgctgttgcacactttatagaccataatatagtgtaagcctactttttaaatgcactgggaaagcaaaattcatgtgacacactttattgcaatattcactttattgagatactcactttattgcagtagtctggaactgaacctgtaatatctccaaggtatgcctgtatattctatcactcccaagctgtgtgctcttgggaaagttacctaatagaatccttaataaaaaatggagtatggggctgggtgtggtggctcgtgcctgtagccccagcagtttgggtggctgaggtggaaggatcacttgatcccatgagttcaagaccagcctcggcaacatagcgagaccctgtctctacaaaaagaaaaaaaaaattagcggggtgtggtggcatgtgcttgtagtcccaactactcaggaaactgaggtgggaggattgcttgagcccaggagattgaggctgcattgatctgtgatcatgtcacagcactgtagcctgggtgattgatagagtgagaccctgcctctaaaaataaaatggagcattatctattcatggggttatgtgagattatttgtgtgaattgttagtcatatatatttgccaaataaatgtttgcatcccatcaccgtggctgaatgagcatcggactaaggctaccttcttctatgcgccaaaagttttggatacatttcttgaggctcatgtagttgtagaatctaaaatctaattttagcttagaagtgcaacttgaggaaaagcaatcaggatttttgaacttttaatgaaacattttataaagaaaaacatctcttgtgagtgctttgttccctgtttaatttggttgagggtactttgttcagtagaggccaaaagcctataagttaaataagctgagactatcagtggaaaaagaaacactacattcattcaagttcatgttatataagtttgccatcatttcaaagcaaagattttacatggctcacctgtgtaacaataaaaaaatctacggttcagttgtaaatgtgcacaaatagggcatgatgataggctcacagttgtagcttcctctaacttggtcatggactcaagatcaatgtgaatgccatatatcagaaaggagcaaagagtgctttaaaactacaataagaaagattggcatgcgtgaatctaacggtttagttatccattttgagggataatttatttggaatgctactttatttctttattttattttattattattatactttaagttttagggaacatgtgcacaatgtgcaggttagttacatatgtatacatgtgccatgctggtatggtgcacccattaacttgtcatttagcattaggtatatctcccagtgctatccctccccactctccccaccccacaacagtccccagagtgtgatggggactccccacaccacaacagtccccagagtgtgatgttccccttcctgtgtccatgtgttctcattgttcaattcccacctatgagtgagaacatgcggtgtttggttttttgtccttgcgatagtttactgagaatgatgatttctaatttcatccatgtccctacaaaggacatgaactcatcatttcttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctggatcaaatggtatttctagttctagatccctgaggaatcaccacactgacttccacaatggttgaactagtttacagtcccaccaatagtgtaaaagtgttcctatttctccacatcgtctccagcacctgttgtttcctgactttttaatgattgccattctaactggtgtgggatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttttcttgtacatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatacctaggttttcttctagggttttcatggttttaggtctaacgtttatttcttaagctaccatcccacaattcatcactattcctgatggtctgttttacagaaattttctgtcagcacataactataatagatagtacataatatagtgaaatatgaaaatctctgtgaaaggatcaacgaaatttgaagagagagctagtttgaaatacgaatcatattctcaaccttttaaatttctgattgaatgatttatgggaaacattctgtagcaatgtgaattccttataaggaaatagtgactgtgtccataaggatgatgtactctataattcagataatataaccatttatgctttgtagcaggagttccccaacctctgtaccaattcatggcctgtcaggaacctggctgcacagcaggacctgagcgatgggggagcaaacattaccacctgagctccgcctcctgtcagatcagcagcagcattagattctcatagaagcctgaaccttattgtgagctgcacatgtggaggatctaggttgtgtattccttatgagaatcgaatgcctgatgatatgaggtgggatagtttcatcacgaaaccctcaccgcttccaccacccccatccgtggaaaaattttctcccatgaaatcagtccctggtgccaaatagcttggggaccactgttttatagggtccgtatttcatagattgaaagactgaggacacagttaaggcattatgaagtcaatgagacatagtggtgaagaaaagataaattcttaaagataaatctttactggacatttaagtgggttttccaagtccattaatcccattcatgttttaacatgtctttgaaccctgaatggcccctaaacttagcctgtaccttagttccaactcacccagttttcttagtgtgcctacaaggctaacagaccttgtaggcttggtggggccaggcatgaggtagctgtggattcactgtgctattacaagtctaaaatatggaagtgtttttcagctttttttccttatgtctttttctgctgactctaatctttagttgcttttccccctttggttttactgcagattgaaaatgtttccattcattcaaaacaactatttcttgtttaaagtaaaactgttagttaataataatgatgctttagcaactatcatttttctcgatgatttagcagaacactgaattactgcgaaatgcaaacagtgagagggtataacagcaacaaaaatatatcttggaagactcaggtctcatctcttaggtctccttccctaccaaagatgaacattccccaaaaagattcaaaatggctgtcaccacatggtggaatcatatgtgattcttacgtttatgcccgtatgcaagtttctaaattagttttattacctttgttaaagaaaaaaaaagcagaagaatggaccctttagacagtgtctaacttatctcaattttccactcccctttgtgtaggcattgatttaatttgtggcatcgtttttaagatgcatattagattatcagaattgcatcaatgtgaaaaaaggagtaaaattaagaataataaatcaaaatagaataaatatgaaaataatagtaaatagaatttgtaatattttatagatgttattcatacttattttataacatttatataataaatacaaaaattagcaaaagaatttttctttcacagaattattattgcatgtaatatacaatgtagagttaaaaatgtggcagatgaatattatgatttctcaagattttcataataaaattatgaatgtttcaaatgtcaaagatctagattccatttatcctttgccttgcagttgagtaaatcctatttcttcggctaggttaccaggactttaaagaaaaatatttttctaacaaatatttctgtttggagctttttacaacaaatgagctctgcgtttgcatcgtacaaagtctagcttgcttcattgggaagaaaatggcatgagaaacagtatccatagatttaacaagctcatgacaacataagttatcaagtagcaaactgatagaaacgtaaactgattacttgggaaagcggcaagagtttggggtgctcatcagagccataaccatgagaactgccaaatgtttgtccttaactattagtttaccttatactgtacacgactctttagttctcccttgattgcacctcctgtaaaggggagataaaactctttgggagcctttcctgtgtttgattatcattctctccaacaccactatcaattgcccttgacaattttgtcacaccctccagcattactcttgctataaatcttgataattttagtatccatatagatgattcttaagtgctctgccatctcagttccttgaacttttgtcctccaatgatcttgtccaccctatctcagccatccactctaatggaaaaccttagactgtcatcatcagtaacctctgccctctgccccatctccatttcaagcatcccactgtttgactgttaccttctacatttacagattattccttcttgttctcagacttcaaatttcttgaccccacagagagatagtatatttaccctaacaccttttctcagttcctcaacctccactccctctttcagcttgcttccatgtcttcacttctctctttcctcatcttaggtgatgcagacctcataataatcacactttcagatattgattcaattttctgtttctcccaccgtaattaatcaactggcaatactccagcccttgttcaatccacatctgtgctaattcagcatctatactagttctgctggaggaaaatacaaccatgctgattggttttgcttaaacttaatgaccatcagtgcagaccaataagtcttctactcaaatgagttactgactttactttgttctctcatctataatatggggataataatagaaaactatagtcatagagttgagggatttaagtgtattcccatatacaaagaacctgacaatagtgcctggtacctagtaagggctcaatttattctacttctccccctcctctctccctccttctccctctcctcttccaccttctcctttttagtagtactacattagaattcccctagttaaattacctttataccaacctaattaattattttgaactttatttctcctgaaatcctgaatgcctccctctccccctcctaaggctaaggcttttaattcgcagagaaaacagaaagtcagaacaaaatggcctcatacctccaccaccatatctactcacccacttctagctgtgacccatattctgtctttttctttgttactatggatccttttccttgttcttatataaggccagctcttacagtcatgcagtatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaagaaaaactgggtccacccaacatggcaattcccaccgttgtccccttgcccttgcccccacatgtgcttggcagcatggctactcccacatatccccatgtgtgtaaaacatcatggctccctgcatttccatattaaaagactagggtggaagagtcagtttttccgcgggctacgtaaataacatgcctggtcaaaccaatcccctgagccctatgcaaatcaaacaccacctcctccagccatcgcatgtaactggctggtatcccctaaacacaaggtctcctctttcagcttcatttaaatgagaaaaaatattcctttattgcatatcccttaccagctaccattccatttaccagtttccctttacagcaaaatccctgaaagtattgtatatcattgtgtccacttcatctcttcccattctgtctatttaaacctattccaatcaggtttttacccctccccgcattattctacccaattactcttcctaaagtcaccagttacctccaccttcccaaatatggtgtcttgtcctcaatatctgcttccttgacctaaacagtggtggttgatgcagttcatcattccttcctcctgaaaacattttcttcacttggcttcaggacaccacactcgcttagcttttcttctacctcactgactgatccttctaagtctcctttattggttctttttcatcttcctaacctgtaaactttggtgggctccaggactcatccttgaacttggtcttttctctgtgcacactcaccctctttgtgtattactctcatgacttcaaacactgtctacatactggtgattccccaaattctccagcctggcattcttatttaaagttcaggcatatttccaactgcttccttgacttctccatgtagatgcctgattatcgtatttcggttaacaagtcccaaatagaaatattcatgtcacttccctaaatattatatgttcacagtcttctccatctcaataagcggcaaccccatccttccatttgcttaggtcaacatccttggagttttccttgccttctctctgtctctgacatgacacatcaatgcaccacaaatctttggctttctttcagaatatatgcactccagaactaaaccaactctcatcacttccacttctaccttctacatctaccctctcacacctgagttattgttatagtctcctcattagcatccctgcttccatccttatgcctccccactttgtgctccacagttatcctgttcatagtaagtcagataatgtgacaactcctctgttcagatttctccaatggattcttcaacgtccaaaatccttagtatggaatttaatgccctctgtgacatggcctaggggactatctttctgacctcatctccctaacccttactagctccttacttaccactcactgtgctccagtcatatcagttttcctgccgtttcttcacatcatgacaaacccacccctgctttagagcctttgcactggctgtttcttctgcttggactgctctttcccagattccccattgctcactccctcactaccttcaggtctctattcatatatgactttttcacagaggcttccctgactacttaatttaaaatagcattttgtcaccataatttcctatctcccattatctattatttatatatccattttatgcatccataatttatacagcacatttaaataaatcaagtcatgttaaatatgttaaatgtacatttattgaataaaatgcctatttgtatattgtttgtgtatgcacagtagagtataaattttttggcggtcaggatttttgttttgctcactgttttttgttgaatgaatcaatacgtacttgcttatttgtttattgtcttcctctactagaatgtcagctccttgagggcagggtctttattttgcttagtgatctttcccgagtacctggaacagagtctggaatatactaggtactcaataaatgttgcctacaatatttaattaattgattagttagttcagacattgaaagagcttccaagagtaatgtttaaactcaatcaatgtaatggataaatatccaagtactgtatgaggaaaagatattgataaacgttgcctgtatttataagattcataattttactcaactctttgatgaggaaatgttgacttgtccaaaagcaggtaaatataaatagaaaaaccggaggtttttcttgataagagtatccctctatatgaagcagagacgtaattcagcctaatttatattgaactcctatagtccaactattgattccttatcacttgctgacatttgttgctagggagcattgtgagtatttgaaatatacatttatttccactaagagttatgtaatcaattttaatatattttaaatatactttatgatgatgtagattaataatggaaatgatgatggcggtggtggtggtggcgatggtgatggtcatgtgtgtttgtcatagctaaagaacagcattgaaacttttccagtgcacacaacacacacaaaatccacttataactaaaaattaattatgaagtaggtcagtcttataaaggatttttaaggaaacataattacatgaattttctagattaactcaaactatgctaactcttgtcctcagatgacttgaattaatgaaatgatatataattagtgtttcagttgtttacatgtaaatataagttgagtattccagaaaagtttgttcgtaggcactttttcatctctagtttttattttatactgaaacaaaaagaaataaaacatcaccccaaactcactacacagatatttcagtgtctatcacctgtatgcctccctgtgtatatatacacatatatctacttgattgtatgtaaatgagataactttatatgacctgttctgtaacttgcttttttacgcacatcttgtgcatgtatttctatgtcaataaatgtacatccacattattgttttaaaagatgaataacattctgttgtatgtatgtaccataatctgctcatccagtcctctgctgatgcatttttttctttgttgctgttacaaaataatgttatggtaaacattcttatgcatgcatcatctttataatttgacttgcaagtatttttaaagtttctttctcagtgtcattattttgttctatacgtataaagggatctctaaacaaaatcaagtttcttccctattctgtttttaaattattgtaaatttcaaagtagcgaaattggaataaatgagattttactgtgtactttgcctggagccctctcttgaagtgtattcaaagggaattaaagggcttattaacggataggactatttgtgttaaagatgaagtctgttgaacattttcacctaaatataccaatctgatattcttgacgtttttttgttaaatttgatgctgacaataaaaactttggaataagctataatttctgcatccatgcatattcaggtctgaaaatgaaagaagagtgtgacaggtttgcatgtagaacttcccacccactcatttctttcctttctgcttctgacacttcagcctttgaaacagtttcccatgagcaatactgagattcagactatttagatctaaaggaaaaaatgcaagctcttctacagcttgtatctagcacctggaaacgtcttagaagaagtgctaaaatgtaaataatgctgttatttgttatgcacataggagaaatcctaaaggtattttagggaagagatggaatccagagatattaagaacaaggtgtgggggccaggggagaaggggagaggcagaaggatcctatccacattattaaagtgaaatatttccagtatactcttatcaactgacatgtagactgcatgccgctttcatgcaaaggtatcacatttcaaacttagcatttaaaagaagccagacaagaaaggaaaagagacagttatttgttgaaaaaagtctgggtttagcatcaggcacaggggttattggtagttgtctgaagtacactggagccttgtaacattgttttgtgccatgtattgccagcctgataccactggagtacatcctctgtctagttttccagaactcactacaataactgtaggatttttccatcctttatgaaattgcatcagtattgtgaagggccttaaaagccattcagttcaacaaccatctcccaaaagaaaagttcctcttctttttccatttattttatctcttcccaaagccatggggacctagatacatcaattatcctttgtcctgtaccttcactacctcctggactactaccttttttccactggcatacagatcatttcaagacttctcatcctaaaaagtccctcctaagtttctctttcagactgtctctttcctttgataggcaagagctttcttcattttctcgcctatttttaaattattcagcttcacctttgcttttattttctcatctaattcttaattattcagccctccgcattctatcttctgcccacattgccatccatgaactcctcctgctaatgtcgctagtgactgccaactaaaatccatttctcccttcagtccttaccttatttctcctttctacagcacttgaccaggttggtcaactttttcattgaaaccatctcttctgtgggctttcacaacactgctttttctctgttctacaccatcactatttttcttttaatttttacacttccctcgtcttttctgaaatgtttgatgtcctccccacccccagtttccagcctcagtagttgtcttgtattctgcttgtgttctctagattattaaatgtattcttgtggtttcagttaccatccatatgcagacacctttcatcttgagagccaggcttatatatacaaatggctgctgcacattaacctatcactaatggctctttaaactcaaaataaccaacaatggagtcattgtctctatctctgaaatagaacacactaccctcccccacttcttcccctttttaccctgtggcaacaaccttttgctatcctgattttaagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagattcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaaccaatattaatgttctgttatagatccttgtagtggctagctggaattcgtgtatatctctctctctctgtctttgtctttctttctctctctctctctatatatatacatatattccaaatatacatttttatgtaatatatatgtatattatatatgtatacatatattccaaatatacatatatatcttcatgtaatatatacgtattttatatatatgtataaatacataatatacatatataacctaatatatgatatagcataatatatgtatacacatatatgtgtacatatataaaatacatatatattacataaagatatatatgtacatttggaataactatgcataccatgtttcaaacctgctgtttactcgttattatgactattcctctatatattaaaatattattcttaatctacattttagtggttgaatagtaataatctatttagtttgttctctgtttatttgtttttgtttttgggaacaaggaactgttcacacctaaatgtgtacaacctttatgtctagatcaggcacttgaattcttaaaaaagtgttaggaaatggaataatgatcttttatttataagttgtatatgtttctgtattctgttcatatatgataattgaaatagacctatatctaacactttaaaatttatagtattttcatctttatttcctcatttgatccctgctacaccttgtgagatagagaagggcttattattctgtccttatagataaggaaacttatgtccagaaagatgaagtggttttccaaaagacacgtagctaataaataattgacaacattggaatttggaattagaaagcaagtcttgtgactcctaaccaatactctttccagtacactttgccatgtcccaacttcactttctttaagtgcttctttctagcacctcttattcaattattgtcatacgtactttttggatcataccttaggagaatgtagctttctcatgaatttcctcattagctgacaactgaatatggctagattttaacaataaaaacacatttttttcttttcaggaatgcaaatacacagtgtattatatgtagaaaaaactctcagatattggatccttattgatgaggcttatgagataatatagcaactcagacttttctcaggaagaagaaaatccatgtcttttgttggacagtttagagagtctagactaccatcattcagcatttgaacattttgatttcaaaatgtagacaattgaagaaatacaatgtaaatgccagggaattaaatcataggacaaaaactccctatgaaaacatcttagtgatagcatacatgttaaaatttttgaaaacactgggaatggtttcacttctcatctgagtatctgagaaacagatgattatgtacctcccagccctgtgtcagccctaatttagttgatggcattattgctccctgctttcttttttttctctttatagcagattgctattcttttttactttaaaatagcaccttttgctgccctgtcttatccttgtgctcttttaaaaagtggtcaggcacacacttttgtcactagttttacatgagggtaggggctttctcttttcttttcaaaaattaagtgccactacatctcagttaaactgccttcatctgacaagcacttacagaatactgaaatataatctactgcaaaaaatctacatgtttttcataaatacgaatgaaatgcttttaatattatccctgtgttcagagttaatgcttaggcattaactaaagtacgctagacgcttttgatatatttccaaaggcccagccagaaagatatattgcagatacacatattctaagtgtttacaaaatcttccaaaattattttgcctgtgtctgcttaaaaggcacaggaaacagctcccctactatctcctctatccagtcaggaacacttgcagtaaggacactggttgttcagtgcacaaggattaaagtaacttaattacacagtcaaatcaataataaattgagatcattagagccttggctcgagctgaaccccaggtagccgtggaatccctatgatacttgaagaagaattgacacagattctaaggcctcacaggttcaaggagaagcagacagcctcactttgttccttcaaattagttttgagtggaggaatcttaggtttaagtgagacctggatcttgttttggggtgatctctggaaactgggatataatctactctccagggtagaagactatgaagggactaaaggagcaaactctaggtcactgagaacccctttcctacaaacaaagatcttggttgtgttccctcacttccagagagctcattggaccgagcatacccttgagtattaaggtcagtgcatactgagtttaaaaacaacataggtataaaattgaatggagcagtggtgaggaaggtggaaaaggatgagaagggaacttcctttggacttctttgagccaaaataagtagtatgtttcctaaattcttgtaatcagaccattgttggctattggtagagggaggttcagattttccatctctatcttttttcttctgtttcttggtccttctgccactgcttcttttaaaaagaaataaactcatttttttctcagccttatgtgggaaaccctcttggcattttctaactgccaagtgttctataactagccatctgtggaatatttttttgttaagttaattttttaaattaattcatttcccttttctctctctctctctctctctcacacatgcaaactagtgtttgaagatcaatgagcaaatgatctttcttgtaacaacttccctttttcagctgatcgcttttctgaattttatctcctaaaatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaactatctgtgtatataaataatcaaggtgatgttaactgctttatggattttcttgagcaatttaacacaagattgattagtgatttctgtctgtagaaaatgtttgattccaggctggcttagcctcaccacacttctgactgcctcctccctatctgaggaggctcagaaaatacacaatcatttcaatattcacctaagcaaaataaaataggaagataaatttctgccctgaatactgtgatgcgtaatattaatacaaaactccaagagaaatacatttgaggtaattttttttttaacttggataacttaactgtgagtagaggcctgtgattccacaacttcactaatgtggaattttttctttctttccattagtccagactctagactttgagggtggagggggaactagtcttgttcaagctggagttccttattaatgagagatagtttagaaatcctgaataaggctttggaccagacaataaaaaaggaaatgtgaaagctcagagccttctagaacaaagaaacaccccaaatcttatgcctgtcagctggatggtgacagtacccagtagctctgcagtaggcaccagagcatctgaagtacaactggtggacctcgagagaatgggagctagctgaaaaccattctctccttcttaatgattatccattagcacaccatgtttttattgcagaatagattagaaacaattagcaaatggaaaattgaagaggcccttgctgcttttagtgtttagatgtaacttttgaacagaatcaaaatgctctttttggagtcagatttgccattttacctgaattccattttatgcgtctgccatgggttacatgcttcattccatttaaaaacggaaattttctggatgtagattcagtatgtcttgctgattgctgcatttatttcagatgctctttagaaagcattgtttagtaagctaactttttcatgctgagcattaaagtgatggttgaagcatattccaaagtcatcttttaactcacaagaatatggaaccatattgacttctaccaagacagtttaatcattcattgttaacaaagaacattatcatttttattgtacttgtcattacctattactgtactcttgtctgaaaaggcactatggtataagaaaaaataatgaaattaaacgaacaatggatctgattttgtcaatgctcaggaagtgaatcactcaatgccagtcctatagaattcagggaaacatcattagggcttcaggaatttcgactttactaatgtggattttgttatatttctcacatagacttggatgaagctttatgtgaatgcaaattttctcatttcttatattgatgcattgtttatttgcatttttattgtaactcctccaaagagaagaaaatcttggttaatatgcagattagaatttttattgaggattgtgttttattgttcttaaagactaaggtggtaaagaaggttagaaccccctgatgaaatctgcatcacattcaaagaaatagtacttagtgagattttgtcatgaacactttcacagcttgattctatttctcattatatcccaattatcaaacgaaataaaacaaagccattcctatagaatgaaacacatgaaaatggcaaactgcctgtaaaaatgaacaaggaaatactgatcttcaactattcctatacccttatttctaacctaatgtaccaactctccttctctcattttcttttaccaaagtactctgaggcagagaaattaaatttctatctaatactattggtgaaaacagaagactatatgagaaacagagaaaatctccaaacaatcatggtgtctcctggacttcctaatatggaagtcatctaatatgattaagtaatgcagcactagtaacatcaccagagttcacagtgaaatgttttcattcatccccactggaactccaaagcaccaagtggacttagcatcagaacttaagaaactgaagccttcgttagccgtaagtctttgcaaagaaatggaatcacagttttgatttatgtaagaggcacaaagcaaaccattactctgtatccacaaatgtcaattgtagaggagcaccaggtatctgagaggaagatctttgagggatatgctgcttcttatacccttttccaagctcttatttgtttagagtacaacaaaaggaaaggctgagtaagagaactgtgatagggtttgggagaaggaaggaaaattccatggacatatactagccaagtaacttacgtagtttgggtcacttgttatctgttaactacccctaactcctctagtgaatgaggagtagtggtagtagatttctgaaaagacaacacagtgtttattacctaaaggagcagacttcctcaaatgtgtttctgttggacctttggattgtataacatactgtttggggacagaaatgaaacttcctagttatatttttcttagatgtatactatagtgggtgtgtattatctgtgtaattcccccaactgtaatatatttcaaatcactttattctaaaaatgaagtacatcttacatagagcaacattcaaataaaatatttgccatagaaaatagagggtacaacgatggttactagaggttggaaagggtgaggcagggagtggggatggttaatgggtacaaaaatatagttagataggataagatctagtgtttcatattcacagggtgactactgtcaccaataatttattgtacattttaaaataactaaaagagtataactggattgtaacacaaagaaagggtaagtgcttgaggtgatggataccccatttactctgatgtgattattacacacagtatacctgtatcaaaatatctcatgtactccataaatatatacacctgctatgtacccacaaacaaatttttaaattcaaatttaaaaaattaaatgtgtgtcatgagaatttctaagaagggcactccaaatcattggtttgccttgctagacaaagtgtaaattattttaacacaatatacagctgggtaaaaggaaaaaaagactgtgacttgtttgccacccacagggctgtcaggaaaggctacaacatttcacttctcaaggagtaagttccttttacagattaaattggaaatacagttacattttatttcatctcaccaatgttgaattaataacctatgtgaaacctttatttagaaatgaacacttcaagcatgcgttaaattagcaactaagtacatagcttataagaccatgaagaatggttatgtttataatgttcatttttaaaaaaaaatattatactttaagttctgggatacatgtgcagaagtgcaggcttgttacatagttatacatgtgccatggtggtttgttgcacccatcaactcatcatctaggttttaagccccacatgcattagctatttgtcctaaagctctccctccccttgccccccacctgccaacaggccccagtgtgtgatgttcccctgcctgtgtccatgtgttctcattgttcaactcccacttatgaatgaaaacttgtggtgtttggttttctgttcctgtgttagtttgctgcgaatgatggttttcagcttcatctgtgtccctgcaaaggacatgaacgcattcttttttatggctgcatagtattccatggtgtgtatgtgccacattttcttcatccagtctatcattgatgggcatttgggttggttccaagtctttgctattgtgaatagtgccacagtaaacatacatgtgcatgtgtctttatagtagaatgatttataatcctttggttatatacccagtaatgggattggtgggtcaaatggtatttctggttctagatcctcgaggaatggccacactgtcttccacaatggttgaactaatttacacacccaccaacagtgtgaaagcattcctatttctccacatcctctccagcacctgttgtttcctgaatttttaatgatcgccattctaactggcgtgagatggtatctcattgtggttttgatttgcacctaatgttcatttttatacttaattattttagaggcaggttgttgctatgttgtccagactggactccagctcctgggctcaactgatcgccctgcttcagcctcttgagtagctgggactataggcatgcaccactgcacctagccttacttaattaaaaaatatctttctagaacatttttagctcattgcttcagaaggtattaatgtgatggttcagatctgtcattcattttttcaagtcattactcgtgtccttcacatttcagaaggattagagagataagaagatcaactttcaagattatgtaagattgatagaaaaagcaagccagtatttccaccatcagcttgagataagattccatattttgacttatacaggtgatagaggcgaatgtttttcaatttgaggtatttgtcagaataggcaagagatgaggacttacactttaaaaaattcttctttaaagacaagtttgagaataaaatcaagctatgattatgtagcctagtagaaataatatttatcatcccttaacttgtaaatgagaaaggtcagtatcattctttctgttgtataaattttgaagctcaaggctcagagcatttgccagactttagtaagggtcatctttaaaccagtgaccgatccagagattcctctccattagaattcctggatgtaaaagaatgtaactggtcttgaccttaagctactcccgacactcgaatgttcaaatgtctttcagacaaactgaaaagttattttccgtactattatataagaatgattattcttttgcattcatagattgaatttaaatttgtcataattgtaacttttgacttatatacctagcctaaataaataaaaatgtttactttaaaaagtccaattagaatcattggcttaactagttgctttcatttaagtattcatacaaaagaaaagaggttttaaggattagtttctttcatgtgctaggcagtctagctgatagctgttgtagtgaaggcaatttctgttagtaattgctggttgtatttgcttacacctttatttaaaggaaacttgtctgttttgacagtctcacattttttgctcattctgaaaattacttgggaaaattacttgagtgcagaaaagttattttctttgtattgtagaaaaacatccttccctcctgaacacaaatattgtagtcctggtgaaagctaactgctcaacttcacttgttggctttgtttcagtaaggttctgccattacaatggaagcttatttcatagtttccactttcacgactgatcctcaataaaagaaaacaaccagttaagcataataaatatttgatttagtaacttgaacatagtcactttaaaaatcagaagcgactctataaggcaagacctttattagaattctctgctgtcctatgcagtaatggaggaagaaacataattatcaaagatctacatcaatgacatatttcagattgtgatttctgacatcagtgtagtaatcatactgggaattggttgtttttatttctagcaggcagaatctgaattttggttttggattaccagaataattgcttctcggccttttggctaagatcaagtgtggattaccagaataatccttcatagagcccagtagtcagtaaaagatttggtttccttaagtatatagtcaaagccattaagtggaaaattgagataataaaagtaggcaatgtagttccgtcatcacatgcaatatgattgtataatattgtgtcaaaatttcaaaatagtttcaaatagtttatgcatacccatgtggcttgaggcaaaagctcctaatattggctctttagggctaacggcaaatgcccatatttaaatgcttgtgtctataggaagtcagtaattgctaaaggtaattctgtttgcagttctaataagataagtgaataacatggtgattaatgttattttaataatagatggagtcatataaacacctaattcttaagttagtgggttgtgtttgttcatgacaaatgggaccccggaggatcaaaattaaagattcaactaaatattttcattcatttccaagaacctagtacattaccctgcccataggcaatcaataaatatatgccaattaattggctttttttttctaaaattgatttccaataattcctaaagaacaaggtcaaggagaataatatgtaggagtcattttaccaataattgataattgagctcagagtgcacaggggtgatctatgaaacgccatcatgatttctgaaaagctttagcaagggttattaaatataacagattatttcattcagtactatcagtctgattgaaaagttaggccttaatgatgtccatagctggtattttgttcctttctatgtgtagcatttccctggttaagatgcctcacaatgttctcaaattagtatctttcagccttctttgttttttggacattgtgtctgttttttgaggaggagtctgcctgccatttgtttcacactttagtagtacctacctataagattgaaaaggaggttgtgccccctacttttctgacactttaacccaccagcattaagctaataacctactggcgtctgccagaagatttgttagtgttaaacccatatgcttctagtgtttggcaatgtgaaatattataccaagtcttatcattcaccggttatcatgaacccctcaaggtgctatggtctcctcctccaataagctcagttgaactccttgccaaccaagagatactgtgacaggattgttcttatttgctgttgctatcagctttgaggagccactgcagcctggagaaagccttagaaaatttcccaaggcaactctgctattcccccctaacacctacgggatttacatacgctatgccattgtattccctatgataatatatgtaaagtcctgtacacattactgacatgctatacgtgttgaataaatgtcagctatttctattattaaatatccattattatgactgagcctctctagtggcccttaggctaaaatgactgttatacctcagtctaggatgctcttactaaacagcagctccttctctgattaaagcaccatgtgttctcaaagttcctatagtgcactatgattactcctactttggtactcatcttgccaaacaatacttgcaacatttatccttcctgtttctctaaccagactgtaaattctgaaaaagcaggaaatagctgtgacttgttcactgtagtatccctagggctttagcatagtgtctacacttttcatgcatgtagtaggtgttcagtaagtgtttattgaattaatgaatgaatgaaaagtatcctagtatcacaggttctgaattattcctacagagaagtccccaaagaagctatgtattctccagttaccctctgaaaccatagggtaagcataatcaacatattttctatgaatagatgcaaagcgttaatattagcaattatgctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatgtatgtatgtatgtatgtatttttgagccggagtttcactctgtcacccaggctggagtgcagtggtgcaatcccagctcattgcaacctccgcctcccgggttcaagcgattttcctgcctcagcctcccaagtagctgggattacaggtgagtgccaccacgcccagatgatttctgtatttttagtagagacggggttttactatgttaaccaggctggtcttgaactcctgacctcaagcgatccgcccacctcagcctcccaaagtgttgggattactggcatgagccaccatgcccagcccatcaccccattttgaaaaccaaaagcctaaatcactcaccttgaagcagatttgatgctgactatagacactaattgattgttagtcctgttttggtttatacataggggcagccattactatgctattttattcaggcacgaagtaattgttttatatgaatgcaaacattctaaaatactgccattcattcctcaatttataaacttcttctttaggaaattgtattccttattataggctgggtgaccctttacaaatcttaacttattttatcctcctaacaactttatggagaatgtactatattttccccattttaaagatgaggaaactgaggcatggaggtaacattacttgcccaaagttactaagttagacccgactgggttctaattattgttctgcaacttactgacttaaaaactcaaccagtatgcaaattcaaagcttccttaatacagaatgtaaagtgaagaacaagagtgtacagcacaccaatctgggacgctatttgccattagttcagatttttttaaaggcatgtaatcaccccttatacatttttccttttcccagtgtgccaaaatcagcaagccaagacagttgattgcagtgggcatgtcttaaaaaccagtttccatgaaaggagcgactaaagggcctattgtgcttgttgccttacttttattttgagtccagtatctagtctgttagtttatatacagaagagactatcttgcagggaattcagctaaccctctgcactgctcttaggtcagggccctgaacctttgctcctggctaagccatcccaggtatttgattagatacgttacttctgagttcacttattagcaaggcacactatgatggagtcctgatgtacctacttgccagtgagtagaataaagatacattttgtgtttattgctgttgataaaacacttgtgtaaagtgtaatttataatttaatcacttttaattcaatttttaattaaaaatttaactttttaattttaataattaattactaataattaacttaatcattctttttttctttctccttcactatgcttcctttgaaatcatttccttctctaaacaacattggaagcgtggcactgaagtgatagatttttgtatcccattgtacttaattagcaagttgtggcatgtatttggttaatatttctctttctaaaaagattattatctttgttttggtaaattgaagagaaattgtggtccatggcaaaaagaatgaaccatgaacccatctgtacggtatgtgctcagcctgagatgcccatattctacaaagagcaatttaagcatgagtgatatcaggtgttaagcccccatgaaacatcagagataaatactaggtccctggctaacctgctttcgatgttttactgttcaatctgtaatctgcagtgtattttaattaaatcatcaaaattacagaattttctttggaaagatgtattcttcatttgttgtttggttcaatacaaggagttggcatttctgatatgttgagaagatttcactttcacatattactaggataagtccttgaaatttactagccatcaggatttgctgcttttaatgattaattacctgttggcacacttttcaaaggtattctctttagctgtttcctttcatcttgccctaccttttttgtgaatagcctttcatgtttagctcaaaagagtattcataaaggtttatttcgtttctttgggtagagatgctgatttataattttaatgcagttcgtaacagcagtgaaaattaaagtcctgagaactgtacctcagtagggtcctaaatattttatgacaggtctaattgtttaataattatgcaaagaccttaaaaatttggaataatttgtcccttcactgtaccaggctaccaggattcatctatcccttaatttagtaaatttttatgtcaggaatagagtaccatgtactgttccaaacactggagtacagcaatgagcaaaacataatccttgcccacagggagctcatattatagagagggtagacagactttaaacaaataaagatatagttttctttggagaataaacaagaagggttagaggggtagagagtgcggagagataagggtttctctttcatataggatggtcaggggaagcctctctgttgaggtggtatttgaaggatgagaggggaaggttcaggcggatatctggaggaaaattattcaaggcagaggtgtaagccagttcaaagagtcagaggtggggatatgcttagcatattaaagggacaagcttggaagccagtgtgacatataaaatgaaaaaagaggacaaatgatacataagatcaaagacgtagtagtggtcagatcacagatgatctcataggccaagtcagggactttgtctttgactctgagtgaaatgaaaagctattgggaggtgtagagtagaagaatgacatgatctgctttatattgtaaattaatgttatactacatgtatagtttacatgtatagtggccaactaacagagtgaattagggaatgctatcaaggagtccacaattttccctccaccccatgtggcctcactggctttgctttgttccacagacaaagaatgaacctcagattttaacaaaacattgtggacatttgctctgtaggtcagaatggaattggcaagaaagtataattagctcagcccatcccatctacactgcacaaagaaaataatgagtacactcatttaactcagctatcagcagtgcagcaaaaacaactcccactgaagtgagtcaggagcatcttcataaaccaaggcaagcatattacaccctaaatgatggctcagtggcctcaaggaaataaagtatcttcctaagcacctaatttactaccaggctgtgactcaggctcaggaaaaatcgaatctattattatatattcagaatacagtgagcaactgtggctaaatattgagaatacttaaaagaatggagagttaatattgctaagaaaacaaatgtgtagtctgaaattattttcactgcttatgtgtatgtctgtcttcctgtcactgctgtttacacacccatctctttgcttttttgttggagttgtacacataatttgatgtgcttgcacagagttaaacatccctattctaatggcttcatacctgctaaatttgtctactcctatttccttcaaatgctagaaaattagtgaagtccctggcaactaagtatagtctgcagagcttaccccaaagctatgagatttgaaactctgttagtgtttactcagagtcttcatactatcttttactctggtcacttggcttatggttcccctgttccttcctcctccctatggttttcagcaaatatccagcttctgtaaacattccttcagtagatctgaattgcatagagtataacttcagtgacaccaaagtgtgttttgtagcatgttgtttctgatgattgaagcaatcttcctgtgcagaaaggtgatttaaaaatggagccgccttatacaaaattacagctagataagaggaatgaattctggtgttgtgcagcagtaaagggtgaatatggttaactataatttattatatagtttcaaaaagctagaagagaggatttttgaatggtcacaacacaaagaaatgatgaatgtttaaggtgatggatatgctaattatcctgatatgatcattacaccttgtatacatgtatcgaaacatcactcttatcccattaatatgtacagttattatgtgtaaactaaaaagagaaagaaaaaattgaatcttaatatcttatattggcatagaatgtagtgtattgtttatagttcactatgattaattgactcatatttggctagtcataacatgtacgacttgtatgttcttgtaggaacatgtacgacttgtatgttcttgtaggtactgtcatgatggcaacttgggtcattctgaagtgtgattctgaaagatctggttttaggtttcaacaaaagttatttaaattttaatctgttccttgctctaggataatcacatttttttttagagattggtaagcaattagctgctgccgcttctaatgataatagaatacttaactataacatgaatttaccaaatgaatccttttggaatggaataaatgctcaagcaggttattctagtaggaagagattcatgcaaagtagagttatatcttgtttggccagtgtagactatagaactcagttttggtctgttgtcttcttgctgtaagaatacactttaggatacttcatgagttcaggctgagacctgggaagtgctctttggacaactgtctagagaaggcacatgctattccaaaagtgctaagcaccatggttgtcagaatctagtttaggaaaactagtgcacgtgataggcacttaagaattctttgttgaattgaatgagtaaactcttcattaaatggcatatagaaaaaatggtcttcataagtcagccagaggtgataccacacattctgctaaacaacaaacattatgtgaagatgttgttcagaggagttctgactgtctagggaaatcatgcattgtgattctttacacaaaccactttctttctggaaccagaacttatacctgctttacctagagaacagaatagaatagctaggctcatctgaaaatgttttagttgatataaaccagcacacataattgaatgtcttcttttctgaacaactgacatttgagagtcagtcaaagaacaagtctatgtctcctttccccagtagtgagcttcaaagcagagcaaatggatccatgacagggccgaggagggaagaatcagatgtggagtgcatgcaaccctacccccagagacataacttgggcaggagaggaaaagaatgtatatctggtacaccctgtctcccttacagttatcacctttccatcaactgactgtgtttattttagttggaagtcagcatttaaccagttctgcctgaagcttagtgagggagtttgattctgagaactgtgttctcactgaagggcaatattctctttctcttggggaaggagtgttgtttgtatcctcctgatgttgagggatatagtagccatcatcatgtaatgacataccaaatgtattttatctgagagtttaaaaattagaagcaatccaattgctgatgtgattcatgaataaatgatgcaacttataatgacttggtgataacaatttattgtataccaatcacgtgcactcagaagaacctgtgcatgaaatcaatgtgagcgctaagactaaatgcaaatatattgtggacatttaaagttttagcccccttgattatctttaaggtaatatatacaacatatttgccaatatagatttttcttcaccagccatctggtaaaaattagtatgagataaataatttagcttccttctgttcagatacaacttcattatcctcttccttgatgctgtgaaaagtcttcagaaataatcaatggtaaagtgcatttgcattcctgtcaaagctgagcctggaggtttctgacatgctgacgtttgattctttttctctgtgcgctgtgaaaaggagaggtgcctattatcaactggccccaaagaattgcgtgcatagtggcagccttgcacaagtgcactgcctgctaaatcacagtgtgaggaagcatgacatgacacaactgggatgttcgagaactgcaagtcatttttcaggatttaaaaaaaataatactgcagaacataagaaagagatttaggaggaattagttacatactccttgtgacctaatgattctctctctacccacagagactatcttacccttgaagcacagtaattggtttgtaggagatatttttccattcataagaaaaaaatatctcctacttttcatcctggacttatttctccaatctggcttgagttgaggaatcttatgctagagttgtaggagagcaggtgccagattgtggagggccttgaacgcccggccagggagtttagattttatcctgtaggcagcagagagccattaaaagattttgagcaggaggaatgtaaaaaataggacttgatttggatgcacgcttagtataaaagtgcaatgataagatatattaagggagtgttacggttctgttcacagcatgaatataactgtaggattcatctctactagctgactagttcagtttttatagcatgcaaattttcagagccagctgtaagaggttgatggtaaaagaacaaagtacgaattgatcatgtgaatgtaattgtaaggagggatttttaaatgatcaagatcactggtaacacagaatagtaatcattttaaagggtgactgtagaattatttgttattttgtttgagttatctgaaaccacttctatgctatataattaccttaagttttaagtgctccctgcagggataatttatgcattttgcattctcatgcaaatactttaacagtctacattgttgaaaatagaactgaacattatttcagataggtaatggttgtacaaagcttatgaagtattcatcatttttatatattctcatggtttatattatattactgtgttgtgttttcagctacagtgatacttaggtaacaaatatttgaaaatttaaattgcatgttttgataaagaactgtaatttgccaatttcaaaatttaatgtcatcaaaatccttttaaaatattaatataaaatgttgcagtatttcaggaaatacaaggcaagccaaatttaatttaagctactaggggctcagttatgaattgtagctagatacgtggccaaacactcccgtaaagcattgcatttttaggattcaggcttcaccgcagtggtttctgtagagccataatataagatgataatcataaacagcatcacaggcgatggcagtttagtcgtaaataggaaaccgttgtcttgttcactgcaacatagctacacatgtaagcattatatatcccttgtgaaaatgtgattcactttatgatggtgacattcatatttcaaagtgtcttgttttaatgagctttcacaggatttctttgcaccaatcttgaacttctcaagagtcctggatttccttttttttttttttttttttccccagagatggatgtgcattaagcataggaaaacctccaggaagaaatatgtttactcctctgtttggctcctctatagacactaactttacagaagaactttacttaccttgggcagcctatcggatttcaccctgagctctgagcacagctgggagtttggacagtaaagagatgtcttctccagcaaaggggagacaacttactttccagccttccccgttaaacattcacgggtgagggtggtggatatttctcaaagtccacaggtttatagaattggggaaagcaaatggcccatttttttaactttctgtgttttcactctctgttgtctttctccgctttgtatttctgtgtttcgctctgtctctctcatgtatgtatgcatgtgagtgcacacatacacacacacgaatctgactaaataatttatatatctccttatatgtgttacctgcgtctgtacctgaaaaggcagaagcctaatttcagtaaaggtgctctagggtcatttcctgaatacctctagagtagagttcactggaaataaaaaacccaacatgtgcccaaactcagttgtgagtatttttgcagtagaagagtgaacttttcatgccatgatctaggagaatgttaagtggacagatttatataagataaatggaatgctgctgcccgttgtaatggaaaaagaagcggcctaggggataggctgcctggcttggcttctgctctgtgtcagacctcttcctaccctctggaactcaggatcagttggagctcctggatcttcagtgtcttgcagccccagaaatatcacatgccagtaccagctaccgtaaacagattccagcttcctctagaaggagctgcttccctgcactggattagttctccagcagaaagtgttaatgccaggttccagtgtattagcatctcttgtttcatttctttgactctaaaacaagctctttagagatttttttaaaagtctaccaaaacccattataatcattacttttgttatcattacttttgttaaactgtcccttacctgtcacttgaatgccataactattcaagcagttgtagaaaactttaaatgtaggcactgcttaaacataaaatactgttatatttttcattattgttattagtaatctacattatgaaagtagaactagtaaaacagtggtttggaacaaaagaagtgagataataacattgtagttttgtagcatagtaattaaagtgagatgtgtaaatgtcatctggcctattaatatggaattatttcacaaatccctttattatcatgtggtctcactgatacacattatagtaattctagtattagattcttagaatattttaagcgctaaatcaaaggctcatgcattgtcatccttgaaaaggaatcactactgtaagcatttctcacacatacaattaatgtgtagcattagcccctcacagaaatggaaaggtgcttttcttctctgtttttattgaccaccaccagtttttataccaatttcaagttgcggggtggggagaatactacattttcttatatatcacacaaatggaaagttaaaggaagggaagagatctggtagttgtcgagcatttccacttaagctaactgcttccccatgccttctgtgatcttccgtatgaagcacatgatgctgtccccatcttgcagatgcaggatcagaaaacacacgaattgcctacagtcagaaaacttggaagtggaagaggcaactttgagctgagctcttcaaaagggccagggcacacaaataggagggagggctgagccttcagcaaacgttgaagttgcgcatttagaagggagttggcattacagctgttgtctacccagtgactactctgtgggtgaaaaggtgcacttgcaattgagtttattttaaaaatgacttgttaagggcaccattgctgtgattttctcacctgtgaggtgggaggaactctcctctcaggccagagggaagtaattactgagaggtgccttcaagagtaaagcagattgttatatatttcaaagggggctgtcacagtgcctgggacacagtaggctttcattaaatcctagattagaattaattcttctatttgggtctcaaatgaataaattggctccctccattcagattcgtgacaaatgactgccactagcatcctctcatgtagctcctttcaaggggctgatgagtagaaatgcattcttcataaaaaaggttcctctctttagcacttgttatcctcagcagtcatttgcagatgtaatgtgatgcagcagtttaatagtcctctgcagcaccattctcatccattcaaatccttggtttatagatgaggcctttgcaccttgccctgtgacaccagcttttatgttttgcagcagaaagaatgctatagtgacttccatttgagcagttgctgttggctagcattactttcctacttgttcaagaaagtctcctttcaaagtttttgaagaagcagactcctaattactgtgacacttttcttcagagacaaaccctaccaaatgtaacagagctgctatccaatgtgtgtcaaaagtgtgattctcaaagattcctggccaggtgcggtggctcacacctgtaatcccagcactttgcgaggccaaggcaggtggatcacctgaggtcaggagttcgggaccagcctggccaacatggtaaaaccccgtctctactaaaaaaatacaaaaattagccaggtgtggtggcccttgcctgtaatcccagctacttggaaggctgaggcaggagaatcccttgaacccgggaggtggaggttgcagggagccaagatcatgccattgtactccagcctgggcaacagaacgagactccatctcaaaaaagaaaagaaaaaaaaaatcctgaggtacaagaatataatatgcacccaccttggtatcattttatttttaataggccttgccagagcttttcaattcatctaggaggaaaggacctttgtcttgtgcatgacagttggttggatctctgtgaaaatttttcagagctcctaagctttgaatttttagtcaagtgcttgcaacagctatttaaaaagacacaacctactaagcttgttctcctgataacatgtacttcagaactcatattcttgcagctggatttagatcccactctgaagtcagtacagagaagaggactgccacaaatgagaaagcttcatagtagcagagactatgtatccaataggcacaaattaattacagagaatggctaaaagactagaaggtttgtttttagaaatcatatctgatatttgattcacctttcaaaacacatagatcaacactgccattaaaaaaaccaatatactgaattaatacacataataagcaggttaatagggggttttttagggggttattcaccttagagaagtgttcttcgcttgaaataaaaaattccacagatttctgttaaacagtgagatgccctaataagttttaaaatatacaacagttcacacagtctctctagaacatattttatgtaaaatgaattacaccctctgccacctaattggattgcctaaacaatccgtatccttctgcagggttaaggtcagactaacacagtcttgggccagtcacacagtcttgaagacatatggcctatctctcttctttgtcacgagtctcaacaagctacttccatgtcaaaatgtatttgctgaccagtcttgcaggagagtgaggcgtttggatcatgtaatttttgtatcacgacaaaaataacccatcttagcctctggaagggatgtattgtatttgtttgttctcattctttaacttctagcttatttcagtgtgttttataaaacattgttttggaagaatggagagcctgggtaatccattgtatgacattgctttagagaaatatatgaaaatccagaacaattcagtatagaggactaaatgaactccagggctgaaatatggtcatatctgagtcctagctctgttttcagcagtccattggttgacaggttcctgaatagttttcttatttttgtttgtgaagaactaaggagaaaaagcaacactgtgttgacatattttgtggggccaacataaggtaaattaaaatatctatgaaatatctaggaatatagaaagtcttggtaaagaattcagtgtaaccatatgaggcaaaatagtcccaatgtgcatactcttaattccaatttgcatttctttagaaatcgttgctaattaacctgtgtatttttaagtcattttgtggcatggtatttcatgaagcccttttatttaagcactgcatttctttagtgctatggcttggattactgcagccatttcagcctattgcagacagaaatgaaaaatgaaaggaggcaaaacagttctctgagaaccaagcttgaaggagagtgctgaacacaaagtgtaattcatgtacagtcctaatttttgatagaatttatattcttccatgttaataaaacacatatagccaggccttttttttgtaaattgattccatagtgaaaaagaatcttgaaaagtggatttatttatttggccttgatttctgggcccgtattatcagaagcaatcccacatttcatgtttatggagctttacaatattcagagcttctttcaccctagatcatctcattgcatcctcatacaacaaccagtaagatcagcagaactggtagatttttttcaccattttacaaaaatcggtctaatagaatttaattgaaacacttaactatttgcagacaaaaagaccaggagtatgaggttcttgcctatgtcaggattattaggaatttctttatttttgcttaagtattgttttgcttttgttattctctattcttttcctccttttctccctccctccctccctgcttccctccctcaccctctcccccttttctctatacctcccctccttcccctttctctcatcctttccagttttgaaattgaatttacctctaggccactttcctcctttgatcgcctactttttctgctctcacaggcaagtttctgacttgcctgtatctactttaaaatagtcctctattcattggaaaatgtagtgccacatttaacccttttttggatttacacaagggagcttccaaagtttcttcatatattctatttttaatttatttgtttcactaggtatgtattgataatttactgtatgccagcccttatgttaggagctgccctcaagtatctaatagtccagcagatatttgagtgagcaatccatattctgtttatcgtgaattaataattttgcttagctacagtgcactgggtgagtattgattccctcttccccagtctctcccttcccatgctttgatctcagtaataatgaaattcattcacatcaaatataccctggaagagaacatcaaagccctaaatataataattagtcctggattttgaaatcactggtggaggggaagcctgtatagagaatataggtagttacattgtcacccctatgggcatgatttatgttttaagattctgttgtttcaagttttttaacagagttgaaaatctaattttaatctgcatattaatttcattaggctggggaataattgatgtacacaagtcaaacctgcttaaataacctaacttttaatctggaaaattaattatcatcggaacatggctcagaattagaagagtgacccttgctattggcagtaattgttcaattaattggaatgatcaggctactgaaaatgtgactggaagagaggagaagaagagagaggtgggaatatagaaggaaaaggtagattagttaaaataggtttataaaacctactgaaaagaggaaactgtgtttctaggttcattatgaaacattctttaaatgcctactcataatatctatcaactgtttttctttctgtgttctatggttcttgctttaaaaaatgttacatgtgaattaaacaaaatgtattgagacacattaatctataccaggatgtgtgcacttggcaacactgccatcacaggctttgttcgccaggctgaggacttagtgttcccattttatgtatggacaacttcagtaccctctgttgttctctccagatccaagggaatcagtgcagcccatgtaaaaaaaaaatatgtttttgagagaaatgtgttaaagggaaacatttacagtctgcatggcaatcctcaaagcctcccatcctgctgagatacggacacacatgaaacagtgccaccctatcagttgcactatagctgaaaatacaagagcagggtgaaaaaaaagtatgaaaaacctgttattaaggcctatgtttgccaaattacttatttgcatcaggaaggcatttagtcttggtgtgtatcttttggtattggagatgtgtttaagacgctgaaacaacataaatgttttacagatattttagctctcatcattttggtatggctactgaagatatagctacacaccatctgctgactgacatggtccttacttggctcaattcagggaagccatcatcacagcccactcgtctattaacctggctccagctccgggaggccaaagagatactacactctgtccatactttgccctcggtgccaggggcaagccaggccactattgcttcttctgactgtaacagagaataacaatttatattgctcccaagcctttgttcgggggaaaaaacgttttctggcacacctttgggtcttgcggttatttccatatattcaacataactggttgcactaatgcattctttacttgcctctctaaagtctgtgtggaggtcttaatatgccctgagaagggcagctgatcattaacatctgtggctgtaacaattccccaatatgttatacagatgtggtgtttagggttcaaatgttttattcttgtcagtgatatttcaacctccaaagaattatttcctccttaataatgtgagtacattggtaaaaaggagtattagattttgctcctggatccacctactctctgaatgtagattcctcattccttatccaaaatattatcattatactataatgatactaactgataagaattttttttttttattgagatggagtctcgctatgtcacccaggctggagtgcggtggtgcagtctcggctcactgcagcctctgcctcccaggttcaagtgattctcctgcctcagcctcctgagtagctgggactacaggtgcccaccaccatgcccggctaatttttttttgtatttttggtagagacagggtttcactgtgttagccaggatgctcttgatctcctgacctcaggatccgcctgcctcagcctcccaaagtgctgggattacaggcatgagccaccatgaatttcttaaataaaaggttcagtattcactgagaagaaccaaacattgaactgcaagagaaatagacatgattatacagaggaaagatattagagacagattgattatttcattaactaaaaagttgttatttttctgaaaaaacatagatatgccaaacatacatttcttttaagagaaatcaacacataaaaggtcagaagacttaaagcatcttttattttgtactcatgtcaagtaatttctcagtaactatgcagggaatgcatgacatctttttaactcattcatgcattaacgacaatagcagacatttatccagtgcctgttaaatccagaacacagtgattgctgcctttatttagtgcctctcatgtgtcaagagcgctatggtaccttcttccagggcactagtgagcatcttccagatcagtcaaagtaggttggttccttggcatacatctacttagtctcctctgaacagggatttcgtgggttgggacaaatccaatttctattattcatatgaatcactgcagagacataggggtgaaactgtatccttttggtggacctgcctgtgttgggtgacatgctcacatttttccacatttgataaaaatcaagcctcttctgcctactcaacactggataaaatgacagtgtcatacacagagaacagaacactcctttggttgcttcagcattctttttttggcctcatttttctccctctttactgagtttttgagtccaaatttagtggtgatgactaagaaattgccaggatgtgacagagcattcagttcattgagtccttccttgccatttttcaatagttgtaacaattgccaagattttctcctgatgttataggtgccacgttataggtgccagatactaaattacacttgcagaatctgtccatgcagtgacagcctcattttacatacagctgatttcatgatatggtattaaggaaaatccctgcagactttttactagttgataattctgagtcctagaatttccaatatttaaatctgaatctctgaaattcaaatcacataaacaataatcaagcggtctgccatgtgctaacgtgtcatttttgttgggggaaggtagattggggaaaaaataagacaagttccctaccatctggagctaatcatacagttgtatgagtcacagggccatgctagagatgtagatagagtttatgggagcacagataacaggtgtaatcagttctgattgggagagattatatgtgattctggaaacagtcatatttgagctaggccttggagggttagaggaaagccagtaggtagagaaacaaaggaatgacattctaagcaaaggaaatgaatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaaggaaatgtggagacttctagtcaaatttcttggtactttcttggctttctctatgttgagaaatcctacaaagaggagttttcacagcccataaatagaacattttggttcctaacatgtgacagttgccttagaagtacattgcttcttgagtaggttgaatttgtgtgaatcctctgaacatctatcgagtgtgcccctaggctgaaataaccccaaaagatacttcagttcgtgcattctgggagccagattgggaagatggggggagattaggcagattactgtgtgaaacactgtttgtagaatcccagaaaaaaggaaaggaaattgcttgagtgcttaaatttcagagaaaagctgccttgcctgaggaatatatccctctttgctgaagtgactgagagggcttcagatgttgctgctcagctagtgtgtattgcttaaaatggtatccaatatgaaaaataaaggaaggtagaaccatggagacattgtttttaaaagactagtgccccagaaagcttgcaatatttgtttgtatacatgtttttggtgatagtaccaagtgtttttcctgataacatctcagcaaattagcaaaaatctgatagtttaattggtgcctctatgacatgtagctcacttagcattttcctaataatcttccactccaagtaggccctttgctactctatggattacttatacattcaaatctactattcatttcatttagcttagaaattatcatttttaatggctgtttattgtacacatagacacgtgtacactcaaacacacaaaaggttttttgttgttgttggtttttttgtttgtttgtttgtttccttgaaatggtctattgagggcaggagcccttcatttgaaaaatccagtctaaagtaaaaatggccaaatgcatgacagaaaaccatattcctgagttcaaagtccactgggctgctctatcgtgtctgctagtaaaattgctgtaaattccttgcttttgtattgatttgcatgtaaatgttactgtaaggcaaggatggggtgaggggggaatttttctttctgtctcaagtcaaggtccaatgatccaaaaaaaatcaatttggtttacctaaaagtaaaaggtaggctttctttgtagcattcttttagaaatataggcagaaagcattgtaacacagatttcagcctgaggcaattgacaaccatagtgtataataactcaagaatccatgaaaattaagtacaaggaccgaatgtttattttctcatattgaaccctgaagggaacaaagctccatgtgtcagttttatgcttgtcttttcaatccttggctcttgtagttgtccaatatatttcacttatgtggcttgttctaatgttcccattacctattacaaagagagctaatcattgatcaatagcactttcacttatgactttttctaaagcatcatgtgaaatgttatatgtagtctgatggtttccaatgatgatagtttatgctattaaaatagagcaccagtcacacgagcttttacaaagtatgtcttaatctcctaaaaggcaataccacatgattctacaggaaattcatagctataaacactgaacttttgtttatttacttttgttgcaggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaaggtacatttgatattgtgggaactatggattatgctactaaatatacttatttatttattaaatttcaatagttttgggggtacaggtggtttttggttacatagacaagctatttagtggtgatttctgaaattttggtgcactcatcacccaagcagtatacactgtacccagtatgtagtgttttatccctcaccccactctcaaccttccccccaaccaagttcccaaagtccattatatcatgcttatgctttatgtcttcatagcttagctcccacttaagtgagaacatacaatatttggctttccattcctgagttacctcacttcgaataatggcgtccagctccatccaagttgctgcaaaagatatcatatcatttctttttatggctgagtagtattccatggtgtatatatataccacatttttttatccactcgttgattgatgggcacttaagttggttccatattttggccattgtgaattgcgctgctataaacatacctgtgcagttgtgtttttcatatgatgacttattttcctttcagtagctagccaggagtgagattgctggatccaatgctacttttagttctttaaggattctccatactgttttccatagtggttgtactgatttacattctcgccagcagtgtaaaagtgttccctttcaccacatccatgccaacatctgttgttttttgacattttaattatagccattcttgcagcagtaaggtggtatctcattgtggttttaatttgcatttccctgatgattagtgatgttgaacatttagaaatagtaatttaaagcagtccttaataatacttttgaaaatgaaacagttgttccacattaagacatttatttaaaaaacttacattttgtaacactcaaaaacatttgctctcctgattttaatttttccatagtgcatgtacatatagtgacactttacttatgtggaagtaacttacatgctaactcaggacagccaagatccccaaattatgctaaaatgttgcctgggcagaaacataggtgttaaaaatgtgtatacacagccgggcacggtggctcacgcctgtaatcccagcactttggggaggccgaggcgggcggatcacgaggtccggagaatggcgtgaacctgggaggcggagcttacagcgagctgagatcgtgccactggactccagcctgggcggcagagtgagactccgtttcaaaaaacaaaagaaaaaaaaaatgtgtgtacacttaacacttaccagaaagctccttgggtcctctctaagggcccaacatattatttcagcaaattttgcttatagttttcccatcattattagcagattaatagcaaattagaaagggtgagggacaagaataggctatggaagatagggaggtaagaaatagtgagatatggtagagaagagacagaaaatgcgggcaaagcagaggaagacttcaaagagattactagcctgaggtaagagtaggggtttagagtagaggcagacactgtgcaattcgaataagcacagcactgtgttttacagcacattttttggagccagactacctaaattcaaggcccaacttcactttttgctaactggatggtcttgaacaggttatttacctgtgtatgcctcaagttcatctgtataatatggataagagtacttataagattctcatagggactaaatgggataatgcatgcaaagaacttagagtagtatctaatgttatgtgttccataactataagctattatgtttatttatagcacaataataaattttaccatttactgtaccaagaattatccaatacttagactcttgaagtgtttcattttaaagtatgatagaaatcagtgttttaaaatattttaaattttaatatttgccttgtacagtatgctatagatcatatttaaacttctaagaggtttattaaatgcattttttattaatcctctcttacataaccatatgtggttgaagttaggcattaaaattctttacacactactacaccaaggctagatttttgcttaatctgaacctgtccactctctactgagtccttgaaagcagtgtttttcatgtctggcttaaggcacagaagcctagtaaccaaaagaaaagttgaggaccagtgtggtaggcccatttttttaatgtattttttttctctttttccttttctgaatttaatttataattgacacaaaaattgtatatatttattatgaacaaggtattttgaaatatgtatacattgtggaatagctaaatcaagctaattaacatatgcattacctcacatacttatcatttaggtgtgtggaatagaacacctacaaactattcttagaaattttcacaattggtatgcccatttgaaggccttttacaccatctttgtgtgcttttcagtggccatgtacaaggagccatcactgcacga

SEQ ID NO: 5903 - DNA, 572052 bp, human; identical to SEQ ID NO: 5902

SEQ ID NO: 5904 - DNA, 513925 bp, human
gtgctttggctcagatgcagactattgcaaaccgcagaaactcacagtgacgacatgaccaagaagcttcctacccctggcctgggagcaagtgaccgtgggcgctaataacaacagggccctttaagattttggtccatggtgggatcttgcttgtttctcaccaccaggcccattgcgtctccacttctaaggtaggtgaaaccaaactcattgggaaaatgctacgggaattggtatcctcttaggtaacccaggcccaggtttccttggcctagggtggggagacaaatgtctgggcaggacatggcctacaaataaaaatacaactccatgctcccaacacactgatcaaggcacagtaatgtttgggaattaattcctttccttgtaccctctcacccaaaagctaaggaattagctaaaaagaaagcacctcaatgttaaatttaaccctttatcaactactctacctggagctgctctattctaggtgccttgtccttcctgactcattactgtgtgaatgtgaatttggatcagagcactggttatctgtgttttccttgtctgctgtgcagtagtggagagtaatatagagctgcacagggcaggaattcctatagttcagacagaccttgtgaaagagagactccgacccaggtacacaaaagacttgcttggattccatttccttcctgaaatattgctgtcagaactcatctctgatttctggcctgtttatagcagtgggcattagggaaggagttggaattgaaggggagctagaaacttctgggggtgaggttagacaccctctgagaggaaaagaagcaagcttggctgttggaaggttaaacactagcaatttcttgctcaaagttgacttttgagcatttgctaacaaattactatgccaacattccaactagccaaactgaggtgttttcatgaaaatgaagagacactttagtaacagatatactttacttaaaggaaaatgacaatcttaaaatatcacatggctttaggaaacaaaccttcagcctcagaatcatctgtgtctgtgcattttttagaaagatgaattagactgatccttgaacttcgtttcccctgcccacttttttccttttgcccatcttcaaggtagatggtgtgcaaataacacaaacttaaaatcttaaagctagaagaaatcttggaagtcatatagtctaatccttattggagcttgagttgagatgagtgaccatctggtttctacctatattggtgcctcaatttcccctgcaacctcaaaagggctacctggtagatatgtccatcctgaagccatgctctatcagcatcacatcctactagcactatctcttttccaatattaccttacggtcattcattttgctataaatctagaggaaacttaaatattttgaattatttttcccatgttctatttgtacaaccatatatcatcactaataccggcattaaattgttttgtcacatgttatggaaagttgtcaggggttttacatttaaattgggtgtttatttaatagaaacactccaaagaaagtgacttctttttcttctgctgaacaaagagatttgcaggaggttgcctctgaatagtctacttgcttagtactttgcatagtgactccactaataaaatttctacatacaaacaactttttaggaatgcatttgtcagtaaaggagtggttcccaaactccattttatgaaccaatgccaggctggctatccaggaatcacctaacaaggttgtttaaagatgtcatttctgatccacatccctggaaattctgattcagaaagtctggggtggagccccagaagctagacttagcaggaatcattctgaggcatggctaagtttgggaagcactgtgaaagtctaggctgtcatatttttgttttgtctcatatctcttaattttttttccctttgggataaagttcaaattctttaactcagcatcccccaagccctccatgatctagccctaacctatctttcaaatcttattcctcattgttcctcttcaccacttccaacactcatggtcgaattgaactggccactgtcttctattttgcttttatgcctggaaactttactcatgctattgcccttgactacgtgtccttccccacttctctgcacacccaaatctaccccatttctcatggtctatactatagggtgcataagattgatgtggaaggcttctttaaaatgccaactcctgggtttcacttctggggtttctgattcagtagatctggagctcttaagaacctcagagaatctgatgctgaccacgcattcagaaacactgcatttagctcaaatgccatctctttacaaaaccatttctggaaatgtttgcccttccctactacaactcttatagtattttgtttgtagctctatgatttaacacttcgctctttaccttgtatttgatttattcatgtatgtcatcattttcctcactcaacacatatttattggatatcaaaggcatatctttccttcaagaacttaaactctttgagataggagatctctgcttatttgtcgctgtaaacttaggcatgaatctggtctgtgtcaatgggggtggtaaagtttaaatctctttgctgtagatgggagggaggatagaacctgtcccaagatgagactttattttcccaaggagatgtgtacatgaggcaggtcttttccctgtctgcatgtcccagatctgagatttatgcacaagagtaggatctcagaagccttctgcagttgggcagtctcagagcacagtgatgactggattccagggagtctcttggcttagataggatgggaagcacctggcacttctaaatacagtagttctgccctatgcggatccctcccaccataagggagggatcagcacagtatcaaggggtacagaggaggggcaagagatatttggtgatgaggatctggatggacttaccttgggacaggcttcccttctttgtctcacctgaagcaggaattgcaagttctttgaaattgtttttgaaatgctgaggctcctgaattatttttaatatactttacatataatatatatgtaataatccatactaccagctgagtattatatttccatattgccagtctcatataattatataaaacatgtgtatatatatatatatatatatatatacacatatgcccatgcctgtcttttactatagattattttacagaaattatgtcatgttactcacacatttttgtatcttactcttcttgtcttttactagttatgtggccttagattctctgagcttcagtttcctcatcgagaaaatgaggattataatagaacctatatcatagagttgttgtgagcagtcaactagttaaaatatgtaaagcacttaaaagagtaccatatatgaatgtttgctattatcatcgttactattactcccattcaataaaacctacaagtcaacagcaatctcactatttcattctttttaatggctgcacagcattttgtgatatagatggagaataatttattcaaccattccacttttagtggacattcactttatttccaattcatattttaccactaaaaagcaacatagcaataaacacatttatatatatatatacccttacatgctgttggttttttcagtctgaaacaggttcccaggaatgaaatagctgggttgaagggtatatgcatattgtttttaatttcatcaaatgttgacttattgctttttaaaaagcatataacatatttacaagtctactagtaatttatgagagtacaaatttcccccttgcaaccccaccaacagtttatcttactgctctttttaaattttgtaagtcttatggataaaaataagtcatctcattgttacattaacttaagtttctctgtttacttatgagtctgagtatcttttgaaaaaaatcattggccatttgaatttgcttctctatgaagtggttcttcccactgtttgcctgttttttgaataggttgtttttctttgtcaattgttaagaggtcctataaacccctcatctgttctctgggtgcgactatgtttccaattccttgtttacctgttgatttaattattatgtcttctgccaaaattttgaagaattgtatatagtcaaatatcttaaggtctctccatttctagattgtgcatgttgttccctagattttcttgcaggacttttactgtttttacattaaaatatgtatttatctggaaactatattgcttttaggtataaaatagaggtccaactttattttaagttaatagccagctgcatccacactgttcattaacaatccatctcttccccactgaaatgaaacatcacctttgtcatgtattaaatgcttatatatgctttccaattttgcattatctattttgtttctttgatctaattgtctattactcccatgccactgccatgttttgatttaattacattgactttagagtatattctggtatctggttaagatatttctctctcattattattatttttcattacttttctagggtatttattcttttatataagtattaagattatattgtataaatgccctctttttttcccctaaaaaaccacactggcaattttcaactggaatttaaaaaataatattgactttgggagaattgaggtcttatgatataaagttttattattcattcgttcattccttattttcagatttcgttttacatccttcaataaggtagagcaattttcttcatactggtctgatgcttttcttgttaaattcagtccagtgtattacacaggttattttcattattgtgaatataacgtttctcatttctatttcttggtgtttgttgtctgaatagagatacactatttgttttatagtaaccttgtattcctttatggtaccacattctttgaataagtctcatagattttactagagtgtttcgttttctagctatacaaatataccattagcagacaaagaaatagatagcatttctgatgtttgtattcatttattttttggtctttttattaactagaccatccaaggcaatgttgaataataaacaaagataagaggcattcttgtcttgttctgaattttatttgaacaggtcagtgctttgccatttgggattatatttcacatccatttttggtaaactgtactattttaaaaggttttattttaatcttatttaacttagaaatttattaggaaggtagctgaattttattaattgacttttaagcctttcttgatatcatcactcatatggttttcctctttaagttattgatgtaattaattatgttgatagatttactgatactgaacctcctttgcatttccaaattcaattctatatgtcagttagtaatatctatgaaacaaaccagccaaaatctcagtggctttaaaaacaacaatcatttgttactgcttgtgtgtcttcaggttaactggggtctggctgatccagtttgggttgagctgagtggctctgattgtcactgtaggtctgttggtctgttggagctgctttacttcaggctgtagtggcaagtgcagctctgccctaagtaactcttatcctcctgacaaggcaagtaggctagccaggctagtctcgaggtgactgcagagacacaggagggaaggagaaaatgcacaaggtttcttaaggcctagcctgggaagtggcatttggctgatttcaaagttaagggacagggaaatgtacaccatgtaaaaatacctggacacagggaggagtgaagaactggaaccaatactgtaatccaccacactctagttggttataattatactttattgaaagattgtggccgggtgcggtggctcacgcctgtggtcccagcgctttgggaggctgaggcgggcggatcacgaggtcaggagatcgagaccatcctggctaacacggtgaaaccccgtctctactaaaaataaaaaaaaagaaatagtcgggcgtagtggcgggcgcctgtggtcccagccgctcaggaggctgaggcaggagaatggcgtgaacctgggaggtggagcttgcagtgagccgagatcgcgccactgaactccagcctgggcgacagagcgagactccgtctccaaaaaaaaaaaaaagaaagactgctgaattgtatttgctaatgttttattcaaaatgtcaacatttacacccaagaattagtgtctatagatttcttttttgtggtcttccttctaggtttggatattaaatttaggttggctttataaaaaagaattaaggggctttattttttatggcctataagaatttaaatgacagtaaaattacttgttttaaaagaaaaaagttgaatcggagcaaatgattctctgctatgatgactgtttcagtggtagatgtttattcacgatttaattcttttatttgataattgacctattcaatttttattcttgtggggttaatttggctttctaaaaaatcatcctttttctctaggttttcaaatgtgttgttacagagtttaatgtactttcttatataattatttaaaattgtctcatctgtggttatgtctgttttttcatttcaagtcttgtaaatatttattatttttttcttaattagacttgcaagatgattatctgttttatttctcaaagaacaatttttggctatttcattaattccagcttttatgttatcaaagcctttcctagttctttttagttttatttgtggttcttttccaaatattttaagatgaattttaagctcatttaccttctcacctttgtttattaatactgaaaacatttaagaatagaattttttctcactcataagtgggagttgaacaatgagaacacatggacacagagaggggaacatcacacaccggggcctgtcggtggtgtggggaaaggggagggagagcattaggacaaatacctaatgcatgtggggcttaaaacctagatgacgggttgataggtgcagcaaaccaccatggcacatgtatacctatgtgacaaacctgtacgttcaccacatgtatcccataacttaaagtaaaaaaaaaaaaaaaaaaaaaaaaggaatttttttctgagtacaacattctttgcgccacataggttttggaataaaatgttctttttaattgctgtttacatagtttataatttcacttttgaatcaatggtgttctaggagtgtattttgtaatttcctctttttcttttctattttattttagattcagtgagtatatgtgcaggtttgttacatgggtaaattgcattcactgaggcttgttgtaagaatgattctgctaccaaggtagtgagcatactatctgacaggtagcttcccaactcatgttcccatctttgtgtccacatgtatttaatgtttagcgcccacttataagtcagaacttatggtatttggttttatgtttctgcattagttcacttaggataatggcctccagctgcatccatgttgctgcaaagaacatgacttcattattttttatggcggtattatattccatagtgtataggtaccccattttctgtatccagtctgctgttgataggcatttaggttgattccatgtctttgctattgtgaataaagctgcagtgaacatacaagagcatgtgtctttttggtagactgattcattttcctttgggtatatactccaaacagttattttttgcatattttaaattattcatttaaattttataattgttatgctcagaaaagctattttccattatctttgaccaaaaaaaaaaatcacagattttcctatatttcttctcttttctccttctaggagacttattatttttcaggatctatcctcaaaggttcttatgtttctcttcatcatttcattgtctttatatttttgactttgtgctttgtgatacttcttccactttatcttccaggccactgttttgggtctcagcaataatcctcttcgtcttaagtgcatctactgaactgtttatttgggaaatcacatttttgtttgcagttctagaaagtctatttttatgctgtgcatgtatctccttatatgctcctattttgttatcgttattggtagtgatggttttcaagttgtcacttgtctctcctcacatcagtttaattttttttaggtatacattgctcaatttacctctctctggttggtgattgctgaacccacagaaatggttataaagcattttgttgtcagcacattgaggtcagctcatattagaaggggagctccccaaggggttgtaagccattgagtagtgggatactagaaactagtacctggagaaagctgctgtcttcccaggtctacactgaccctgtctgttcctttagttcattccttcttggcctcttgaaggtctaggagaccaggaacacaagtataatgttgttttcccaatctcctagtctgtttgtgctgggcctttctagtgctggatccaggctttgctcaaggggcaaagcctgataacacttatttttattaagtcttctgcaacgtctaggaccctactcatatccagttcttctccttaggcttcaatagccattaggttgaggagaagcaggaagcctggagctgacaatgggaaacaacacatgcttagttggtatcttcccagagccctctgtggtttctaaagaagaagaaaaaaggccttttaatggattttagttacattacttcctagggcgtcactttataataacacagaactagtggtgaaattcagggtgggtacctgcatcagtttgggtacagtcatgaaaatagagccactaaaatgttaacaatgataaggaatttaatatattttagaaactggattcataaaaagtgggagctagagagtgaaagtctggaagattcatgctggaggatcacacaaatgtctctaatgactttaacttgaaacactggaggaggtgaggaaacaaaagctcacaggaattctgagaagtcaccaggtctagttgcataaggctaatcggaagtggacgtcatagagagatctgtgaagccacactatctgactgtcacagcctcctgagaacaatgacttctgcttcactcccacattccaagccttgagtgagtttctctcagtggcaaagtctaacttggaaccatataaggaaagagcttctgaaaacctacttcccagccttaaccagaagtggtccctgagttgacatcggacaatccagcacagtaccccagaagaaagaacaaagactagcagtgtaggattatgagtgtggctaaggaagcctctgagaggactcctctgtccttagtcacagtgccatagctttcttgattggtgtgctttgatgtggttctcagaaatgtcctcttcactaccaaaaaagacagagcatcactcagtatccatggattctttcagaatcctctggcccatgccaaccgcagccttcttgacaacgtcagcatctgatatgcaaaaagtattggattttgcaacagaaagacctgggttcaaatactgctagtgctattccatagatatgggaacctgagctggtaattaccctttccaagctcttttcattacttgtaaatcaaggctgacactgtgtaatactgagaaaaggtacaaggacgaaatgacagtttatataaagcacgatatattaattacctcatttattttgggtcattagtcttgctgccttgacaatgcttctggtgtatgcctaaaacaaaggaaaatgatgctgttgtttcttttcttttatagtaagtggggaccctccagggagattctcttgtgctgtccaagcaacagtaaggctcctattattgatctgagttgcctccccaaagcagacaacagtgattccttaccttgcaggctgggtgatgtagggagggaaaaggccttatagaatagagtggaataaatacagaaaaaaatgtaataagaaacaatcatgcaagatcctcatagtgggagaggggatgagaacatggaaagggaaatagcagcagagactgcactgggagaagtagaatggggaagaataaagaatcccacacgtgggatactgagaagagtacatgagtagggaggtcccttagagaagaccacagttagctacagtatggcaggtacagttatgacaacagtgtaatgggtaaagtcacttcagccatgtgccagacacatccattctacaccatgtaaaatcataccaagtaggttacagtttcaagtgaaggaaagtataggtctaagtgtctcatcatgagaaacccagcttgttatttcttgaccatctgtgagtcacttctctttctctaaaatgtaacagttgtatacagtaccagctgtgtataagggctcttcacatgtcccaacccctagcactccaaagaaggctccaagaagctacccaagaagacaaaggatcagaagcaaaacgactggcaatgcagtgaagatcatttaaactatcagaggaagaggaagattcccagaatctttctttaccaaaatcgtgggcaataagacagggttggagagaaacagagagagaaggtgtcacagatgggaatgtctgaaagcagatggagtttgtggtggaagatgttttcattagggatcaacaactgtgaaaggaagtgggaggaggctgagttgggcagagggagaagttgaactgtgaagcaggactaacgaagccttagcctacccggcagggagctctggagtgagtattgtctgtcagagtgcctgtgttgatctaaaatggccaggctttgctcattcatggaatgtgggctgacctaggaagggaatgacctcaagtgaagcagttccgcagcagagacaaaccgtgagggagctgacagctggaggctgcctagcgactgcactccccatagctgggcagcaagcctttcttgggaggagaatctggacagcactcctttatgtctatcacactgtgggggtggggggtagcgggatgtggggaggggcaagggtcaggcattgacagaaaacaaagaaagaaaacaaaggcactgacagaaaacaaaggagagcccagtaagccctgagatctcttctctttctctaatgtttgactttatcttcagagaaattttagaggtattttttatttcataatattaacaaaatattcagtgtcatattgtggaaagagcagggactttggaagcagaaggacctacctgcatctcaatcctgcctgggtgcacctcttactagctgtataatcttggatatgttgcttcacctctctgagcttgtttcctcatctggaaaatggagataataataaccattaactcagagggttgctttcagtataaagtgccatattctggataaatatgtagtacatactagtatattaagcaaataacattataatgatgaggatatttattgtgcctcttacgtgccaggcactatgttataccacaggttgggcatgggacaagttaatcttagaggagtttcacacagtccttttcttctacgaatttacaatcttgttgagagaattcaagatataggcaaatatgaagggctaacaacttactactatatccaataatttttttgtgaaataaaattttctctcccgaactgttttattttaccattgtcagtatgactgctagaatgaaggcaagaacaagacctgaaaatcttctggaaactgacccaggccaaagtcttttgtgtgttacttcctgggagagacaatggcaaggtcctcagtttcagatgtagtgaatgttgggagcatgctatgaggaaaaggctaactttgattacccattcctctttgacacaggtgattctgaatgctgtggaatgatagggattctgggtgaagatccagggctgcccggtgatattggttgggaatgagatggaatctttggaaaagctgtagctcattgtttccttcttcactggagaagaaagtgacaaacatttaaagatgttcattcctgacaggcatcccaacatcgcattataatggcccaaatgtcaattttacaggaggcagaaaatcacacatctgcttcgtgtagattggaagggtcttagtgttaagctgttttgggatgcatcattgacatcgctctgtcttgtaactttctctcactttaaaacccattctggtttgtaacagacaaacatagggaacagagaagacttgatctgaaaatctttctggactactcatttcagttatccattgctgcgtaacaaagcactcccaaactgagtggcctaaaacaaccaccaatttgctcacaagtctgtgggttggaaatggggacagggtggagcaggaatggctttttggtttcccatgaaatctggaggctcacagcttgaatggctaggagctgactgagatggcttaattggtgcgatatgtctggagcctcggttcttgccatcagctgagttgttcagttccctttcacatggactcttcatatggccagctcgggcttccttacaacttgagtctcagggtgtctgacttcttacatggtgtctggcttccccttgagggaactgcatctgccaagtttcttaaaggtgaggactgaagctggcataggatcactttagccacattacaagtcacaaggacagcctggattcaagggtgagggaaatagacattagctctgcaaggtggagaggcatataaatatatataggattaggagaacttgttggtcacgactccagtaactattgctgcatagcatattaccctaaaatttagtagctaaaaacaaattagaaattaaagacatttaattttgttcacaattttatgggttaggaatgtgaggaggactccactgagtagttctccactgagggatctctcataaagctgcagtcacatgtcagctggggctgcagttatctcgtggtatgattggacttgacatccaagacagatctctccctttgccggccagcaatgctggctgtcgtctgggagctcagctagcatggttgactggtgagcctaaatgtgaactctctagtatggcagcctcagtgtggacaaacttcatacatggtagctggcttttcccggagcaaacattccaaagagtgccaggcagaagctacgtggcctcttctcacttagcctaaaagtaacagagtaacacttctaccatactgtatgggctgaagcagttacaaacccagtcagtatcaagaagggaggacatagtggccacctttcaatggccacattttaaaactgctacagtggccaagagttggggagcggcagattatgttttccaggtcttttgttgtagaaatccaccaactcattggagattccaatagaaatgaaccttaaatcatgatatagataaacactgcagggtttgaatcagaaatgaatgcctttcagagctctggcatttggatctgaacgttcaaattgttgagacttaagcgtaaaaattaaagtggcttccaactcccagatcttggcccagtgggcttttctttatctcaagcactctggctggaagtgtagcttttgccaggctgcctccttttgaaccagctttctgctgtgaaatgttttcacaaatgaaaaacatgtttcatccagtgagaagcagtcttgtcactaaaacatctaatttggtggtgcctgatgacaatgtctctacacccaggtagtccaaaactgccagaaaaaaaagccctaagtgtatgtgtcctctgccctcctgctcactccaactttacccgttagcacagacaagggaaccatgtggtctcttgcccagaaacattgctcagagctgctgtaggatgagcaaacctggaatccagagtctggtgtcttgaggcatttgtagactagcaggaaactgacactgagataatagggccaagagggtgagcctccttaggaccttttccacttcactaccaagtagtgaagcctctgtcctttattccagaaagcagcccagccctatttagaggcgtggccatgcaacattttgttttagaatattgctttaattccaggactaattcactctactacacagaataactctgcaccccatactctaccgggtcaatggaatttctctcataagagcagcagagacaggatgggacacattttaccaaagtgacaaggcacagagaggtgaagtgaccagttaagtgcaaattgctacactgaaaactgaacgtacttccactacagtgggatgagggagatggatctgtgtgggaaaggctgggtgggaaaggggaagtactataagctcagccaggtcttccttgagatgcttgaagactgagtccctttggtggcaggaaaagacctacggaccatcctcacacagatgtcagatcttccagctgaccatcctgcattaccaagtagcttgggggctggacactggaccatgcctttttctgagtcaattgcaacaacacttttttcatactaaatttgtcatggggctttgaagagagaaagtcccccattcctttcacagaacaagctgccagtgacctctttagcagaatcttcagaagcttggtttagataagaatgtttgtccctgcacttgactattcataatccttggtctctgacatgagtgtccttatgatgtcattgatttgtctctgtatggacacaaaccaccatactgttcttgcatgaagtgtgtatttcctttatcttctgatatttcctttccaaggtggtttacagtgaagcaaaacactgtattttacctgtttgtgttcatggacagacagactccactaattttccaaagcagacatctcaactcaccttgatcatattaactaacctaggtttagtcatatattgaagattagtctcctttaaggaacagaatgatatctagcttccagttggaagttacccttgctagaggtgtcattgttgatagggcttagagaggggtcttatctgtggagagaactttcctggaaatcttaacgtggcaggaaagctgagacacccagtgtccacatcaatgccatgcttgatatcttccaagacagaaactgacccttttcccaaaataaggtattgttgcttactggagggatgtggacaaattaaatggtatgtacacaacggaggagtatgtgtgtgtatgcttttgattgaatgtgctgagctagggaagttttaaaagacctaggagtttagaattggcagacaggaccagtgaaaatgtgcctcccacctctctttaagaggctgctaggagttttgagagaccacgtggtataacagatgatcactggttttagagacagacccacctggcatcctagcctgctgcccatctttgtgatccatgctgcaccatgtaccagctgtgtgacctcctggcaagttactttacctctctgagcttcattttcctcatttgtgaaacgaaaataacaaaaccaacacgtccttggggttgttgtgaagatggaataagataatgatgtaaaagcatttagcatgctgcttggcacaggttaggtgctaaattgatgtttactgttttggggtataaattgttattatttaaaaaatgttgacttttattttagattcaggaagtgcatgtgcaggttcatcacatgggtatactgcataatgctgagatttggggtaggactccccttcccctcgacctttcctctaaacccatctaaacctccaacccttttgaattcgatcatttgaagagaaatgttttccttcccagacaactgatatgaactaatggtctaacattggcttggataatcacatcgtgtcatcaagcctcagattattagatattatttacaagaaaaatgggcctggagttcctctcagactgaggatggaggctgcaaattgagtttagagggttgccgacctttagacctggactgggagcaggggcagcccacactcctggtcttgaaagccacagcaggctcttgtaattgagttaccgcctgggatgcagtaagactaatccatctatatgatttcttcgcctggtttaatgccattaacaaaaccgaattaagaagggggtggagctgagtaggacgagggaaaacgaattttctgcatgggagtcgctaccgcgccttcatggccaggatgaagcctaaggtctgattaatggactgttctgaggaccaagtcctgctagtcaccaccccagtccctcaacagagcgcgaggctaccagggactcgcatgcacaaaaaaaaggccatcgcagaaaaggttttccaggacgccccaggggctatttcctgactactatctcaccctccttccctagttcgttcattttcttcccttcccttcccttcccttcccttccctccctcccttccttccttttctctccctttttcttttccttctttctctttctttttctttatttctctttctttctttctttctttctttctttttctttctttctttctctcttctttccctccctccctccttctctcttttctttctttctttctttctttctttctttctttctttctttctttctttctctctctctcttcctttctttctttctttctctctttctctctctctctttctctctctctctctctctctctttccttcctcatctgccctctgtagaacaattcttgagcagttttccttctagttctaatcttcagggaccttctctgggttttgtcacaagtattcctcaggcaacgtttcaatcctacttattcctcttcagcactcgcccccagtcccacctcacccgtttgcctgggattggccatcctgggcggtgggcactctttgcttccagtttaccaacaagagcgaccagccctaggaggaggggcctgcgtgtgggggtgggggtgggaggtggcagccgccgcggtcagtttcactctctgacctactgacacccagatcccagagagcccttctctccccactgagagccggactgtctcaacttgagcagctagccagaagcgaaaagtcgtcgactcccggactgagattccactgctcggtgcgagcagttgccaacaggggagtccccaaagtgtaggtggcgaccagcacgggcctgggaaagcaggcgctaggagtagaggagttacaggggccggggtggggggagcgccggccttccatctccttggccaacggtgggagcccgctacagtggcacccgcgggccctccctgccccggaggggccagggtacgcccagcagacacgctcgcccgcactacgcggggctcgccggggttttgccaaccggcggctgacgtcggcgcgcccctgccgagctctccttttactacagcgggcaggcggctttgtgaggccccgccttcgccagcccccaccctccgcgtgcccacaccttgccgtttatatagaatgcgccgcggtgttgattcgtggctctctaggaccggagagttctttggaaggagagcgcgagcgagggagcgggcgagctccgagggggtgtgggtgtagggagagagagaaagagagcaggtaagggccatcgtctcccactcctccgccggcgagcaactccggccccctttttggcaaaataataggaacctggaaatggattaaatagaaagaaagaaaagaggcgaccctctcctccccattccccgcgggcgagaagctgcgcgactctgcggtgtaacaggctcacacgttgctcatcacatgttcaaacatttccctttcagggaggcttgttatttttaagtgaatatttttatctttgttttgattttttaaaaagccttcctcggggttttattttgatcgagttggcggcccgcagcggattgggagaggcgggggaaagcagcctgccagtgcgcgggcagcccacccaggcaactcccagcgagcggcccgcgcggagcccagggaggccggcagtgaagccggggagtcccggccgctcctctcggccgccccgggggttgcgagcgtggctctccgcaggcgggcagaagctgagggcgcggggcgcggaggaagcgccgcgccgctttgtctcttcacttcttgagcgcggcgagcggctcctcccgcggccggccgctcgggatcgcggcggcggcggcggcgacggcggctcctccttcacccctttcctttcctccccactctctcgtaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggtaagcccgcccgccgagtccgcctgctttcctttccttcgtttccctcgccccctcgcgtgcgcgccgccctccggcggctccttgcctccttcccggagcctaagctgcccatgacctctgcgaccccgggagaaaagggggggcagaggtcgctagggggtggatctaggtttgcaccactttccctccttcctcgcggaattgtcgaccctcgagtgcctccagcctcctccacttcccctctggacgcacggtggtggcgctgcgggcagacgaagctgctgcagcctggagcgccgggaaccgcgctgtctgctgacagccggccgcctgtctgtatgagtgcatgtgtgtgcgtgtgcgcgagtgtgcatatgtgtgctgcgcgcgtgcaacatggtgacatactcaggaatctgccctgctgtcagaacccaagcttgaacccaccttcagccccctctccccgcccccaatgcaaacaaagagcctggtcgagacgcagaacccctcccccctcctttcccaccacctccttccccccccccgccacccgacacctcctaatcctaaactccttatccaccccaaccctccgggaaggcaggagtttgcacccttcgacacgccgcgtgcaaaggtgagcaaccctggtgccctggcgccgcccgcgctgcgctttggcagcgcagcctcgccaagccccaggagaacaaaggctgatgtccccttgtcactagtgcccagcgtgagtgggcctccgcgggagggggcagtcctcttcctctgtttgctggggttcagccaccgcgcccggggcacccgaccactggtccccctggagtgcgcgcctctgcccagggcctcccatcggcgggttggggaggcgcagcaaagcggtgctcaggctggggagaactaaggcaaaggcaggggacgcccccccaccctttgccggttctagccgttgcctttctcaggaccgggattagctccagaatgtaaactggagacagcagccttggagaccggggtgcggagaggcacagagagggaatatggaagagcagtggggaacagcaggtgccttaggtgcaagtgtccgaatggccacggagcagacgctggagtgggctggactagccctgagggccccaagcacactggaccgcagcgacccacgccgagtccccactgcagaagtgaggttgcagcgcagggagtcccagcttttgttcatgggggccccagttccttcctgagccctcaggcccccttcactcccactcctttctctattccttgttctcctctcctccttctcgcctctccccatctctcagagctttctttcccgggagattctagggcagcaccagccctcccccgcggaaagttgtcaaagtcttcagctcaaggcctttatccttgtttctaagtggagccatttctcccccaaataggcgaaagggtgactgaaggttccggaagtttgtggaggggttagatccgttgtcatacgggtcattgttgcccccggtctggctcaaggctagcattcaatcccaagtgaaagagtaactttggaaagtagaacgacagctgtaggtttccagagctcccctaattgttgagtctcaaacaggcatttatatgataaaggaaaatgacttcagggtcattaaatcgttttgttttccactgagggcccagagaagtaaatgtaattaaagaatgtagcaccagattgatctaggcacgtcattcccctgttgaatctgggagtatttctcgtttgtttctggaactttggttcctgatttccatcaggtggttacttcaggtttatttcaggctaccgttgggagaccctgaaaccaaattcattcacagaaaatgagtttctgttctgtttataatttgcagttgtccagaatggattaacgcatctggaaacaggacaggtttctgtaattcaataatacaaatttgtactaggcatgtgtcataacattttcttgtgttgactcaccacatttgaaaccacatacctctgtaggaattgagtaattagcacttgaaattatggctgtaattagaataaattaattttacaaggcaacttttaagaagggagtttacttccccgagaagatgggaagcttttggctgctaagagcaagattgccatttcagcctttctgttcgttgttgaatttagagcattttcaaaatattaagtgtgtagtagccattagtattttcttctttcaagtatatgaaaagtcttatgtgaccaaattttaaagactactttttatattagagatgaaaggtacaaggtctacttatcttttaatcaatagagtttatatatgttgaccatatttctgaagagttttccttacttacaaatttcctatatataggtcatctttaatttttttaagctgaaaaactaattggcatattctttgtaacatagcaagatataggatcaagcatttcatagataccttgaatatacacacatttaattttgaacaatggtgtgacagatgattggatgaaatcaaataatttagtaacagtttgaatgaatttcataatctgttttcagagtctactgctcatttaaattcagcctcccacccccatcagttagggctcatacccacagtgtatcataactacatcaattattatagagtacagtgtttccagagcttttaaagcacaggtagtaggtttccagtaaattattttgtgctgctgaatgaaatatggccttaagagtacataaattgctgattgtctttttaaatgacattttcttcaactcactgaggttaagaccagtgatggacactgatctttttcataaccttttcaaaaatgtagccagacaagataggctgttctgtttggaaagggggcggggaccttgattctgtttgaaactattaaaaaggcctcttgtgcagccagtcgccttttgtgtatttatttatgctttgtataaactttaaaattggcagatgtgtatatagtttgagtcacgcggctcttggaccggaggatctgtttccatttcagggaagaagaaagcataatatttgtttgttcaagcagatattctcttagctttgactcactcttctctaccttgtcacataagatcttttcagcagtcttctgttggaaaagcactcagttaaggctgtttctggtttgttgcaacagttttcctgtggcatcggaaatcttgtaggctgctatagataaaaccaaatcttttttggattaagtaaaaatgctagctaattctcgctttcaaaactgtctttaggtttgtggctacatgtttggagttgggtgtgttcttttcaacaaccctttcctttgtgcttagcttaacagccaccatatccaggcaagtttcaaggctctgtgggctgtgggttctcttggtgagacagcactgttgtcaggctgggctcatgctggctgctggacaatggaggacaattccatgcatagcccaagaagccagccacttgtacagctgctgttgtaatgggtagtagtggccccatgcatttacaccacagttcgttttttgttcacttcctggccctttccaatagtctttctatcctatcctactgaagaaggacaggtcactgtggtcatgcagccagcatatctaggcttgagtcctgaatgccttccaaaagatcatcttgatcattgtggtttactataataggtttcatcaagtgtctttctcagacttgggccaggcaaaagcagatgtttagaggtattttaccgacaagaaattatgaggttggtgacctcttattaagaagtaacagtgatcatctgtctattactcatgtagggacttgtttttttcactctgacatcatggtcccatggttttacatacagtgtcataagccacacggtcttttctgtgctgaaggaggtgatcatagccttgctaaggaggtgtgaccagggagatctctaatcagaaatattggtctgttcttggggataggtggagaaaatgagtgcacattatacccaaatcctcttcataattatttgtagcagcgtgtagcttctttattgacaaaggctaaagctagaagggggagcaagttgaggcatgggttaggggtactgtatcttttctctagcttagtactgcttcctctaagcctcttttcagcacagttcaaataatttaaagggcttagtatgtgtcctaggtctggagatgtgggtgaggttggagtgggaatggatgttgaattggggcctgggtaagaagcagagggtgagctgtggggcgaaggaaggagttgaggtctatgcccacagcagggagattttatgggtggctttgaggacagggtcaggactggggagagaattggaatcagggagagaatttgaatcagaattggataagccagagggctgatttgtaaggcggtaagtaaggatatgaaacagcgttccaggtctctttgcagctgtgctgttttatgtccaaatcaacttcttattctgggaattacaatcaacatagaacaaccagaatgtgttgcagttcttcaaatatatccaataaaaaggctttctagtgtctgcttcagtatgacttatatttttggagttgagaaatttgaaaagaatggacaataattgtcaagattaagcaattgaaggaggggggaaaaaccatgtgcattagagtagatgaaggggatcctacatgtctattaccttgctcagctaaacattatctttgaaatgtgaagactaggcacataatatagttttagcaattagtacagaacacaaatgtctgcataactcattttctgcagtcactgatttatgtttccctatcaagaagacacatcatcaccatgatatatcagcacaggctgaagagtggatttcaggctcattgtcctgtgtaatgtgggtcatcttagttagttttcatcaacttgaaatgtaggttatctatttgtaatataccagctctacaaacttagttgaatcttatttctgacattttttaacatggcattttatcacttttttgaatgtcatatattgatgaaacatttcctaagagtgtgggtttcccggtaaatgcattaatttcctaaagaagtgaaataatatttagtagtcattatgaccaccactccaggccttagatccgatttctccttgaattggatggccatttttttcctttaaagcagtgttttccagagtattaattctgaaaatggtgggggaggggttattagaaaagaaataaattcttgattcttagggcacaatggatatatgaaggactattaagggatctgagttgtaataaatattaagtctaaattacaatgactgtttattgtgattactgtaaagcagttctcatggctgatcttgcctctgccctttgaaattacttttagcattgattttcaaatagaaatagtactagtgtcacgggctaatgaccttccccacaggcaaaggcttctgctggtgtagggttgtggttgacattctagggagtacagtagggctgtccagagctaagttgcttgcttggcctgcctgcagagacatcagatttggtctggacaatcactctttggcctaaaggaatccctagttgtatatgtctgtcctttattttgtggttcctgtaagtagggctgggaagaaagaaaagaatcttctggtgaaaggcaggccagtcaaaggccaaattagaaaagaaaaacagtaaaactcaatttcctttttttgtaattgaaatttacctgtagtaacatgtacagatcttaagtgtgcatctcaatgatttttgagaaatatttacatccgtaaaatcaacaccaaagtcaagatacagaacattcttgtcaccccagaaagttctttcatgcccttttctagtcattcccctcacctaaagacaactcttattttattctttttttttttttttttttttttttgaggtagggtctcaatctgtcacccagactggagtgcagtggcacaatctccgctcactgcaacctccgcctcccaggttcaagtgattctcctgccccagccttcctagtagctgggattacaggcacacgccaccaccgcccggccaattttttgtatttttagtagagatggggtttcaccatgttggccaagctggtcttgaactcctgacctcaaacgatccacccgcctcggcctcccaaagtgctgggattacaggcgtgagccactgcacctggcctcctatttttatttctatcatcatctattagtttttcctgtatgcactctttggtttctgacacacctagccacctccccatccaacactcttcatcccctgttgataacccttcttgtcttgtcctctggtttcttggaagactcccaccgtgccccacactggggcattcaatagaatcttagacatggttagtcttctaggagtagttgttgaatgacctgggaaagatagggaaatcctttaagcagaggtatgtttcattcatcctttaatagcaaataacaataatgaacattgctgtctttataatagtagcctctaaattattgagcagttactatttactaggcaaacattatttttacatatatctaatttaatcctgacagccaaatgaagtacagtagctcttagtacatacagactttagagatgagaaaattgaagttcatggagatcatgtagcttatatgaagtcacaccactagtggtttgcaaattactaacacggtgcttggccttgtagtaatcaataaatgatgaatgcatatgccatgcacctatgaaaactcatcggtcctatgccctgctcacttcctgttttgttgtcatatcagaaggcactgtgatagagaaagactttttcagagcctcctggtggcttaatctgacaaatacctagggatatttacattctatctaaagattgcctggggtagagctttcactcaaagaattcaatagttaatggttgactttccaacacctagatacgtggcagaaataattttgactggtgtcctaaaaatagtattttctgagcactgactataggccagggagttgacatgaaatatctcatgaaatcttcataacaatgtatggacattcaatgtatggagaatgaatatccacactagtcttcaatgtgacagatgaagaaacagaccgaggccatccttaggtcactcagctaacaagatggtgaagtgaggatttgaccagatttcattgactccaaatctacctcctaaccactaaccactatatcatactcccttcctaggcagcacagctgagtctttctaatgcaggtttgcacaaagacgaaattacttccattcaccaaattggacataattaggaggagtgtgcctatactaaatacatggttgctccagggctgtggtctttgttcagttaaacaaaatctgaacattttttgagtgacttttctctatcaggtgctgtgccggggtaccctttccttcttctctggcctgggacattctgactttaaactttccgatgtgcatctcacttcacttggccatcctcttgaaccactgctacaggacattggccaggtgactgtgtctttcattggccaggtgactttggctttcatattggtttaaaaacaatggtactttcttttgcaactgcatctgagaccttgtttcacctgtgtcttcaagattatacatcctcttaattcactgttgagtaaaaactccacttgtttattttagttttcattacatggtatatgctttcagtctgtctcccatcagaatcatatgtctcatttcccttctctttgtctctcaaccctaccccgttcttcctccgactctccttctttccctccctccttttcttgttaacaaatgtcagtggtttttattaaccgaatggggctcctcagggtgtgctgagctcattgaaagattttcatttctggattttttcctttgatagctatattaatcgtgatgaaagaaatccaccccccacaacaaagcgtagctccacagaagaggtttttcactacttacgtaactcattttaaatggaaaaataaaaaagtgcaagctttattttgtatactatttatgctgccttcagttagataatatttccaaaaatatatcttgttaacagagacacaacgccttgaacaagcatattaattacagttctcgaagttgggaatcatgtagtatttatctgtattgtagaactgttgctcaatggtaataattaacagtgatgggtctattgcatggctataggtaaatttaataacaaacatgaaacccagttctcaaaacttgctccaaataatgtaggtagcatttgttactgttctggagttgagggttagtaaatagctagggttcttaaaatatttatctagctcttaaaagtagaagtaaacaacctaaagaagacaggctgagtgcacttcttgaatatgcccatagatattttcagaaacttctttcaatggtgactttgaaagtattgagaattgacctgcttattttgcctttgattctctgtgtgtatgcttgcctctccccttggggggtttattgaacattaaggcttccaagagctcttgaatttgtgagtgattttcggagctctgggaacaatgtgagccattctcttggaaacaggacaaggtgctcctagatgctctcattccggggaacatttgtttttcggctagctgggaaccgacgatcgcgctgaaaggtctggtcaaccagcctccctcagttcctgtgtatctggcaggcaggtttattacaaaccttagtgtgctcattagcctcgtgatgtggcagctgcctaaaaaagaaacacggaaaagttgtgtcaccgaaggtgaaacttggcaaagagctgcccggcgccggctccgggcatgacaaagcgccttcctggcggcggcagcggcggtgggcagtgggggtttctgtttgcttgtcctcgatacccacggcccagtcgactcacggggaggcgtcgcaaagggaaccgcgggcccgggccagggctccgtggctggcggtgcgggtggtcgcagtccgggggaagatactgcgcgctccggtgcagcccgcggcctcgcagtctagaccgcgggcacgttgcagcctgtggggaagcagcgttaagatggtggcggtcagagcagcgctggtggtggccgggcggggctcagggaggcgcgccctcctcccttagcgacacctatcaaggctttcttgctttccgtacacctgacccacccactagacacctcaaaggcaggcatagaaggccaagagccttgaagtcagggcttgaccaacacaagagctttgctttctctgtcttcttgttaatgctaatttgactttagctgctcaaaaaccgaagatgcatcttgagcaggacgctcacaggcagatttgaatttatgtgtgtgtttttatattgcttatgttttattacattgatttttttcagattacaaaataatgcatgtttaccggagacaatttggaacatcataaaagcgtagagaagaaaatatcacccaaggttccactaccaagttaactttttgaggctttgcttctagtcctttttctctgcatattataatacatagacatggctaattatctttaagtgtgtatgtgggatcaggcacatacacgataacttcctttttttccctcaacgtcttagaatgttattttatgtcgttaaataatttgcaccatcattttcagtgtgtatactaggtgtggacttaggggtaaccaaggagagatggtgatttgtgcctggggtgtgaacatttttcctgcacctccttgagatccttctcactggacaccacaagcatgattagtattttgtaaaagtacatatatgaatatgtgcccatatggggctatgtatatgtgtgtataaatctgtaaataccaaattaaacacacatagacaactatgcacatatgtaaatagatacacaacaaatatgctaagaataaatcttgaaagaatatacaccaaaaggaatctctgggtggttggcttatagaaatttatagtgtttagtcatattttctatttttatctatagtggaaatacataattatattaatgatataataataaaaataatactaatgaaatattacttattgattgtcttcaaactgagttttctgctccctcattccttgatctaccgtgacctacttattatttttatattatatgatgcttcaagtccaagctaaatctccatcctccatgaagcctttcttccgccctcccagcaggcactgactgcttacttctgtacagggcttctatgtcacccatctggcaatctccatgggctactttgggtgtatctcatggttaacttctcatctgcttatgtcttatctctctgaatagactggaatgtcttcaaggatccttttcacaaagcaagtgctcactaaatgtgttacgtaatgacaatgcttatcatccatcgtaggtttctgtaaatgctcctttacctttgaaactctataccaaaagcccttagactgacagcaataatcctgctggatttaattttgctaatttaatttaggatacaattgctacttcataatgggctatctacgtagaatttggtcaatgatgatactgataatattactgaaatagtagtgattttcatattgatttttcaagttagaggactcttgatagagggtttcttggtggtagaaataaatctacagattcacacatgcattggacagtcataccccaacttaagtgatttcagttattttaatgcatgtgtaaattaattcatctgttaatttactcgataaatatgtattgaaccttctatgtgccatctgctttcttagacactgagaatacagcagtgagcggaacagataactatccctgccttcatggataatacaagcatattttgcaagttttcttagggaaacagactttcagtgcatgaagcactctgtttcatgttcgtggtatgtcaagcagtgagtgatctggtgcccatcatagccatcaggctctggccaagccaaattactaatgagtcaagctggatggagtcatacatgggttgcttatctgtggttcaggaaccaccgaagctgtggttcctggaccagcttgggcatcagcatcacgtctaaccacatatacccccgaccatgagaatttgattcagtatatctgggcatgagccttagaaagccacattttttattaagctcctcaagtggttctaatgcacagctggtttagggacctactgcctctgggcagtgtttctcaagcttgcctaaagaatcacctgtagggtttgtttgttttttctaaacaaaacaaaacaaaaaccctcccgctgacctactgaattagaattttaggaaaagagatggtaatctgacttgtaagcaggtgtcctggtgattcttatcatcaggctagttggggaaacattgtcctagagacaatcacaggactcccctagaaattatgtataaatgtcaatttttctggtgagcaggctccattgctttgaacagattctcaaaggagtcatccactccaaaaatattacatgaggtggagccctgatgtctaggaccagcattgttgtcaactgtatgttttgagttctcagtgtcctcatgggttgaattaagcaaccttaaagaccttctcggccctattcatcttccacatataaatgttctgcttggaagccttctttctctctttttgctgcttttttctatcttattgccagtcctgcctcaattgtttcccttgatggtctccctttaggagaaagtagggaagcaggagaatttcaaagcctcggctctcgcagagagggcggggctgggagggagcttcgggcatgccattcagagatggcaatcctagcacagctgttagaatagcagaggtcagtgtccaaatattttgacccttatgatagcttgaacctcagtggatcttaaactggtgggataagggggtgggagtgggacttccaagacatttctctgccagtctagagcagggtgacacagggtggacaaggtaattccgcttttccttggacataatttttctgcctgtatctggcagcaggtggtgatgggaggtggaagcaggagtgtgagtgttgggctgggcctaggtgcacccccaccccttctcatccttgaggcaccaagcagtgtctctgtaattggttcatgaccaatcaagtgcattgacctattactgctagttactttgagttataaatggtttttatttcctctgtggaattgggggttcaggctgtataggatgacctgatttgtatcacaagagcctttgggactttgacagatttcaccgtttaaaacacaccgagcttcctccctccaccccactggacataaaagcaacctttgaatttctggcacaaagagcatgtctttaaagggcagcatgcagaaaaagggaggaaaaagaagtaaggcagttcatcttcttttctgaggccattgtctccaaacaagtgacaaaactgaataccttgaaaaatcttgtattgatttttagtgcagaggcatctccccaggatctgaaaatcctggcagaagataataaacttatttccctgcctttgagccagagttgagttgcttgttttacatggctggaagaaatgagagtagttgctctgctgagagtgagatttggttcagagtgcatctctcttgaccatattgtatataggggagactcaatttataaaaactatatatacaaatctaactcaaatgccgaatgtggaggtagttacaatattgaaagagttattgttttatgaaaagtttttcttttaatagcatcatctttagtgtactcgcacgtttctttgggcatgaaggactacttgattaaaaagaaagaaatcaaaaccaagcctagaggcctcttgttgaggcatttgtttcctgctattctaattagaaactgttgctcagagtggctgtcttgcttctcggattattatcttttttattttaattattttaaatatgtttactgtggcaaaatatacaacataaaactgaccattttatagtcaattctatggtatccagttctatggtattaagtatattcacattgttctgcagccttaatcaccatgctccacagatccttaattacaggctataatggctggaagggaccttcatcatcatttggtctaaccttcccactacagagtagaagaattaggcccacagagaggcaatgacttgcccaaggtcatagaacaagttagtggcaggggcctagcccagtacatttccacattgacacagtaacagattcaggcaggtggcctctgttactctactgatagcagaatcaaggattgacataaatgtttagggtatttttctgttttttttttcttttatcaagcaagcaaccaattattatggtttagagccagaaggtccttcagacactgtctagttcaatttccttatttaaaataattggccgtatttgtgatttctaaatccaagttgaactacagaaagatgctaacattcttatttctaaaatacaggacaattcttccccagccttcctttcactgactccatggcattctttggttgaaaccaggtcctttgtgggtggctgttattaataagcttttcttgggatgtttacagtgactgctgtgacctaaataagtttgcttgtattgttttccccacaaaggcaagaacagcttttaaaactatgttcatccctctcatcacaatgtatttattcatgactaaaagaactgaagtattgcattttctcacatttggggcctttgtgtaccccaatcatgttttcttggagtagagcttcaggacaatacaccatgtaacattataacatgatccctcttgaaaattttatttttacttttaattgtggtaaaatacacataacataaaatttaccatcttaaccatttttatgtgtacagatcagtagtgttaagtatttaactgaagtatataatctgaagactgcttgtgcaaccagtcttcagaacgttatctcacaaaagtgaaaccgtgtacacattaaacaattccccatttccccattaccccagtcccttgcaacctccattctactttgtctctatgggtttgactactttagctaccttgtataagtggaactatagttatttgtcattttgtgactgactgatttcatttagcattgctataaagagacccctgagattgggtaatttataaggaaaagatgagccttgaggctcatccatgttgtagtgtgtgtgggaatttctttcctttttcaggctgaataatattacattgtatatatagaccacatttggcttatccattcgtccaaggagggaaacttgggttgctttcatcttctgactcttgtgaataatgctgctatgaacttgggtgtagatcttttttcaattgatgggataaattgttttaaaatactcaatttattttctcagtctttagtctaagattattaaaataacatggtgaataaaataaaggaagaatgcaaatttttagggtactggagaattgaggcatcaatccaaatgacttgcaagtttgagaaccatgagtagagtaaataggacttttttaggtcctcttgggtctattatgttacttttttatagtgattttgtgtgtgtgtgtgtgtgtgtgtgtggaaacaatgaacttcctctgtgatagcctctatgatccttcatccttgcatttttgccctttaccatttatttccattcctgtttatatgtgtcccccactatactgtaaacttgttgagtgcagggaccaagttattaatttctgaatagtacttaggacaaagcctggctcataaggcaaatgcaataaatgtttgaagagaaatttgactcactctgtcatttggaaaaatttaacttcacagttagccttggaataattcaacatttttatttgtttttatctgcttcttttatatttgaaacatagctcatgtttaggagcacaaattagttttaaatatgaagcaatcaagttttttttgttttcaactctttttgggcagtgggagaaacatttgttgaatacttggcatcaaatagaggaaatatccaggccttgactttagttttgatttgagtaagtccctctgaatttccactgtgaattctgtctcctccctgccacctctgaagtgctgtgtgtggctttgagttgtgcagctagtgctgtgagtgctgtttctgtatcagggcacagatttcccactccatgtattggctcctaagctttgttttcatgccccctaacttctcctgaactgtctccaacctctttataatgttccagaaatagaaatctcccaaagggattgtcatttgtaataaacgccctcaatccttaatatattatttcccattggtgggcagaaagcctgcagatatatttattttcaggtgatagacaatactttagagacacatgcttaagaatctggactccattcattcaaagagcatcaagcattatggcaggcccaggcactggtgaaacaccaatgaggaagagtctctattcttgctcttacagagctgatagtgggagaaataaaaaggaagcagtgccttgactgggaaacacagagaactaaggaagctcataggagagggagctgacatagttgggtggtggtagcaagtgcgatcgttaacttgacacctgaaggatgagtaagaatttgtcagttgatgaagaggaataagagtgtcctggaaagtggggacagcacatgtagaagctaggtgatgagcaagaacatggcttacttagagaacggaaggaagtacattattcctagagtagtgagtcaccttagttacgtggatagtcctggcatatcctgaattatgccactctcatttcagtggacagtcccattgattccaatttttaagcagaaatattgaaaatgcagtttttctgtgcattaacaaggaggttccctggtaggaagaaatgcatgaaaaacaagtaggctcaatggtaacttaatgcacttgatgaaatgctgattgtgaacaaaacttcaggatactatcattataaatgaatgaaacccattagattttaagtagaagacttattttttttctgctaagattagaggcctcagggttttgttaattgtggactccatgatcagaaatccatatatgtgtctgcagccatgatttttttattagtaacaagaaagagggataacttcttaactattcagaatatgcattatttagcagtaagacacaactattccagaaagtggcttaatcaactttattcatatgaaagtacatagttttatggctattattagtaggccatgaatttttattaagtcaaaaagaacattgatatttaacagataatgccattcttggcagtgtagggtgtaatcaggcagaacacaactcatttctgacttccaactatatcactcatgttgactttctgctttgtctccagcagttgcatgaaagtaaatgtactgccacagatacttcccagatgttgccacacagaaatttcaggatagttccattcataccatttattcattcaaggaacacgtattgggtgttggctctctgtcaagcttgattgtaggtgttggaaaaatgtgaccaagctacagagtgtccctgcccttgcagggctcacagtgtagtggggaagacagacaagcaaatagtcaatggagacaaatacagtgtgaccagtgctgtaatagcagatgccctggaaactgtgcaagctcagaggagggcagctaacacagccttgaaggaccagggaatgctccctgaggagagagatcggctgggatcagaaaagtgaattaggacctggcctggcaaagaggaggacaaagagaatttcaagcagagagaacagctcatttgaagacaaagaagtgagaagaatggcaggaaggaagggagagagagagggaagggtattgcaaatgtaaatgtaaaagggcataactgtatgacatgcattatggctagagaggcatgaggtgtacctgaataggtaggcaggggctggcacacaaaggcattgaggtgtacttttgtgtatgaggatgaagagtttggatttcatttcaaatgcattggaaagcctttggagagtttcctgatgggaagccctgtgatctgatgtacatttttaaaaactctgtctggctaggaaggcagtgagaaagctgatgcggtgggtccaggctgagacttggtagagtaagaatgaagatggacaatgtctaaagatttgagagcactatccaggaattggggtagattgggttttgtgcaaataataacatgagtggtacaatgatatctcatttacttaagcgggagacaggagtcatgaatgatgactcttatgtttctgggatccagtcccatctctagcacttacaactgtgtgattgagcagtatcacttattctttgcatcttctttttttcatctcttacattttcccactgtgattgcagcctgattttcagtggtgattcataatgatcctaatatcctttgcttctaaggtacatagcagaccatttataaatattgcccaaataaatgaactggcattatgcagctacattcttatgcaggtatacttcctggttaggtgcagattagcctatttagtctttcttatctgtagcttattactgggaataatctaaagtggaaatcaaaccatagattgtgtgtgatataatggtcccctgtactggactgggccttaagaactcacatttttcccccttactttgctgttatcttgcctttatttagtgcaacagaaaatcacttatgtgctttatatcagtattcccatttgtaaaatgtctatgataatgccagatcctgactttagttttggggtgatattattaacaagataatagcttttaagcataatcatttagtgtttataatagacctttcctctaagaacttcctgatgtttgtcattggaggtggtgtaaggcagagaacagaagcccctgaagagctttttcagagaatctaggtcctaactctaccccacaccagcttcagtgggggcccattggtggacatgcacggtggactccggctgttatggaccttccctgctctgcatagtcttgtagcaatatggtcttctcatgtttcagaacatcaaatgtaaaagccaaaactacaactggcaagaactcacttagcagtaaaggggaaatgtataggaattggaactgctattgacaaaagttagattatatgatcaacatttcaaaggcacagagatttgcaataattgcatggggtataggtgttttctgaacaatagaaacaaaagccagtattatatagtgggttaaaagagacacttattatgctcaagtatacaaagtaacatgaacttctagctagtagaattttatggatttcatgatttgccataatgaagaaataaaaatattttaaaattttcctattgtttttgaaagcagttattgtgagtgtggttggcaagtattactatgtactcagcacccccttttcccatggatagctaaacgaattctgcattgttgggtctgatttcatgagttttgttccagtgcaaaacaaacttaatacaagtactttccaggtctggtttcatctgtatgtgaactagaactaaatcgtttacatgtgaggctaaaatgagagtcctcccaataaagtgtcctggaatgtgcatttgagtgttttctctaaagaagaagacagccatgttaagtcagaaatgaatcagcaaaagaaggaatgaaaaagattgttcattctgaaataacactcatggcttgtatgggaaaattttatttcaactttgaaaataaagatttttcatttaacattaattcaacaaatatttattgaatacctactatgtgccaggcagtgttctaggtataagtgatatagcaatgaataaaacaaagatctttgccctcctgggcttacattcgtgtgtgtgtgtgtatgtgtgtatgtgtgtgtgtgtagggacatacaataagcaatatatatataggtaaaaaagatatgttatctgctgacaagtgctatggaggaaaataaatctgggaatgtgtatgtatggtagtggtggtggtaaatggctgtagttttgagtatgatgatgaggtatggacttactgagaagatgatatttgagtaaaattctgagagaaagccatgcaggtgtcttggggaagagggttaccaacttttgcatgttgcctgggtaaaataaaagtgcacaagtataaaaatgtattacccacaagtcaggcagttagaggtgttttttattgaacaagggtaaagccctttctgcattcctgtgtaaattctgcaaggcagaatttcaaatgtagtctctggttatttgaatcttaaaagttcatgaacagctttttaaattgtactctctgaaatttctgtatatgcatacagatagcatttacatgtactaagttggtatgaacccatggatatacctgctttggtgttgaagctacttgatgatttgcaaattcaagcataccatattttcatttatgcaaaagaaagtattaactgttctgatgtctgggaagaatgagcacctctcaggaacataggttctgcttgagctactttagaccatttgactcctgaaagtaggagaaattatcagttagatagatcagcctctccagaggacctgcaaagtgcaagcaagaacagtgtggagccacttgcattgagtagtatgtgagtcaaagtcatggagaggagtggttgttgttcagtatttgctgtggattactgttaggactagtagatccatattctccctatttcctggtgttggtcattttgcattgctataaaggaattcctgagactggaagatttatacagaaaagaggtttatttagctcatggttctgtgggctgtgcaacaagtgtagtaccagcatttgctgctggcaaggcctcgggaagtttacaattatggtggaaggcaaagggaaagctgccttatcacatgatgagagggagtaaaagagagagggaggaggtgccaggcccttctcacgtgaactcacatctcacgtgaactcacagagagagaactcactcattaccatggggatggcaccaaggcattcatggggcatctgcccacatgacccaaacacctcccactaggccctcctctaacactggaggtcgcgtttcaacgtgagatttgtaggggacacacatccaaatcatttcactctctgaacagtgctctgtgtaactcttgccacttctaggtggataaggtggtgaagacccactaggtctggaagggcagagttgattctgtattgaggaggtcacagacctaatgtgaaaaattattgctccagcctcccttgtacaaaatttggacatgtgatacttttgacatgtttttggcgtgtcctgccagccaatggtgtgcaagtagacagagcaggggagtgaatccatgccaggacaattagctgttgtagtaaggggctgcagatttgcccttcccctttgtcttcagtgaagtgcccatctgttatataaatatttgaatgtggtggtgaggagggagggaactgtgtgtatttgtggaaagaagacaggaactgggtgcccttgagtgagcctcttaatctcaatgggtcacagttttgtgaaacgctacagtgagaatagtaacattaagcacccactaagcttgttggagtataaaaaagacatgatatgtgaaagcatttggttagcattatacatgtaaatgtacttttttaatgaatggacttgcttttccctagaaggcctttactggtagaatattgttcagctatcaaaaaacacggccttttatcaggaatttttcctaaattagcattattcacaattgaaactacatacttggtttctaagttttcatggcccagattattttattttgctaccttccccaccccatcccgagggaatatgtgaacaatttactattgacagataaaagataatgtgttgtgaaagtgacaggcccgaatcagcaggagagcctgcagttctcctgccttgctgtcattcagtgatgaaaatattacagaacgtttaatactatatgaactagaacaatacgcaatttcagaagaagccaccttatgacacttcaatttatttaacataaaagactgatggtcctattgaagttcaaagcttggaaaattttcaggaaggacaatttatactatttaggaaatgctctccctgagctttactgtttcatatttaatccagggtactacctaagattgcttataaagtcccttttgctgtgtggaccttcaacatctcatagtaaagagagaatatggtgtagtggttaagcatgcagagcttgtgcctttgttttcccatctgtaaaatggggataagagtagtacctacctcactgggttgttgtgtgtattaaatcagttaatatatacaacacatataatagtgacagacacagagtaagctctatataagtgtttgctattattattattacttaagttcttattatgaagattatctgcctagagtgtctctgtctaaaacaatagtctgcataaagtctgggttgtgttggagagggagaagagggtggtgaaggaatttttttcagtaaagaaccagcaatatctgctgcaaaggttcttccccacctcatccaactggaaaagccccgccagtcccttcaagaccctgttcaagcatcaaccctctccaccttctccacccttctcccagtggataattcccactgttatctcagcactttatttctgaattatatcagtcagtttctgaattatagctgttatcatactgcattatattatctgtttatgggtctctccctcactaggctgtgggctccttgaaggcagggactagtgtaattcaagcatagtgtcatggtatgcagtaagccattgatgctcatggagtggcagactatagctgggcagatttctctttcagagttgcccttccttgtgttcatttccttccctgcaggtctagactagagtcagtctcaaccgccctcaatttgccacttggccaaaggcctggactctctgcagtggggagctaaacatctgaatgaagtagtcatcaaaaccaaggtgagctttggagattgctatggcagaagtgaagagaagaggcaactagagtgacagtacatctttgctagttggggtcagtgttgggcatagctgttccctataactcagtactccagctagactgagatcaagagcatggctgagatcaagaacatgccctgtgttaccccttttgtgaggtcttctgagatgcccccaggcacacctaactgctagtactcctgtgcttcactgcaatttgaacatctctattaaaggactagtgattttattgcacatctgcttctcaccagactgtgagtcacatgagggcaggaactgtgaggtttcggttctgtagagctgctttaggtaaatggttgatgaatgagcaaatgaatcggtttgtctttctgatactacttcagtgatctgtccaaatgccgttaagaggcatattttgttacttgtttatcagtcatcttttctgcttgtttcaaccttcagtaaactgtggaactgttctctttcatgtagtacctggcacgtaggaatagtgcagcagataactattgaactgaatggcacctgagagcaacacagatgtagggttcttttattttctggatgtatttggaggcagggatataggtcagcaacccatagtgcagttgtcctttggggagggggtcagtgtgccaacctgtacagtttagatcggggactgtgaccacacacagtcaccagttaaatcaggcagccctattgcgcacatcatcatctccatcttcagttgtgtgtacagccaattgtaattactgaggcatataaggtagccaaatcatgtttgtgagcctccacttgaaaagtaaaagaaatatatgttatatgttagaatgagggttttttttcatacagagagaaacagaactaagaaaaaaataatttgtaatatttcagaaaactcaatttttgaggactctggatgatagaattcttacagtagctacccagctcagagcaatttgtgcatggaatacctttagggtatgtaagttccagaagatcatcatttagcttagtgcccagtatgatgccagtcattgtagaaaatttgacagattgatgatgcatggcctttgcccccaaagaatttgcattctaattgatgatctcagatgttatatctgcagtggtggtgagcagcttggaagagtataaaatataaagctaagctgtctattttgtgcgtgtgggaggcattcagaggagacatgccaagggtggggtatgtcaaggaaggctttatgataaaagcagtaggtgagtggaaattaaagtcaaagtgggagggtagggggacctgggaatgaaagtaaaagtgaacctgaggtgttagtaatggtgtatcctcactggattattcattaattcatcagttgaaatttatgtaactgactaccttgggccagacactatgatggatactagggacacagagatacacaggacatggtccctgcttttggcatactatggggacacccaaggagtgccttcctttattgaccatacagttaaatgactgacgagtcattcatgccttcaacaaacatttattaagtgtctgttttgggtcttactcagcattggatgctggggatacagaaatgagtcagaccagtccaagatactctcatactccaggtagatgcatgtgttaaaacatacaatcagctatttgctatttgcaaagtgcttctctcatatgaggcaggtttaatcctcatagcaatcttgtgaggttgtttctgttatattccccatctcacataatttgtgagattatgaactaagagattatgaaagtgagattatgagtttagttgataaactaaggcatagagctgttaagcaatttctctacgctcatactgctaagaagtagctgagctgagaagtgaatccaattcctctgcatgttttttttttttaatgtcctggaatcacaagagtatttgactcatactgtaggagcagaaataaaatgaaataaaatgaaaactgattttttgcgaaaagagaggcatcttctaagaaaatgaaagaatgattcttcgaatgggaaaattgccatcaactcaggggaagttatgaaaagtttgaagacatgtaatgggagagtgaacaaagtactaaaataagaagggaccacattggggtgtgttgctttactagtccactgtgagatattaagttggtgcaaaattaattgcggttttgccattaaaagtaataggcagtatcatggaatattggccatagagttaaatgttctataaggtgaaactattgttaaaaagtcacttgtgttatggaatcaccttcatgtgttagttattgatcttgccggcttgcaatttataaatgtatttttaaaagcaagagtccattatgtagattttctttctctttccttctttcctttcactgagtcaataattttaagataagaaaagaaatatataaaagatctattatagaacactgatgtccagtttaatcccttattcttttctgcaatcaaaagataaagtaggaagataactggaatcagtttgtgacagagaggaaaaaagaaattgactgtgattacaaacctcacaccaaaattattattatagacctgactcccaaattatgcagattgagaccacatgaaacatatggtgtattgtttttctacgcataacttgtttgatgtttgtttaaagaccttagatgaagaactggctcttgagatatcttgtctctcataatcacaatctgaatctgccttaccctcacttgaggtttacatggagagtttcaaactgaaataatgcaaaaattccttatgtgacatggtgatgtggagtgtgggctttggctctaagtttgtgatgggattggtgtagtgttcgcatggaaataatcatatacttggcagcattttctctgaggctattagacctgaatggacagaaatactgatgtttgcaaattccctctggcagtatggtgcaagtgatatcattcatatcctttctttccattttctatcttcctacactcagtgacctcagagatcatctggccattctttctacagttgatgaactcagtcctggagagtgtaaaggacctgctcaaggttttttggcatagccaagtatagcttctagaagtaatttccattgatcttattgcttgctcttcagaactatctaatgaggtggctggcaagatggccgaataggaacagctccagtctgcagctcccagcgagatcaacgcagaaggcaggtgatttctgcatttccaactgaggtacccagctcatctcattgggcctggttagagtgtgtgtgcagcccatgcagggcgagctgaagcagggtgggacgtcacctcacctgggaagcacaaggagctggggaagtccctccccatgagggactgtgctgtgaggaacagtgcattccggaccagatactatgcttttcccatggtctttgcaacccgcagaccaggagattcccttgggtgcctaaacaaccagggccctgggtttgaagcacaaaaatggctggccgtttgggccaacacatagctagctgcaggagttctttttcataccccagtggcaactggaatgcaagagagagagaaatgttcactcccctggaaaagggctgaagccagggagctaggtggtctagctgcccggatcccacccccatggagccccgcaagctaagatccactggcttgaaattcttgctgccagcaccaggcctgccttacaagagctcctgaaggaagcactaaacatggaaaggaataaccggtaccagccactgcaaaaacataccaaattgtaaagaccatcaacactgtgctgaaactgcatcaacaaacagacagaataaccagttagtatcataaggacaggatcaaattcacacataacaatattaaccttaaatgtaaatgggctaaatgccccaattaaaagacacagactggcaaattggataaagagtcaagacccatcagtgtgctgtattcaggggacccatctcatgtgcaaagacacacagaggctcaaagtgaagggatggaggaatatttatcaagcaaagagaaagcaaaaaaaaaaaaaaaaaaagcaggggttgcaatcctagtctctgataaatcagagtttaaacgaacaaagatcaaaaaagacaaagaagggcattacataatggtaaagggatcaacacaacaagaagagctaactatcctaaatatatatgcacccaatacaggaacacccagattcataaagaaaattcttagagatccacaaagagacttagactcccacacaataatactgggagactttaacacctcactgtcaatattagacagctcaatcagacagaaaattcacaaggatattcaggactcaaactcagctctggacgaagcagacctaatagacatctacagaactctccaccccaaatgaacagaagatatattcttcaaagcaacacatcgcacttattctaaaatcgatcacataattggaagtaaaacactcctcagcaaatgcaaaagaatggaaatcacaacaaacagtctctcagaccacagtgcaaagaactcaggattaagaaactcactcaaaactgcacaactacatggaaactgaacaacctgctcctgaatgactagtgggtaaataacaaaatgaaggcagaaataaataagttctttgaaaccaacgagaacaaagacacaatgcagcagaatctctgggacatagctaaagcagtgtttagagggaaatttatagcaataaatgcccacaggagaaactgggaaagatctaaaatagacaccctaacattacaattaaaagaactagagaagcaagagcaaacaaattcaaaagccaggagaagacagaagacaagaagtgaataggatcagagcagaactgaaggagatagagacaaaaaaaaaaaaaaaacccttcaaaaaatcagtgaatccaggagctgattttttgaaaagattaacaagatagatagaccactagccagattaaagaagaagaaaagagagaagaatcaaatagacacaataaaaaatgataaacgggatatcaccactgatcccacagaaacataaactaccataagagaatactataaacacctctatacaaataaactagaaaatctagaagaaagggataaattcctgtacacataaacattcccaagactaaacctagaagcagctgattccctgaatagaccaatgacaagttctgaaatcgaggcagtaattaatagcctaccaaccaaaagaagcccaggaccagacagattcacagcctaattctaccattggtacaaagaggagctggtaccattccttctgaaactattccaaacaatagaaaaagagggactcctccctaactaattttatgaggtcagcatcatcctgctaccaaaacctggcagagacacaacaacaacaaaaaaatttcaggccaatatccatgatgaacatagatgcaaaaatcctcaataaaatactagtaaactggatctagcagcacatcaaaaaacttatccactacaatcaagtgggcttcatccctgggatgcaaggctggtttaacatacacaaatcaataaacataatctatcacataaacagaaccagtgacaaaaaccacatgattatctcaatagattcagaaaagggcttcagtaatattcaacactctttcatgctaaaaactctctataaactaggtttgatggaacctatctcaaaataataagagctatttatgacaaacccacagccaatatcatactgaatgggcaaaagctggaagcattccctttgaaaactggcacaagacaatatgctctctctcagaactcttattcaacattgtattggaagttctggccagggcaatcaggcaagaaaaagaaataaagcatatttaaatagaaagagaggaagtcaaattgtctctgtatgcagatgacatgactgtatatttagattagacaaccccatcctttcagccccaaatctccttaagctgataagcaaatttagcaaagtctcaggatacaaaatcaatgtacaaaaatcacaagcattcctatacaccaataatagacaaacagagagccaagtcatgagtgaactcccattcacaattgctacaaagagaataaaatacctaggaatccaacttacaagggatgtgaaggacctcttcaaggagaactacaaaccactgctcaaggaaataagagaggacacaaacaaatggaaaaacattccatgctcctggataggaagaaacaatatcatgaatatggccatactgcccatagtaatttatagattcaatgctatccctatcaagctaccactgactttcttcacagaattagaaaaaactactttaaatttcatatggaatcaaaaaagagcctgtatagccaagtcaatcctaagccaaaagaacaaagctggaggcatcacactacctgacttcaaactatactacaaggctacagtaagcaaaacagcatggtgctggtaccaaaacagagttatagaccaatggaacagaacagaggcctcagaaataaagccacacatctacaaccttctgatctttgacaaacctgacaaaaacaagcaatggggaaaggattccctatttaataaatggtgttgggtaaactggctagccatatgcagaaaactgaaactggaccccttccttacatcttatacaaaaattaactcaagatggattaaacgttaagacctaaaaccatgaacaccctagaagaaaacctaggcaataccattcaggacataggcatgggcaaagatgtcatgactaaaataccaaaagcaatggcaacaaaagcgaaaattgacaaatgggatctaattcaactaaagagcttctgaacagcaaaagaaactatcatcaggttgaacaggcaacctacagaatgggagaaaatttttgcattctatccatctgacaaagagctaacatccagaatctacaaggaacttaaataaatttacaagatgaaaacaaacaactccatcaaaaagtgggcaaaggatatgaacagacacttctcaagagaagacatttatgtggccaacaaacatatgaaagaaagttcatcatcactggtcattggagaaatgcaaatcaaaaccacaatgagataccatctcatgccagttagaatggcaatcattaaaaagtcaggaaacaacagatgctgcagaggatgtggagaaataggaatgcttttacactgttggtgggactgtaaactagttcaaccattgtggaagacagtgtggtgattcctcaaggatctagaaccagaaataccatttgacccaccaatcccattgctgggtatatacccaatggcttataaatcgttctgctataaagacacatgcacacggatgtttatttcagcactattcacaataacaagacttggaaccaacccaaatgcccatcaatgatagactggataaagaaaatgtggcacatatacaccatggaattctatgcagccataaaaaaggatgagtttatggcctttgcagggatatgaatgaagctggaaaccatcattcttagcaaacttacacaggaacagaaaaccagacactgcatgttctcactcataagtgggagttgaacaatgagaacacatggacacagcaagggtaacatcacacactggggcctgtcaggggatgggggactaggggacggatagcattaggagaaatacctaatgtagatgacgggttgatgggtgcagctaaccaccatggcacgtatatacccgtgtaacaaacctgcacgttctgcccatgtatcccagaacttaaagtataattttaaaaacatttacatatatatatatattatatttatattcatatattttaaaaaaagagctatctgatgagacaggtgaggcaggttgttttgtatcaatttctagaagagacagtttagagccagggaggttaaaatgctggttaatggcccaagacgtagccagcagctcagctgggactaaagtccagatcttctgatttcttgtagcacaccatattgcctctgaattcttttctttcaaaacagatatttctgtccttttgggtttgtcaaggaatcacttcctatgttattcttttgacactggtattcgttggcacttgcaaattgccttagattggtaattaacttttaaaatttgtagatattttgtttctctaactatattataatctctctgaggattgagggccagccaggttttatactgcctttgaatcttccttagtacctagcttgtaatatatgcttgacaaatatttgtttagtgtctgatagtggaagtcagctggaggttggtgtatgtctaatataaatctggaaattaaagtctcttttggttcttggctcaggatataaaaagcatcatgggtaataaaatttacaagttttctagcctaatcaggtattatgtaaaatttgtatcctgatttgagaaaatctgtatctgccagtgtgttctgactgttggaacatgaatataaagattaatttgagattgcagagttctgccatagggtttggtgaaatactacctaaactgtcctcagagctttctgatatctatcaatagtggaaagttgatcttgtttctcctttaaagatttttgtctttagagctttgtgcaaaggttgaccagaacctcggaatcctaggatggatcgaatacctggtgtgtgctaagagctaggaaagtggaagctggattatgcacgggtagaaaatgaagagagggcaagaggaaggaagaaatggaaagtgtaagccaatgtgagtaggagtttggacgcaagccccatatttgaatcaggaaacaaggctgttggcagggctgattgtcatctccccagatgacctgctggccagaaagagttaactggccttacaacctgctgcaggaatagctcaagagctatcaaattcatcacatgtaacttttcactcagattggttttgggtcctgatatttacgagttaaaacatcttaacatcatttcaaatatttgtgaaagtatatgggaattttatggagcagcggggaatttaatgcaaataaagtagaaatatagagtcatatttgagtttttatgttgaaatcatatcttgatgaagttagttttaaacaactatatttactgaggacccactggggacaaaacacattcaaggtatttttttcagtttttaaaatttttgcaggaaagaaagaaccagtcacatcgaagcaacttgaatgtttataaaggaaaatcatagaagaatggacatcctttactcttgaaaagtttatgaataagctgcatgtcaaagcaatatcataatcacaaagtagagaagataatccattgttttcttgtataaagtcattagcattctaacttattcattcatttgtaaatcacacattgaaaagaaaacaattagcacactctttcacatatctgtgataagtcctcaggcctactcaggaagctgttgaaaatgggcatgctgatttgttattaatgcttatatattttagaaaaagcatccaatttagaaattaaattgatttttttttctttttacaaaatgaaagtcattactacaggaggtagggagacaagcaggcagacaaacaagacagcagggcagagccctgactggggcataggatctgttcacatcccatttctgttgaaggaagattatagcctaagagcatacagtagagggttggattagaacctcccatcagaagccatcaagaggtattctctttcccctgttctcttgcacttgtttctttcacaagttttttcagcatttttgggtactctgttgtacaacctaaaataaattaggcatctaataatagttttcttaaggaggcaaaaggaaaaaaaagtagaatttgtatttctcatgtttctaatacggattcttcttttaaaagtagccccaagaatgcatccttattctttcagcataagaatatgctgtcagctctggggacactaagatgaatagggcacaaccttacttgctaggttctcataatccagttggctgctcaggataagtcaagcataaagacattatcaaggccctgtgggaattcagaagggaggaaatttattcctgctaagggactcagggaaggcttcctggaagaggacaatcagagctggactttggcagataggtaggatctgcacatgaagagatgggaggagatggaggcagctgtcacatagttgagaaatcatgtgatgtgttggctaacagaacgcacttttttcttggagtctgaggcttgggaagggaaatgacgggaggtcaggttagcaatataagttgaagctagattggtagggacagccttgaatgtcaggccaatgtctttgggactttataggtagtgctaagacatatccagagaattagctaggcagtgtcacgaacagatatttatagcatattgtggcaagaaacatgagtgcaggatggttggaggccttgaggagggagccgctaagctgccaaggtgtgaaagctggagcatcgtcaaggaagcttgcatgaaagtgatgacattttgctgaaccttgaaggatggatatgaattccccagggaataggttgggaaaggacatttcaggcagaaagaatagcacctgcaaagtcccagtggtctatgagggaatgttatgctgaagaatggcaattactgtgatgtagagaatgcaggtatctgggaattgggtagcaagagaccaagctaggaagagggcaaagaccagatcccagcagaactagtaggcctggctgggtggtttcaacttcaagggctgtatgcaggaaacaattgtgatgtgtgcttttagaaatatcatgctagcagtggtgaggaggatgcattagcataaatgagaaaggcttagcttgctgagtggtagggtggcaatggaactaaaatacgtaaagaaacagtgtttggggcttagagagagtctgggcaagacagagggtggactgaaaggatttagggggaatggtttttatactttaattaatgctgtggttttcacaataggtctctttgtttcaaaggaaatcttacgcaaactccatgaaagataagggccaagctgcatggagttcaggtgggaattgggcttggatccaagcctgcttgttcccttgaaatcctgcaatttcgtgatggctcctgaggtacctctttgaaccctttgtagttcagcaaatgcagtttgaaagccactgccctgaaaagattcatgtgctccaccaaaaacccaggcctttgccctccatgctgctgggagagggaaactggcctcttgctgtcatggttgggcaccgaaaaaggcaggcttatctagggacaatgaacttgatctcttttagaggctctcactgatcctggtggctcactgatgaggcatctggagtattctttgatacctagggacattgtagttcccaaggcattttgaacaatcgtttgtagtccaatcaggccgaattcatgaaaggaatttctgggttctaggtagaaagcagggccagacgcagtggcttatgcctgtaatcctagctctttgggaggctgaggcaggaggatcccttgagaccaggagttcaagctgtgattgcacctctgtaccccagcttgggcaacagagcaagatcctgtctctttaaaaaatacaagcaagcaagcaggggataaaagaggtgcctaggccagagataagcaaggggagctggagacagggccattgtacagggatgtctggccctcggggtcagtgaggctgatattcagacagtgcttttggcagctgatgaggagctgcactcttccagagggattacctttttctaattcatagaaaggcaccttatgctctagcattggatatttgggaagatagcatgaagaggtggtgaagagcaagagataaatggggagttggggttggaatcaaatgtctgctcaacccttatgaggtgtgtgaccttgcacaacttccctaatctcttggatcatcagcttcattctccatgaaacatgaatgatactagtacctcctgttgtgggcttttatgaagattaaagaagataatttgtgtaaagtgcttaacacagtgcctggtacatagtaagtgttggataaattttggctgttaatattctttatttgtaatcagaacactgtctactccattacagcagtaacttcagacttcatatcttgatacatttctctttactaagaaagaatgcctctcagttcaacaacatgggcatgagcatcttatattttcagttatgtcctataaaagaaatacaaggaatgactactagcatggattttaaaaattactagatgtatttcagatacaaaattggatgctatggtgaataatccagggggtactcatggacccaccacttagcttagtaaaacattactgatgcagttaaagctccttgtgtatccctcactgatattcccttccttcttgcctggaggggaccaagtttctgaatttggcgtgaataactttcatgaatgttttaatattgctattacatttgtagctatctgtaaagaatgtataatttgtgttttaattattttagctttatgtagaagaccttttactgtattttttcttcaacagccctctttttccccctcaacatttacctaacataaacatatacttgttgctatacataaggtagggaagtaataaaaattgttatttattatggagaagagtgtcagctttttgttgtaaaataaaaaaatgatatatttaaaaatactaaatgtatttcaaattgactttctgaaagatctaggtagaaagagagttaggttttggaattttatctgatatacctacaggccactcataattatagggtacccaaacctgcaccttattaaaccttgatcgaatggttgtattgatgaaacatccacaattctgtttacataacacttgcttggatttggagacttggcatcttgactattaagtatgaaactgtcttgaaaaatcactgggttcatgaaaggttttaaatgaaatagcatgcatctataaaccattctctcatatttatccatttgagtgtgaagtagtatcctagttttcattttgaactccagagtcttatatttgtgaaatatgatgtcttctctttaactacaattgtatgatttttgaaagaatagatattggcatttatattctggtaaagttgcattgttatagtttgcaaattattaatccacagcacttatactttactgtttgaaaggagtcctatgcttttttcttttaaagcagaatgtggcatatacattaacacattgtcccacatttttgctaagtggaatgtgtctgactttgtgggctgatgaatgatgccatatttatttctgaatcaatcttatggcttatcagtgcagttatcacttatgtgatctgagacttttagctgggactccagagacattgatgatctttatcattctgtatcactcataaaggatcagggtcagttgaggttttgacacctggccatgtatttaatgttttggctttgttggatgtaactcatctggcacaatgttattaccacatcactgagtgagatgtcctcattttcagatgttgccaacattaatatctcagatttcaggaataaaaagttacctagggtgagttgagatgagtgacattgacatgtgtgtgtacctacatacatgtatttgctgacttgacttttgcttatctttatctctgtaattagaatatatcttctcttgattaaattaaacctgtcattttcccataatcatttatcaaatgttcctatacgccagctactatgccaagtacagggtatatacaagttactcttgaagagctcacagtccaataagggagacagtatactttgtcaggtgcttccgttgacttatgcacaatgtattagaggaacagaaaaggaaggagatattcatttatataaaataattgctcaagggaggcttctcagagcaggtgatatttgatgtgagtcttactgggtgaataggagtttgccaaattgaaatgcagagggtatatcatttgcaaaggcacagaagcataaaagaggacgatgagtttgggaagcatatgtgagggtaagagggaggctggaaattgagattgggccagatcatgaagggtctcatgtatcatgataaggagcttgggtgttatcttttaaggggaattgaaggagtgtttcatatggaaaagtgaaattttcatatggaaaaggttttagggaggctgtcttagtctattttgtgtgattataacaaaatatcagagactgagtgatttataaaggaaagaagtttatttagctaatggttctagaggctaggaagtccagtggcatggtgtctggcatctgtaaggccctcatgacctaaatacctccaattaggcctcacttcccaacactgttgcattgagaattaaatgtcaacatgagttttgggtgggggtattcaaaccacagaattctgcccctggatacccccaaatcatgtcctttttacatacaaaagacattcattccatccaaatagccttaaagccttaatttatttcagcactatattagtccattctcacactgctaataaagacatactgggtaatttataaaggaaagagatttaattgactcacagctcagtatggctggggaagactcaggaatcttacaatcatggcagaaagggtagcaaatacgtccttcttcacatggcagctagagagagaaaaacgagaaccaagcaaagggggaaaccccttataaaacaatcagatcctgtgaaaacttactatcacgagaatagcataggggtaactgcccccatgattcaattacctcccagtgggtccctcacatgacacgtggggattatgggaactacaagatgagatttgggtggggacacagccaaaccatatcattctgtgaccttcccctaccaaatctcatgtcctcacattttaaaacacaatcatgcccttccaacagtcctccagagtcttagctcattccagcattaacccaaaagtccaactccaaagttttatctgagacaaggcaagtcccttcttcctatgagactgtaaaatcaaaagcaagttagttacttcctagatacaatggaggtacaggcattgggtaaatacacccattccaaatgggagaaaatggccaaaacaaaggggcccaggctgtttgatacttcttttgaaatctaagtggagactatcataccctcatacccccacagttcttgcattctttgggcctgcaggattagtaccatgtggatgtagccaagcttaatggcttgtaacttccagagtgggagattgaggcacaccttgggccgcttgaaatccagctggggcaaactaggggacaaagctccagaacgtggggagcagtatcctgaggttgcacagggcagtgaacttttggaggccacccaggcctgttcccccaaaccattctgcccttgagagctctgggcccctgatggaaggggcagagtaaaaaatatccaaagtgctttcgggatttttctcccattgttctgatggctagcacctggctcccttctagccctaccaatctctttaacaaatggtcacttggccacactcttgcaagctttttcagtttttatgtggcaggctgcagattttccaaatctttctgttccgctactctcttttaattatgaatttcatctttaagtcatttctttccttttgcatctcactttatgtggttaaaagtagccaatcatcatcctgaatgctatgcttcttagatatttcttctgccagatatcctagttcatcattttctgcattccataaaatcctaggacatggacacaattctgccaagttcgttgcaactgtgtaacaaggatgccatttactacagtttccaataagttgtttctcatttccatctgagagtttgtcagaatggactttaacgtccatatttctaccagcattgtgatcacaaccacttaagtaatccctaagaagttccagactttctctagtcttcttttcttctgagccctccccagagtctcccttagtgccctattcacagcaatctagggtttttaaacttgctcctataaattcttttttttttcagtttggcaaccattcttattttatttaaagtacagataagagaaaataatattaagtagttcatttactattgtgatgattaactttatttatcaatgtggctaagctataagtaaacagttcttcaaacatcagtccaaatgttgctgtgaatgtattttttaatagaattctccattcatttatttatttatttatttatttatttatttatttgagacaaggtctcactctatcacccaggttggagtgcagtggtgcattttggctcagtgcagcctcagcctcctgggcttaagcaatccttccacctcggcttcctgagtagctaggactacaggcacatctcatgacgcccggcaaaatttgttattttgtagtgacaaggccttgctatgttgcccaagctgctctcgaactcctgggcttaagtgatccacccgcctgggctctaaaagtgcagagattacaggcgtgagccactgcacctggctagtggtacttttagatgtgatttgacatttaaatcagtagaccttaagaaaaaaagattaatctccataatgtacatggccctcatccaatcagttggaaaccttattagcaaaaactgaggttccccgacatagaaggaattatccacagaactaccacatgaaaacccattgggagatatacctaatgctagatgacgaattagtgggtgcagcgcaccagcatgtcacatgtatacatatgtaactgacctgcacattgtgcacatgtaccctaaaacttaaagtataataataataataaaaaaaaaaaaaaagaaaactcagcctgaatttccagcctgcaagcctgccctgcaaatttcagagctgtcagcccccaccttaacgttgtcataaatacttcggttttggttgttcacaaaatatgattccttatttggaatatttggggggaatattctagaggaaaaaagcataccaaataagcatgctgtgctcagttattccaacttaaattcatgatgctgcttgaacatactgtttttggatctctaatgcacagcatccttagactggattttcctaagaaaacttcaggaaaattttagagttgttgaattcatttgatagaaacagacattaacccaaataataatagaaataataatggtggtggtgatagtagtggtggcagtaataatagtagtagtagtagttattataatattgatttgcatacctgaaaggagtaaaagtagacctggcttcaaagctgaatgacctccaacaatgtgaccaggactccctcactatccttgagtttgatttctccagtgtacaacttcttcttcttcttcttttaaattattatgcttaaagttctgggatacatgggcagaacatgcaggtttgttacacaggtatacacgtgccatggtggtttgctgcacccatcaacctgtcatctacattaggtatttctcctaatgctatccctcccctaggcccccaccccctgacaggccccagtgtgtgatgttccccttcctgtgtccatgtgttctcagtgttcaactcccacttatgagtgagagaatgcagtgtttggttttctgttcctgtgttagtttgctgagaatgatggtttccagcttcattcatatccctgcaaaggacataaactcatccttttttatggctgcatagtataccatggtgtatatgtgccacattttctttatccagtctatcattgatgggcatttgggttggttccaagactttgctattgtgaatagtgctgcaataaacatacgtgtgcatgtgtctttatagtagcatgatttatgatcctttgggtatatacccagtaatgggattggtgggtcaaatggtatttctggttctagacccttgaggaatcaccacactgtcttccacaatggttgaattaatttacactcccaccaacagtgtaaaagcattcctatttctccacatcctctgtagcatctgttgtttcctgactttttaatgatcgccattctaactggcatgagatggtatctcattgtggttttgatttgcatttctccaatgaccagtgatgatgaactttttttcatatgtttgttggtcacataaatgtcttcttttgagaagtgtctgttcatatcttttgcccactttttgatggagttgtttgtttttatcttgtaaatttatttaagttccttgtagattctggatgttagctctttgtcagatggatagaatgcaaaaattttctccaattctgtagggtacctgttcactctgatgatagtttcttttgctgttcagaagctctttagttgaattagatcccatttgtcaattttggcttttgttgccattgcttttggtatttcagtcgtgacatctttgcccgtgcctatgtcctgaacggtattgcctaggttttcttctagggtgttcatggttttaggtcttaacgtttaatccatcttgagttaatttttgtataagatgtaaggaaggggtccagtttcagttttctgcatatggctagccagttttcccaacaccatttattgaatagagaatcctttccccattgcttgtttttgtcaggtttgtcaaagatcagaaggttgtagatgtgtggctttatttctgaggctgtgttctgttccattggtctttatatctgtttttgtaccagcaccatgctgttttgcttactgtagccttgtagtgtagtttgaagtcaggtagcgtgatgcctccagctttgttctttttgcttaggattgtcttgcctatacaggctctttttgtggttctatatgaaatttaaagtagttttttctaattgtgtgaagaaagtcaatggtagcttgatgggaatagcattgaatctataaattactatgggcagtatggccattttcatggtattgattcttcctatccatgagcatggaatgtttttccattcgtgtcctctcttatttccttgagcagtggtttgtagttctccttgaagaggtccttcacatccctttaagttgtattcctagctattttattctctttgtagcaattgtgaatgggagttcactcatgacttggctctctgtttgtctattattggtgtataggaatgcttgtgatttttgcgctcattgattttgtatcctgagactttgctgaagttgcttatcagcttaaggagattttggcctgaggcaatgggattgtctaaatttacaatcatgtcatgtgcatacagagacaatttgacttcctctcttcctatttaaatacactttatttctttctcttgcctgagtgccgtggccagacttcccatactttattgaataggagggctaagagagagtatattgtcttgtggccagacttcccatactttattgaataggagtgctaagagagagtatattgtcttgtgccagttttcaaagggaatgcttccagcttttgcccattcattatgatattgactgtgggtttgtcataagtagctcttattattttgagatatgttccatcaatacctagtttattgagggtttttagcatgaaggagtgttgaatattattgaagcccttttctgcatctattgagataatgtggtttttgtcattggttctgtttatgtgatagattatgtttattgatttgtgtatgttaaaccagccttgcatcccagggatgaagcccacttgatcgtggtggataagctttttaatgtgctgctagattcattttgccagtattttattgaggatttttgcatctatgttcatcatggatattggcctgaaatttttttgttgttgttgtgtctctgccaggttttggtagcaggatgatgctggcctcataaaatgagttagggaggagtccctctttttccgttgtttggaatagtttcagaaggaatggtaccagctcctctttgtaccaatggtagaattcagctgtgaatccatctggtcctgggtttttttggttggtaggctattaattactgcctcgatttcagaacttgtcattggtctattcagggaattgacttcttcctggtttagtcttgggagggtgcatgtgtccaggaatttaaccatttcttctagattttctagtttatttgcatagaggtgtttatagtattctctgatggtagtttgtgtttctgtgggatcagtggtgatatcccgtttatcattttttattgtgtctatttgattcttctctcttttcttctttattcgtcagtctgactagcagtctatctattttgttaatcttttccaaaaatcagctcctggattccttgatttttttaacggtcttttcatgtctctatctccttcagttctgctctgatcttagttatttcttgccctctgctagcttttgaattcatttgctcttgcttctctagttctttcaattgtgatttcagggtgtcaattttagatctttcccactttctcctgtgggcattcagtgctataaatttccctctaaacactgctttagctgtgtcctacagattgtgttacgttgtgtctttgttctcattggtttcaaagaagttatttatttctgccttcatttcgttatttacccactagtcattcaggagcaggttgttcagtttccatgtggttgtgcggttttgagtgagtttcttaatcctgagttttaatttgattgcactgtggtctgagagactgtttgttatgatttccattcttttgcatttgctgaggagtgttttacttccaattatgtggtcgattttagaataagtgtgatgtggtgctaagaagaatgtatcttctgttgatttggggtggagagttctgtagatgtctcttaggtctgcttggtccagagctgagttcaagtcgtgaatatccttgttaattttctgtgtcattgatctgtctgatattgacagtgaggtgttaaagtctcccagtattattgtgtgggagtctaattctctttgtaggtctctaagggcttgctttatgaatctgggtgctccttaattgggtgcatatatatttaggatagttagctcttcttgttgtgttgatccctttacgattatgtaatgcccttctttgtcttttttgatctttgttggtttaaactctgttttatcagagactaggattataacccacactgtttttttttttttttttgctttctctttgcttggtaaatattcctccatcccttcactttgagcctctgtgcgtctttgcacgtgagatgagtctcctgaatacagcacactgatgggtcttgactctttatccaatttgccagtctgtgtcttgtaatttgggcatttagcctatttacatttaaggttaatactgttatgtgtgaatttgatcctgtcattatgatgctaactggttattttgcccatttgttgatgctgtttcttcatagtgttgatggtctttacaatttggtatgtttttgcagtggctggtaccagtttttcctttccatatttagtgcttccttcaggaactcttgtaaggcagacctgctggtgacaaaatctctcagcatttggctgtctgtaaagtattttatttctccttcacttatgaagcttagtttggctgcatatgaaattctgggtcgaaaattcttttctttaagaatgttgaatattggcccccactctcttctggcttgtagggtttctgcagagagatctgctgttagcctgatgggcttccctttgtgggtaacccaacctttctctctggctgcccttaacattttttccttcgtttcaaccttagtgaatctgatgattatgtgtcttggggttgctcttctcgaggagtatctttatggtgttctctgtatttcctgaatttgaatgttggcctgtcttgctaggttagggaagttctcctggataatatcctgaagagtatttttccaacttgcttccattctccccatcactttcaggtacaccagtcaaatgtaggtttggtcttttcacatagtcccatatttcttggaggctttgtttgttccttttcattcttgtttcaataatcttctcttcatgctttatttcattaagttgatcttcaatctctgatatcctttcttttgcttgactgatttggctactgatacctctgtctgcttcacaaagttcttacgctgtgtttttcacctccatcaggtcatttatgttattctttaaactggttattctagttagcaattactttctttcagagatgccctgcccagagaggaggaatctagagaggcagtctggctacagagccattctgtacctggctccgcccagtttgaacttcttggcagctttctttacactgtgaggggaaacctgcctactcaagcctcagtaatgtatgatgcccctccccccaccaagctggagtgtcccaggtctacttcagtctgctttcctggcagcaagaatttcaagccattgaattttagcttgctgggctcaatgggggtgggctctgctgagctagaccacttggctccctggctgcacccccctttccaggggagtgaacggttttctctctctggtgttccaggcaccactgggatatcaaaaaaaaaaaatgctgcagctagctaggtgtctgcccaaatggccgcaccgttttgtgcttgaaacccagggccctggtggtgttggcacctgagagaatctgctagtctgtgggctgtgaataccatgggaagggcatagtatctgggctggaatgcaccattccgcatggcacattccttcagggcttccattggctaggggagggagtttcccgcccccttgcacttcctgggtgaggcaacgccccaccctgcttcagcttgccctccatgggctgcacccactgtctaaccagtcccattgagatgagctgggtacctcagttggaaatgcataaatcacatgccttctgcattgatctcactgggagctgcagaccacagctgttcctattcggccaccccgacagccacatcctgtaacttcttccagcccctacccatcatccagttctaaggctgcttccacattttcagatatttgttgtggcaacaacaccactttctggtactaattttctttctttgttttctattgctaaaacagaataccacagactgggtaatttataaaacaaagatgttaatttaactcatggttctggaggctgggaagttaaaaaccattacacctgcatggggtgaaggccttcttgctgcatcacaacatggtgaagggcatcacatgttaagaagggaagaacaagagagctagagagagcttgcttttataacaaagccactcctgagataacaaactcactcctgatagtgacattaatccctttatgagggtagaagtattaagtttccaacacatgaacttttggaggatacatttaaaccatagcagaggtctctcagatagcagtttggagtaaatttaaacaagatagaagtggaaggtggggctcattataatctgatctagtacaaagtgcctgggtctaaatcagaaatacctgggtttgagtccttgctttgccacttattagtcgtgtgacctttggcaaatgatatagcttccgagtttagtttgcttatcagtgaaataaggatgacaattcctacattacagggctatggtaaggaaataataataataatgataataatcagacttacagcatatttcacgtggctggcatatggtagatgctcagcaaatgtcactttcctttccattctcttcttatattggcagtttgcccttctaatggttcctggaatagtgtgttgtgctcctagattttctcagcggcctcttgtttggttcttgttttcctcagatgactttctgatgtttacttagtttccttagcgttttacttctcatttcaatttgacataaagcaatgacgtaaggaccaggtacatttttctcaccttcatttattgtggcccataaagcttaaacatgttggcttgtggactgcagtgtactttttctcaccttagatgttaagtatgtgccccatggtagagttactgaataaaaatttctgggagtgggctctgattttgttaagaatggtagaatatgttagaataaatactatcataagctcccttgattattcttgtgcatactgaagttggagaacgacttaagcctgtgggctttaaggttgagcgcctcggtttctaactggctgttggccagagaccacactcagtttcttgccacatgggccttaccaataagactccttgcttattcaaagccagtaagggagtcacttagcaatataagggttacattttgatgcattgtaatcatgtacacataatcaaattcgtcttatcaccttggcaatgtcctgttggttagaagcaagtcaggatcaaagggaggagtttatacaggggcgtgaataccaggaagcagagatcatgggggccaccttaaagcctgtccccatagaatgtgaggggagaggggaggtagtaagttcagttgtctgcatgtgacatttaaaaaacttgtgggcaaaagtgggtttataatgaatctaaagaagttttgggtgatttattttctctcacaggagaagactctgctgaccagggctcaaccctgacaaaacaattttatgttcatcattttgtattccattcctaaaaagagtctctgaaattgtataaacttgaagcctcaccaaacattgactttccctgcctgtgggaaagcttcctgggtctggagaatattctgctgcccagggctcaccctgaaaaacagccccgagctgtggcttgcatatccctggcctagcagcttttaccaggaggtggccattagcaatggaaatccctaaaccatgatcccaagcactttctgaagagtggggaggacaagttccagaagactgcttttgtatcaggtctattgttctttgggagctcatgttaagcagaggagaaaaattgacttctcagacaagcatttccctactcttctgcacccaccgtcagttcactaggcatctgcatctccagggcaaacatgcctctgaagactgctggagctagtctcctgtgttgtggccagtaagaacttttgcacatttctgcctttcttcctgtccccagaaacttacagtccctaccctagaatggtgagtcaaagtagtccacggttagctgcagtgtcctgaagataactcatggagacaaactaaaaagtcaaagaagttgtatccctccacctgtcatctgagtgttgggggatttctttgcttaagtgggtgacttgggagactttctttctagtagatacttgttggccagcactgacctggaagggcctatagagagacagagctggattaggctctaaagcgtcttcagtgctgggtctcatgttattgcatgtaaattagagatccccaatatcaaaatgtagctattacatgacaattccttttcattaagaagcaattgcttttcattaagaagaggcttcaagacacaggagccatgcaccctgagggtatgggggtgtcattaatgcttaaggtactaaatatgcacacctagttttagctatagactaaatgattaatatggcctgtatatgtgctcctgtttttcacaagtatatgcatactcttgtgatggcaggataagtaataagctctggaaccagactgcatggtttgagattctccatctagaacatacaagctttgtatgtatgtataatgatgctagacaaattgcttaacttctctgagcctcaacatccttgtctgggaaatgaatataataatagcatgtacctcaaaacgttgttgtctaccttatattaaatatttttttaaaaatccttagaacagtccctggtacaaagtaagtgctgtatatattaacctttattactactaatatacaaattaaaagaactacccaagacatggtagctgcttgcagtttgttgttttctcaatcaaaatatattgaaagcacaactgctgctgtgttccttaaatgagcgcagagccagggacagggcctagggctcctgactacacttgccgcatcatttttactattgcagattgcgtgttttgtctctttgcttaatgaaaagcaatcacaccttttgttgttattaagggcttattgtcatttaatggctacattttgctattggagacttttctaatttacaagcggtaattgttctggacacgtgactctcatttagtatctgctgaagagcccttgttcataattattgcttccgtggttatgttatgtatttatccagccctttctttagacaattgatatgttgtcctggatacctccctgttgctgatttggagttggtcaatccatcgcttcatcagtgctcttaaaataatgagttatggcatgctttgtgatcagcacataatgttctgagtggaaaaaactcatggcgactctcaggagtgctattttttgtccccttgcccactcctgcacacatgcttgcttctgtttagccagaacctcatcttgctaatagtggtcataggaaattttctcaccaatgggacctatgtgtgcatatacaagggggtagtcatggggtgttagatttcaggtaaaatcagaagacttttttgtgtttggtcttttctcaagatggtatctgtgtttatttcctagaattgttgtaacagatgactacaaatttgattccttgaaacaacagaaaatcattgtctcatagttctggaggctagaagtctgaaatccaagtattagtaggactctaggggagagtgcttccttgcctcttctagcttctgctggttgctaacaatctttgacattccagtctctgcctctgtcttctcaaggccttttcccatgtgtgtgcatgtatttcccctttctctatgtccaaattttcctctacttataacgataacagtcattggattagggcccaattaacctagtccactatgacatcatcttaccttgattatatctgtagagactttatttccaaataaagtcacattcacaggtacttgggagttaggatttaaacgtatctttttgggggacataatttaactcacaacagtggcttttccttgtctctcttatttttcctagtttttaaattttaaagaagggaaaactcccttccacccagtggcacaggaatgagttgatttatatggattaaaagtcatagatgttagaagaggaggaaagtcctagaagaaattgtagcccatttctttcaccaactgaggtctaggggagagggggctatttggctaaggtcagaaatctgataagggatagagccagtcgtcagacttcatttcctgattctgagattaggataggacttttttttttttttcattatctcttcataaaggtactggcaatagtggttgaaaaaccatgtggcaacagacattgaggcaaatttctataaaaccagaaatagctgggaaagcggaagccaggttggacctgccaatagttggaattcttggctgtctgtagagggtgaattgacagccaaaagccctaccaaggtccaaatctctcttccacccatttcagttcaatctgatcaatactttttattgagctaataaccagaagtaggccctgaggattcactgatcacaagggtagagattatccctgcctttacggagctcacagtacagtgagcacctaaacagtgctagactccaattgcctacttatttttctgagtgcagtaagagaaggacatagtaggggcatccattttgaccttgggggaagggaggtaggagtgggggaaggtcaaagagctgagatcccaaaacatgagtaagagttacccagtaaaggagcagtacaaaaggctgcaggtgaaggagtattcctgacaaagggaaggctttgtgtgagggcttggcggtgagagagagagaaacacatggtggaaaaacagcacgaaattcagtttgcctgaagcacagggtctggggggcatcaagaagagctttgtaaactttgaagagatttgatttttttcccctgggcagtgggaagtcatttcaggtttctgggcatggagtaggcattcagactggggatcccaagtcccatatgatatttaacggagctttattctaaacaaataaggcttcagggatctccattctgggtagatccacctttccaacctttccccccacatatttgttgattcacaattagccacagtgcttgatcgggctctagaaccagagtcccttttataatgttttcaggttttagtctgtggttgaaggccactgttcagtatgtatatttgtgcacctgtgtgctgggcccacatcggaggcccagtacatactggcctcgtcgtttttttttttgtttttttttttaacttaatcacatcggtaatcgccccggggcctcctccgttttttttttatgacagttcgctctgaatttaatgtttgtctggatctgcttttacctttcctgcacatgatttgagctatggtttgctcttctcttgtcgatctgatcccatgtgttttccatcttcagggaattcctcaaattctagtacacagaggcaccctcctgttacccagtctctgttaatggtgttacagttagctctcattcaggcaatggagattagcttatcttaatgtttctcaaggctttttatttttcattattgctcccctaaggagcctttctggacatttttcctaattgtaggacattttaataccatgacattttaataccagagatatactatttatgtgttgtacctatatctgtcctttatatagaacaaggataagtataaggcctacttactctttttataacatgaaggattaagaatgactaacgtttgcagttaacaattaagttaaaaattaaaaagctattaacaattaactttgtgtgtatttgctgagtacattttaatttaatttatttacttaaaaattccagtgtatcaactacatataaaaattaacaatttatataaatttgtaatatttaatagcaaggtgcttcaatgtttaaaaaattcatccaaatctgctctttttccggcgaaagtaaagtaattgaaaaaattaaattagcttcttaaaaaattttactgaacttaacatttaactactgcttgatatgggaaaataacttctaatttaactagctgctagacagtcattcagatcttgctaacagtttttctttatatttgacataattaataatgggctgaataatgttattagaattaaatgataacatataaactgaagatcaaatataaaccacattgacaaggcagccagtggcagccacctctgccatttaacttttagaatgggcgatcaatggagagaaagtttccaatcacagtcatctattcaccgtagttttctagtactgatctggcacacattttgtatgtctactatgaagtcaaggtcagtgttactagtatgatacccaagaaaacacaacaggagaaattaaataacaagctgtaagattttgttgggtaaggttgagctctcgagagccaaaaaccattgtaatatgtaagttttttttttttcttccctcccaaagaaccaacttcaaccctttggagactgtattgaccctttgagaatgcgtggcttatctgattgtgtcctcttaggagtcttaacttcctaacatacggggcccaggagagctaagtattaaaaggatatggacagagtatgagaaaagattcagtcatgagacattgctgtgggtgtagcaccctttgtgggccgctgaaacaagtggcctaggctactagcatgaggttactacagtaatggagtcaaagcagaattaggggctgctccttggagttcttgtatctcttaggttcactgcatctcagtgcttatcatacaatgagtagttggtattttataagttgtctggtctatcagctctgtgcaggcattggctgtttctatcttgttcctattgccagttatctagcacagtgcctggcacatagaaagggctcagtaaatatttgttgataggatagagagaaggcactgcaggtggactcagcctacttcacaggctagatgagggctagatacaataacaggaaaaagaagattcactatttgaaaagaatcccaagccaccacctccaaacaaagccttctctttaacaccacctcatctctttgagcaccagggagggagtcattgtggataggtgggtttgaccatttgccatttagatagcaaagcagttttaatttgaaaagttttagtagtgtctttttaaaatgtgttagtcactactttggttttttaaagcaaatactgctgaatatattttatcttttgttggcaacctagaatcttcctaataagtatcagttcttgaggtacggggatcactttatcctgcaacaaatggtctgagaccaagaactttttgagttcttgggctggagtttctgagtttttctgtcttcttccctggcaggctagcagctatcactttgagttgttgttagaggcctactggtagcacttgctcactgtcctccctctcatttggtagttctaggatattcagatggagagaattagccaaccctgtaaaaactttgtgtaaagtaggagaatggaagttcctagtgaggagttgaggagttctcctgtaaataacaatttctgaaactttgtgtgtaggtgtgggtgtgggtgtgtgcaattgtgcacctctacagaatctgttttgcccttcttcccattatcacctgagttctggatgggtgacatgcactgataggttttgtgctggataagcaagtgattagtatcatattttctcagaagagtttatggagagtatgtacatgaagtttatttttgtcttaatggactgtccaagattcctttaatgggggctcacctttaaataagagaccacagatttccaattaatagaaaaagtaacctatggggatctaggttgttttgtacattgtggactggtacctgctcaaataatcttattcagtagcactatccaacagtgttatcaagaagtgctaattaacttttggttggggaaatgtaattacttgaatgggaattttgacccagatacttacctgttattctcaggacattctaaacttaaacacagttttctttcaccaaacacactttagtaagagataatatcagtagctcttataagtgtgaacagtaccaattttcagcatatgtgaagattaggttcctatgtacatttaacaaagtatttccaatgtaacatggcatgtggcctccctttgatgtcaattccatatttctgattttaaatccttaatctaatgtattgcaatagtacatattatgtgcacaggtctagaaatggaaaacctttgaaatggtgcaaattaatgatgtgttaagtatcacaatttgaataaagcagtgtgaatatcttgaaagaataaagggagagtaaagaatagaagaaaaacagggagggaaaaggaattctcaagggaaataatagggttgtgtaaatacttcaccaaatcgccaagactgacagcagaaaaggtcaaggtcattttaaaattgcaggagactcagttcaagttgcctttgagaagtaatgatgttttgagcaactcaaaactgaatttaagatttggtattgggggcaaaaggggatcacagaaggactccaggcctgctacctcattgtctgacaaattcctatgttctgggtctggggtcaggaccctgcccatcctgcccccattattgtcaccatatttcccaggcatccaagcctctgtgagctggtagggtttgttatgcacttacagcaaaactgacattaggagcacactcagtacagctaacagatcaagtgcaggttcctaaatgtgggcttgttgaacatccctggcctttcagtgttaaagatggacatagaatatttacttgtatctgttttttcatgaaggcttttgatactttgccatgatatttcatgtttttccttttttttttttttttttttaaaccaatggctgctacctggcattagaaagccaaatcacattatagcattttggatcagagctagttgtgaaggcatttttagagtagtttttttcagtcattctttcccttttattcattttaaaaagctggcctttatgatttattatgtaggctgcacacaacaaacattccctcactgggatattctatactcatcactgagaaattttagcaataaattatattccctaagtgtaaggaagcaattcctgggtagtgtatgaagttctactctgaataggcaggtgtgtgttctgtatggcactgcccatgtgggtgtggagtgaggaaacaggaaaaaatgaaggcagagcagtcacgggaggagggcaatggctgagaaggaaaacagttatcatccacttctgtctctcattttccttccagttgctcctacttggttggtaagtgtctaagtacaaagccctccataagcccaggttatcctcctgggaaaggggcctctgctactcttctacctttgtagaaagaaaggaggatgttcacatgagcctgtcacttactgtgtaccttcacacatgctctgtatactgtgctgagtggtgatacatccaccaaaattcatgtctacccagaatttcagaatgttgccttatttggaatagggtttttgtttgtttgtttgtttttgtttttgtttttgcagatgcattaccttcaatggcaaaaaaaaaaaacccagagttacttttgcaagaacctagtaatcaaattaatacaaggtcatacttaattaggatcaaccctaaatccaatcagtggtgtctttataaggagaaagagatttggagacgcacggagacataccaggccatatgaagacgagggcagagattgaaatgatgcagctactagccaaggaagcatgtctctgttgacaacttgatttcagacttctagcctccagatctgtgagggaatgcattcctgttgttttcagacatccagtttgcgattttgttatggcagccctaggaaaataatacactctgttgataaggacttatggcaaccctgacaggtggatactcttagatgccttttatgtctgaaggtcttactgaggaagctgagtcttactgaggaagtcctgcttcccttgcagcacaggtatgtggtaagaacctgtgatgggcttggtgctttaaggattataggtggcttaagtgtaggccttgctatcagcaagctccctgcagatgtgtgtggtggggagatggaacacggaggaaatcgacttttccaataggccctgtagcactaggctgcttgccctaggctgtcttcatctgctcatagacttttggatccctttttttttttttaacttgtttttaaattttttatttccatagatttttgggaaacaggtggtatttagttacacaagtaagttctttatttttattatattttattattattatactttaagttctagggtacatgtgcacaatgtgcaggtttgttacatatgtatacatgtgccatgttgatgtgctatacccattaacttgtcatttacattaggtatatctcctaatgctatccctcctccctcccccaccccacgacaggccccggtgtgtgatgttccccaccgtgtgtccaagtgttcttattgttcaattcccacctatgagtgagaacatgcggtgtttagttttctgtccttgagatagtttgctcagaatgatggtttccagcttcatccatgtccctacaaaggacatgaactcatccttttttatggctgcatagtattccatggggtatatgtgccacattttcttaatccagtctatcattggtggacatttgggttggttccaagtctttgctattgtgagtagtgccgctataaacatacatgtgtatgtgtatttatagcagcatgatttatagtcctttgggtatatgcccagtaatgggattgcagggtcaagtggtatttctagttctagatccttgaggaattgccacactgtcttccacaatggttaactagtttacagtcccaccaacagtgtaaaagtgttcctatttctccacatcctctccagcacctgctgtttcctgactttttaatgatcgccatgctaactggtgtgagatggtatctcattgtggttttgatttgcatttctctgatggccggtgatgatgagcattttttcatgtgtcttttggctgcataaatgtcttcttttgagaagtgtctgttcatatcctttgtccactttttgatggggttgtttgattttttcttgtaaatttgtttaagttctttgtagattctggatattagccctttgtcagatgggtagattgcaaaaattttctcccattctgtaggttgcctgttcactctgatggtagtttcttttgctgtgcagaagctctttagtttaattagatctcatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaaaggttggatcccttttttagtgtcttttcttgattcaaagaagattaacaggagacaagtcaatctgaggaaattcagatagaaatgtgcccccgctgctctcacctgattccttcctgacccactaaagttgaagaaacaatagcttaattttcctggaagagggtgttgggatctaggaaagctttttagggatgatgacatttgaggtagattttgaggaatttatccagttggagaggagggaaggtggagagtggaggcattggtggggaaaggattttaggtagaggaagggatgagaggaaaggtgcagaaagggaccggtgctggtgggtctggggcaccactgttagtaacacacagttggagtgtaagttttatggcttgaaggggagtagaggcagagggggaagaaagggaggttgacgtcatgatgaacagcatttttgaagcttttttctcctatttttaaatagctttattgaactaattgacatatgacaaatagcatatacttaaaatatacaattttataagttttgacatatgtatataccatgaaaccatcaccacaatcaaggtaatgaaaacatccatcactctcaaaagtatacttgttcgtttttgctatccctctctcccagcctctctgatttgatgcccatttgatttgatgctgatttgattcctcctcactagagtccctttgagggggtctgcaaaatcctgcctcttctaattacatatctgtgtaatactggagtttcttcatgtacctcagctaaaacaaactaccataacaaatcagatgcagaaacaaacataagaatccagctgtcctccattaacccagacattaaagagatttgcaaaaatacaaaaccgtgttgttttgacctacatttttggttgttttgaaaaatatggttatgtttcataaaactttagttatttttcttaaaaatatgttacttatgttaccatgtaattatattatttatatgaacatgttgttggtttattattgtgaatttcaagggaattgatacctgaatatttaaaaattttttgtttttatttataattcaatatatattgacagatgtagctcacaaaatataaggtctttggagtactgtttttttcccccaagaaatcaccctttttttctctgccacatctcaattatttttaagattctgagatcgaaaagcttgatgatcgttgctctagaggctttggtaacatgctaacatttgtggaatttctttccttaactaatggggacctgttgaagatcttttcagcagaggaatgaggggatctgacttgcttttagaaggaggactttggcagtataaggatgggggaagactgggcagggagaccaggaaggagaccattgcaggagtccaggcaaggcagaatgagtgcctgactgcagtgcatgtcaggggggtcttctggagaaagtgatatggcttgaggaataatcaggacaggaggtacaatctcagggctttgtttctcataggatgtgaatgtgaactggcttccccaaaaggggagtgtctcaggcagtggttaagagagaagcaacttcttgtctccagggtttctggcttgggttgtggtagaacaccatcagagtagaggaaaagggttggcaagggctgggctgaacttaaggtcagagttcttttcacacaggccaggagggggttcaggcttccctgctcaatgggcactcaatgcatagagtgagactgtggtgagggttacagctcagtgagtacgccatcccaggcctgaggctagcagtgccagtgagaacaggaagggagagaaggaggggagtgctgcaccctgccagggctacctttccttggctttggtgtgtgtgggcttcagcttgcatgttggtggtctgcagagctggccactgggaagggaagtgaactaacagaaatttgggggtggcaggtgcatattagggtagcaagaagagaaaggcagtcatttgggcctggaaccatactagaaggcagttaggagactggagagtttgatttatgtgatcagctagtatgtaggtccactgtgcatggaagtcccttgggactagattttgatgcatccccaatctgtgctcaaaggctccagcaatgccctagtggagtctggttggagcccaccttggagggaagcagtcttcatcacctaaaacagcagcgccttatttaggttagtttgtcttcaagtccagagaacattttgggggacaagcaggtccaaaatgggatgaatgggggacatcttccctaattgaacagtgagagcgcatccacagcgtggggaagacagacaacacagagtgtactgaagtacttccttttgaactttgttaaacctccgctaatttgaatactagtaatccaaataatgtccattcggataaaaccagggctataatatttacttttgtaattatgttatatatttgttaacatttaacatttagtcaggcctgtgttgcggttgctgtgtggaagcttatcagtttttgcaaagtgtggaacacctgtaaatgatgataggcaccttgttgatgactgtgaagcactggggctcttccagactactaggactattaccataggcatgagtaatatggaatcagtaacccagattaccacataaatatccaaacacaaatgagcttagagacttctggctcccctttcaacatctttatagcctgattttcagaggcaggatatttcccactggtttttattctcatgagtaccttgcattgcttatcctggttatcaaacttagggcatatatagtgttcacagtgctaagccctatctttgacagtgtgctgttataacattttattttgtatggccttagatgattctccaaatgctgagtcttttcattaaaaagtctatcaggacctctacttgcaaatatttctttttgtgatatgtggatgatgacatatcaaccatccaagatggtgctggatttgaacctttttctaatagcagtgggaagtcattaaaggattttaagcctagggtaacatgattcaattttcagttacatgcgatatgtggatgatgacaaccaccaccaccacaatgaaagtaagaaaaaactgatcagtgctttttctgttcttttcttatgttattgcatttaattctcacaacaacttttgagacaggcattaattttactcttctacagatgaggaggaaaccaaggctccaagaaataacaccacttgccaaagtcatatggcttgaaagtgaccaagccaggaattgaattcaggcaggctggtggcctttcttaaccattacattgtacccagaaattgaaaaccactttttcccccaaactgttaagaattagagagatttggtactctgccagtactacttactggcagattttgaaaagccgtgtacttaattaaagttttcctgaagagagtactttgctattctctgaaagtttacaccttccctatttttattgtctgtgatgatgccatttatgtttttatgtggtggtatttttatctttttctttctgttagctgtcatttttacctatagaacctgtggccaattatctgtgccattttctcacttgacaactaaaatattgacaataaacatcagtcattgcttgcagcttagaaaaaaatgcagtgagacacatttatcataactgagttttggaaactagctgtctttatattcaggtgacagacacacttgtaaacaactgatgtttacagcaccaacttagatctcacaggaggaatggggtttttttcacttgcctatgtattcttcaggcagaatgtgtaccttaagtgtttgagcccggcaatgtcttcagtctgcctgagctccaaggttctctttttcggcttcttaggctaatcagtgtgtgggtcctagggcacacaaaacccatgacattactactttcatagatgttaatgtgatctgagctgtattataaggcacttgcccttagcagttagttaagaaatattcactgagtacctattatgtgcctactggaaaccagagtattgaatagaatatatatggtctccatgttaatggtttattcagagaaacagaacattgaagaactaaatatacataagttaataagagaagtaggaagaaactgcaaaggagatgtacaaacctgacggacttttccaggaaattgacttttcagctgggatggaagaatgtggaggggtcattatatgatgagaagggaggagagctttgcggttagagggaccagcatgtgtgaaggcttatcagtagaataaacaataccatgatagagaaacagagaaattcagcagggctggagcagacagagtgagtggagggtggataagacggtgctggatttgaacctttttctaacagcagtgggaagtcattaaaggattttaaacctagggtgacatgattcaattttcagttacattttgaaaaggtcaatgcagttactattcatttcacaggtaattattgaacatttactacattccaggcattgtcctcggctctgagggataagccaaataataaaatagacagtgaattccttgcttttgtggattttatattctagtggagtggagtttggagatagtaaagaaaccaacaagtagaacatatcacatggtgaggagtgctatgaaagcagcaaaggtccaagagtgtgcccttggggaaagggtgccaattgtgtgtgtgtgtgtgtgtgtgtgtgtgtgtacactcttatctatctatctatctatctatctatctatctatctatctatctatcatctatctagtggtgaggaaagacctcgaggaaaagctggcatttcagcaaaggcctggtggaagtgagagattgaccatgaaggaaaagagctttacaggcagagagaagagcagacacaaggcccttaggagaaaggagaattggcgtattcaaggcccagcaacaaggccaatgtgacagaaatggagtgagcaaggaaatgcggtggaagatgacatctctgagatagtagggacccagatcatggagagcattgttagccagtgtaaggattttagttttcatgttgagtgagatgggaagacattgggggaatgataaaatgcacatgaagtgttaaaaggattgatctgattgctgccccatctcccctcccccatactgcctggatgctccgttgaaatagaccctaagggacaaagtggaagcaaggaaatgatgacttggaccaggggcttcttgtaaaggtggtaagatggaatgacttactacagaacacatttgaaggagggtgagaatagaagcagggagcagcctgttgcagtagatacattaggagactggaagaaagctgatggtgttctggaaatgaatatgggcctggagatggagaggtgtgggaatatcagatagttagttagaacacagagctgacccacaggactttgccgatgggtagcatgtcaggaatgagggtgagggaggagtcaaggatgacttctgggtgtctggctggagcactggggtgatgtcatttattgggaccactaggcacatactagtttggtggtgaggtgagtgaatgactccactttgaactgggtttgatttggaaattcctatgaaatgtgaaaggggagaaacagagtagatcattggatatatgagtctggatttcagatgtttgacccaggctggagatgtagatttaaaggttaatgaggaggaagatatgaatgggaaatgaagtcctggattatggatgatcttgttgaagagtagagtgagaggagaaaaagatatgaactaagttgagtaacacctcttttaaaggttgagaggagtagaatcagtaagagacatagaaacagaatatttaaagacatagaaggaaaatcaagagggcatgcttcagacaagccatgtatagggtgtttcaaatagtaattgtcaatagcaatcaccatactctcttgcctctgtgcctttgtacgcatttttctcagtacctagacttcccttctacccttctctgtgtttttctcttacggtatgctttatttttcctttcatgcctagcaactagtatattgcttagcatgtagttctaagtaggtatttgttgagtaaatgaatggatgaatctataatggacccataaagatgacaggtcttactacatttaggttacctttttctttaaggtatatttgaatcattttaagataagtagaacaaataaattttccccgctttcaatccatcaccattgtgcaatcctgaaagcttgaacattcttggtacctttaactggatgccttcctttgtgtagtctcctttttaagcctgtaaggaatttaacactttgtttaatagacttctttaaaaatatgctcatgttttgttggactttgagtgatctgttaattcccaggtaagcatttctgtgtgcacatgaagatgcataactcatacctatttttgtggactcttgggcatttcatacagttctctgcagatagtaaggcactcaatacgtctttgcctaactagcttagcagtgtagtgatgggtttatattaattaataacaggtcgggcatggtggctcgtgcctctattcccagcactttgggagactgaggcaggcagatcgtttgaggtcaggagttcgagaccagcctgaccaacatggtgaaaccacgtctttagtaaaaatacaaaaaaattagccagtcatggtggtgcccacctgcaatctcagttactttgggaggctgaggcaggagaatagcttggatccgggagaaggaggttgcagtgagccgacattgcaccactgcactccagcctaggcaacagagtgagactcttatctcaaaaaaaaaaaaaaaaaaaagataaataacaagtgtgagctggtatagacaaactggtttagaatcaaaagacctgggtcagagtccacgctgtgtctcgtacagattgtgtgatattggcaagtcattggacatccttgaacctcagtttcctcaaatcagaagtgagaatcattttaaaaaggttgccaggaggatcagatatgaaagtgctttgtaaactggaaatccttcctctgtggtagggaagcttgccattgaaaacccatccaagcattctgaggcctggggtacatgatctgtacccagtctatgctgttgtttcccctgtactgtgtgtctgtaagatatgggtgtattattaagtgagctctggtggctgccttaagccctctgtgtacttgggtctctgtggatggagttgttcatgtgaaaataactgatgggctgtaggtcacagacctgctctttgagcctagtgtggacctgcaatgagcagactttttgtccttggtgcagaaatagcctctgacttgggagagaggggcagagtggccaaatcctgctgtcttacttcttcaattggtttctataatagcttctctaaggtagggagtgctatggttaagaacttgggctttgtagtaaagcagaagtgggtttgaatcccactgctagcacatatttggtgtttgggcttgagaaagttacttggttcctctaaccttccgttttaccatctgtaatttggggataataagaatatctacctcacagggctattttgaggaataaatgagtgaagcatgtaatatgcttagcatagttcctggtgtacccagtaagtgcttcataaatggtgtgtactattgttattattgtttatgatgattccagtgggtcctttcaactttgcattgacaaaggatagtccctagtcaatcataggatatgggaacaacggaaattccactttttaaccattactctggactctgtctgcaaagatgatgattggatcttgttcatttctgcattctcagggctgaggctagtgcattggccagtgagcaggcactgaatacagggcagagaacttgaactggccgtgtgaccattgcttcacggtgatctaaaatgctttccctaaacatacacacaacacctaactcattagatgagttgttgaagtgggtttagcctgctgttgcagtctcaaaactccatcagtgggtgccagagttgacacaatcaaaatatttcttgaggaaagaataattagcaaaagtgagtgttcctcaattagggcctgagggttctggtgctttgattatttccaactactcatcactaggctggatcccaagtggaatacttgggtgggcttctgtgtgcttagccctaatgagtgtggcagtacatctggtacatgcctgagttctaagtggtgaagaagtctgtaacttagcaattgcacagttaagtagctgcctctggagagtggatggaatcaagaaaagggcccagaaatctctgcataaggtactgcaagaatgcctcttgagaacttttggaaatttggttggtatgtgttctacaagttcagttgcttgtttgtgtgtttgcctaaccatgcagtttctgctgccttgttttacttatatgctgcttatataatccccctgaataggcaattgtggtaaagtgtaaaaggcgtgagatctagattaggcagctaaaatatcaaatcatagccctgtttaattgactgtgattctgggcatgttgtttagcctctctgagcttgtttctgtctgttaacaattagaataataatgcttatgttccagtgtgattgtgaaaagtcatgggataacataggtgaatgacctatctaaatgtctggcagtctcaggcttaatactaggtgtaatggattgtgcagaaaagagttagcagagtaggcctgactgctatctgttgacatggttgggccttggctggcatctgggaattcgtctttcaggagggtttccaccattctttaattgataaagtgtctcttggtgcctaagccatttgtacaaacactgtcatttttaccaaacacctgctttcctctggggtttttgacattttggtatgtgcttggcagaaagtgtctacatgaccaactctctccaaaaacccttggcactgagtctaatgagcttccctagtagatgacatttcccatgtgttgtcacaacttgttgctgtgagaatttagcatgttttacgtgactttactgggagaggactcttggaggctctcacctggttcttcctggactttacctcatgtgctttttccctaggctggttttgctttgtatccttttgttgtaataaattatagttgtgagtgcaacaatttgttaaatccactgagtcttcctagcagattattgaacctgggcttgatcttgagaacctaacacattgatacagatttaaatgtagaacacatgtgttgcccttcagaacactcacactttactgcaaaggcatacagagtcatataatggactttagagactcagaacggggagggtgggggggcagggataaataactatacattagttacagtgtacactactcaggtgacaggtgcactaatatctcagaattcaccactatagaattcatccacgtaaccaaaagccacgtgtacaccaaaagctatttaaataaaaaaatatattgaaaaaacaacactcatacttcagatagaaagcccaacatgtaagcatataattacaatacaatgagtgatgttagtgcagagggcaagggtagccctgaagagtagccctggggatctgggagaggtttttggaagagttaacacttgttaaatcttgaaaggtaattagaagttaactatctgaagtgggaagaaaagagattatatacctttaaagtataacatgctcttctaaataattttagatttaactcaccgctttcttttttttagcattatttaattttattttgaaattttgacatgatgaaggacgtgataggactgatgaagacgtacagagacagaacccccatagggtggcagttgagtggatcactgtgcagatatgaaagtggaagtaaaaacaattctttgagcccccaaatattaggaattggcagtgatgcttttagcacctccatatactatcagtcattttaaacatctaagactcccattgcagaaacatggcacatagagtcaggaaactaaggttgtatagatatttgcaatctgtaactgtcctagtgtcaagcacaagaaattcagtaggtgcctcacataaccaagcactgatcattgataccaagaccagatatgtgatctaaattagcaaagacacactccatgctgctttgaaaagaattaccatagatattatgcttttacatgatcatctctttcagcaacaccaaattgctctatcacccttcaattcagatctccgcagtaaaatgtttttaaagcaatttgcagcatttcactttctgtggaccacaccctgcctggacagtcacttttacaatcatcactttcttatggagctaaacaggtgaggatcagccccaggatactagaatcttgaacaaatggatatatagccactctaaaattgcaggtaggctctttcactcccactaatacctacaagacattgcaaatagaaaggacagcaggactggccaaatctatctttggctttctaaagtcagtctcactgtgcactgctctctaccagagtaagactcaaggataaatgattttagtgaattaaagagtttttaaaaataaagtaatgaattaacaatttaaaaagaatgaatgagcagttttttttttctgccattcatctgagctcctgtgaaatagttccaatcaaggttctgcccagttaaaaggaggaagagacctcagaagttgtcttgacaggccggttgcagtggcttacacgtgtaatcccagtactttgggaggctgaggtgggaggatcacctgagatcaggagtttgagaccagccgggacaacatggcaaagccccatctctacaacaatacaaaaattagccaggcatgaggatgggtgcctgtaatcccagctactggggaggctgaggcaggagaactgtttgaacccgggaggcagaggttgcaactcactgctttctttacaagggtttaatgactctatgtttaatcattcatcaaacacgggttgagaactatgccttaaactactctacgttgtgtatcgggctccaataatgaacaggaatggtccctgctttcaaggagagtctggcagtttatgggttgacatggttggattttgaggaaaccatgatgcaaggtgatgcaagggacggggtgtaaggtaaagcattctgtgagagatgctatctaggcttaaggggaggtaactttctaccagcacaggagaaaggcgttccatgaagaggaaacagcatgtgcaaagtcccactggcaagagagacctgatttcttctgagaataataaatagttatgtggatctgcagaatggcagatgaaggggatttaaacaggtgctatattttgacaggtagtaaaatcaagcttgaggaaacagatgaaaggattaaatgagctgtattgaggaatgggaaagaaattggattaggacacatagtattagtacacaataatgttgttgagcatggttgaagacccaagtgaggttggacaatataactagtagtgccaggccatatgattccatgacatatgttctgccatgttgatctggagttagggggttgccaggtgggaaaaatggaaagaagaggcaaagttgttaagaatattcgtaaaataattattgaagtcagggaccatggtatccaagatggaagacaagtgtggcctgatcgatagacttaatggagacttcatagcctcctgactcttctagtttctaagttccagaagagtgagaataaaaggccgaggaaactagtgctcagaaagtaggctgcttcaatttaagatttcagagttgaactgttccaggtgagaacaaactctagtggtcaaagtgggtatgtaaaggtaaatatctttggagatgaagagagcaaggaactcagaggccggaagttggatatgttgtccacatgtgtgttgaagtcacctggggtgaaggtggggcttgtggccaagaggaaacttgggagtcaggtaccacagcccccagtgaatatgagaaggtgcctgtgaggcctaaggtgacagtgatgaggagagagagagagcactataattgcatagttgtgaacctcaaaggagaaaagatacatttcttacaatatgaagccattcttcttcctttgctatgttaagtggagtttgacttgggacagtctatgctttggcctttggatgtataccctttgaaatctgtacaacaaccaccaggacattcctctcactcctttcccctcatcttgggcgtttctcaccagtcttctggtgagaatttttttttttttttttttcacgtggtcccagcttgagtttactgagcctcctccaggctcagatatgtgcttgcctggagaaactgcttccaaaggccaagcagccctgcctttggagagctgcttttgttacttacaatagtgtttcccagagtgcattccatgaaaatattagtctttcaacatgctgaacaatgaaagaatccatggtcaaatcctgagaacatatgtccctcttttagagattcataaggtacattagtatataaagaacctaagagattttgcagtaagaaatcctttgtgtaacctagcattacccaaatgtattttaccactgaagccttttttcccacttactctccatcaatacccagtggatatacattggaaagtgctggtcaattataagaaaagaagtatgtggattttatttcccttgacctatggccatagaagaggtacatattgcaacactggtgtattttcactctactaaaatgagatcttactatgttcctgagtttaaatagcaagaattactacatttggttagaattaacacattaaaatagtttgtttagtctgtcattcttatgtttaagtggcaatattaggaaattaactaagagcatttcattttcctttggaagaattcccatagtcaagattagaatcttaaaatgaaaatatacatttttcaaagtcctcttgctcttattttaattaaaaatgacagcatagatttcaaactaatcacattatttgctcttaaggtagtgataagatttcttcacagatgtgtgcatatcattcataaaaatgacatacttggacttagatacatactttgtaaatgttaaaagacaaaagtactaagaaagcattttgtgaaactacaataaaatgagaaaaaattaagggaaattaccaacatgctctcttacataacaccttgattttgatagaagtgcagatcctaataacctagacattttaaaaagcaaaacaagcataaatatgaacataacaaaatagtgttgtatgttgccaaagtggtgcttggaggaagatacattactctagatgtttatgtcttaaagaaaggaaggccaaatataatgaattaagcttgcacctagatgctttctaataggaagaatgtcagaagccagaaatggtgggcagaggaagtagtaaacgtaaaaccagaaataaactagagaaaaagctattaaatactacatcttgtctttgaaaaaaatgaacaactgtttagctaactaaaaaaagagaaaacacaaattcattacattagtactgagacaggagatcagatgatgaatgtgaaagatttagaaatttgcagagaaacaataaccttctgtatgtgctaataaatcagatgaaccagagcagaaatgaatgacctcctgcaaaattatataaaactcgtgcaagcttaaacagaaaacatgaatagactggtagcaaaggaaggaataagaaaaataattaaagtcctatcataaaatccacacaaaccatgggtttttggctccaatagattaatagaaagaattcagacttctagagcaacgttgatcttttttatttttattttttgagacagggtcatgctctgtcacccaggctggagtgcactggcatgattatggctcaccgcagtcttgatctcctgggctcaaacagtcctcctacttcagcctcctgagtagctgggaatacaggcatatgccaccatgctcagctaatttttaaaattttctgtagagacagggtctccctatattgccccagttggtcttgaactcctggtctcaagagatcctccaatctcggcctcccgaagtgtgtgagccactgcacctagctctgttcatcatttttgactgcctactgtaaatttaatcctttgcacacacacacacacacacacacacacacacacacacacacccctctatattctaatccatacaacaattatatatgggtaccattagtaaaaccagtttacagctgatctaataggctcagaaaggttaaatggcttgcctgaatccctcagcaaataagtgatagagtggggatttgaacccagatttatctggctacaaagtttattatcttttcctatgctatactttctaccagaataaaaaaattctctcataaactgtttttaaatgttgaattgacactagtttacccaattcctaatttacattttgaggaaacatgatttcaatcctcaaattgggaaaaagtacaaaaaaaaagaaaattataggccaaccttatttatggatattcattcttcattaagaattataaatagaaaaatcattccacttacaaatttatctttaagtggcatttaatctaggagcacaggatacgatgataaaacaaaaattatgataatcatattaatacgaaaacgtaattaaaataatatttttaaatagatgttgaaaaagcatccaataaatgaaacaactattcttggataatttatttggcaacccaaaaacgagtatgattttcatatattttggtataaaatctaacactatttcatggggaaaagagaaagtccctatgaaaatagaaaaaattacagatgacaaaaataggactaaggctctaccattttttaacagtatagtagaaatttgagccataggcattaataaggaaaaagtaatgccatcagcaaagaaagccaaacctttcttaataggtctagcacctaccgtatgccaggcattgtgataggtactggggatacactccagaaagactgtgcatgtctaggacacagaagactatcaaatattagttggtataaatgagctcagcaatgtcatgtaattcaaagcaaattaacacatgtttttagttgcaaacaattgaagaatatagtgagtaagataattcatttgcaatggagacagaatacattaaatactttggcattaatttaatttgggacatgagatttatttaaataaaattatacaatcataatgggaagaataaaagacattaaataaatgaatggagagatgccttgttccagatgaaaagacaaaatataagaaagatgcaatattccctgagttaatatatagtgtcactacatgccaattaaagtcccagtgggttattttataagatgtgacaaattgctagcaaaatttgtatagaagaataaggaggcagaaatactaaatagtttaaaaattgttcatttgaagttatacttctgtcacatatttgttcaatcttttgttagttccttgttccctattcattcagttcttactactgtccccgcttcataaaaggtactccataaatattggttgaaagcagaaaggaatccttattgaaggactttgaaaatgggcttgagacggacaagtggctttctccgaaatgtcagagaatcgataaggtggaacatcagggacttgccctcattttaaacaaataaggcaggagtggtcacagtgagaaaggaagagactgttcctgggtctagtagtgtgtctgctgacattttcaagcaaataaaggatctgcctcctagccctctgcctggactttttctcagcatgtgtttgtgttacagatagggccatcatgacacttgggagctcgaactcatcattatcttcataaagaaatgtgagaattttgaacttgggccccagtctggtatctcctagctttcttttgctgctttgggtcttttcagacgcaagagatctgtcatcttttggggcctgtctctaatatgcaatctttctcaagtgccccttacaaaaaatgcctcttcctcctctgcacttatgcatgcagtagtttatttgttctacaaagggcctaaagaaggccatgctaacaagggtgggatttaggctgtcttctccctgttctccactgcatcagtttctgagctgggctggttatcagaatcacttgaggagccttaaaatacacatattcttgaccctggtgattcagatttagtagaactgaaagtgtaatatgtgatgaatatatcatatgatattataaattacattatattaaatatttcattatattattacatattatattaattacataaattacacacacacacatgtgtgtgtgtgtgtgtgtgtgtgtgtatgtgtgtatgtatgtgtatgtgtgtgtgtatatttccctgattattttgctgaagaaccaggtttgggaagaatgcctccatagcatcagccagagtagctgcacagaggagctcccccctcccccaccaccacatttattgaatgaagggattaaattaggaacaatgttcagactgattatagtgttgctatgccaaccgttgttgcaggtgctgaaatagactgcagaaggtctagtaaacacttaaaatgaaatggtccctgaccagcattgtcattattataactaatatttatagataattatttactagtttccattagaatgttaataccagagagcaccactctatctcctattgactgattagcacagtgcctcacacatagtaggcactcaaccatttatttaatgaacgaatgcaacgttttcattaattttcacaatgacattataaggtgggcaattttcatattatcatttcataaatgaggaagtcgaagcagactgacttgttcaaggtcatacagctagtgagcagttgacctgcagttttactccatgtctttgtcatgctaaagcagaggctatataggagaaagagcctttggactccattgactaggcagaggccagaccaggaagggcatggatgtagacagcaggcaccccagacaggatggcacaagcactggggagaacaattagcctcaaggtcttggaaaaaattcagagtatgagatccagagaaccaagtgggcctaggggattgtggtagtatataatgattggtgtcgtagttactgccgagagtatgcattctaggcctttagagattaggaaagaataagataggtatccaggcctttaggaactgggaaacagacagctttggacacagaaacaaaacaagaaacaagttactgggtttggaagatgaggcagggatctcactctaaggaagaaggataatcccggtaatgagaactagagtccaggaccagggcagcacctgcatccctggtcctgagcgtgatcctggtactgatgctgtttcttaagctcttgagtttcttaagcttctgggcaaattgttttccccatttgagcatagtccaggattcaggcttaggtagaataatgcctatgagtcctggctaaggaacatcagaagtggaaagagaggcagactcatgcagtgaaccaagaacctcccttaaactcaaaggagggtgaggttctaaagcgacatcagcctgttttcctagtgatgggatgtggttttgactcctggtatgccaggggttggtgggataatgattataagtatactcttaacccttgtattggcttacttgcccctgaaaggtggtcatatgtcaaagttaccaacatctgctcaagcacaatttcctaagtatgtgctgaaaaataagttaaggggtatttggcatgtcattctccttagcccttgtgactgccaagagtgctggccctgagttgcctgtggtggccagcagcctcagctgtttcccccagcatgccatgtacgattggcatgctgtactaagtgccatacatgaaaaaagttgggaaacattactggagccccattccttgttggcctcttcattactacactacaatgtcctcttccatttgtacaacaccagagtggtggttgtcaacccctttcctgcctcagacctttgagacacactaatccgccacaggtaaagatacctcacccagctctcattctcaagaggtgaagaccttgttctagatcttcccagggctggatatagttggagaaagtactccaggtggctctgaaaaaccttcttgtggaagggggtcatgctcctatctattgagaatcacacatcttagatggaagaacattttcactcctatgatcgcctcccttcctctgaccaggtggtgatatcatctccaaattgtgaataaggaaggtgaggcctaagttgctcaaggttctcacagtaagaaagtggaggaacctgtagtaacacctgggtatggtgctttttttctgcggcactgcaccctccattcctagtactaagattaatacctaagaagaaaatgatcaagtgaaaagccaaggtccatagccatgctagtagatggtgagtgaagtagtacctaagacacattggttgtggtgtcgcgagttggggattggccaaagttgggtgtggtgagctgaaatgaaggaggtaagccctttggacaggcaagaggacccagtggactgggatgtggctcagacaacagacccctggtgaagccattctcagagctgacatttgagtggagaaagatttggaaatagcttttgggcttgaggcttgcagggatgaaactgcccagcaggagcaggttgtactctcctgctgactttcttcagccacacctgtctactggagcacagctccctctagaggtcattattcttgccgacgggacatgactgtgacctcatctaagtgccaaggggattattgaatgctgactttgtgtgacattaaaaatacaggccagccaagcctgttcattgaagcaggatttatttggtaccattttccaggccatgccctgtgttctgggtactcagaatccacagatgaatgagccatcccacagagaagtcactgtcttgggtttcagacagatatttccagcccagtgtgattcgtactttgataggggcaggaactgagtgcaaagtggaggtggagaggaagggttagattcccgatttctttggagcactgacagggcaaaaggtctgggaaggtttcctaaaggaggggactcttgagctgaatttttaaaaatgagtaaggcttagccaagtagaaacaaaaggggaggacgttctatgggaagggtcagtgaacattttctgtaaagggccaaatagtaaatatgttaggctttgtgggccatacagtctctgttacaatgactcaactcggccttgtagtgcaaaaaccacaacagacaatatataaatacatgacctttactgttgtagccatggctgactgctgtcatgtaaagtataggtacatttatcatccctatttgactgtgaagaaatggagtctcacagcggtgaagtgacttgctgaaggccaaccagttgattgtgtgttaagcacctcatctgaacagatgaaacccaggcactggtagcaggggttgagggtgtacatgggatatggcatgtaggtgagctgcagtagatgggcatggactgagctgtgagaatctagaatggtcctagcactctggatctattttcaccctctatccttgtccgttccacctaccagactatccctttctaaggccttggctctgctgtagctgtgtgcttgtcagccatgaatcttcattcttactgtccccctaacacagggccaggcactgagcagatgcccagaccacgtctgcttaactgatttacctagcattcagttaagggctatgggtcctttaaataactctttttaatataactggtatcagattcttttgatatttccatttgttttaattgctgcaacttaatgttcataaaaactaagacatacaactttatggaactgcatcacaaccataggaactgcatcacaacaatgggaactcttccagattatactggagcttccccaaagagaaaaaaaatagttttcattcttaactaattatttttaagtgaatggcaggtggaacactacaacatccataattttgcaagctgagaaagagctgaacgtctttttattgccaaaaaaattgctggtgttagtgacaacagtttttttctggatctgattgaagacatttatgaaaaatcagtcctaaatatgaatattcccataaggaaactgcttctaaggagacttaaaaatactcctgaagtcagatgtgtatcaatttctatttttgtgacttccccccttaacttccataattgattttaattgattgggtccttgttccatgtcgtgaacatttgggactcataattttgaaaaaaaattaaaagattttcttttggtttcatggacagaagcaaaaaacatatattatgtgattttggtaattggactcctgttttggaggctgagaatgtttgctgtctatgcagctgggatgggagttagcagtcgcaccctcttcctaggggaaccatgtgagagagctcccatttggaagcctaggctggttgtactcatcctcaggccaccctcagcctgctttcttccccaaatcctggtttacttctgtggaacatttgtctttcttacttgattatgttaataatagcaactgctcattgagtaccaactctggactgcactccatagagatgcttttgattgagcctcacaaaaaccttacggggaacttattgttatttccacttttccagatgaggaaactgaggtgaggtaacctgtctaggttgactcagagtggaagctagagagctttgatcagaccccagaattgtctaattccaggatctgctgttttcatttcagtggtcagcccacatgtggagagaagttcctatgctcacttgtaggccctgtgttgcaaggcgggtatgatctggacatcaaaagtagtgtatgaggatggagagggtctgggagtcaagacctgtgagggcactgaagggactggatgatgtttatcctgaagaagaaaagacttagagggaagtgagagctaaattcccatatctgatgggccttagttgtgaaaagatttctacgttcattcatacaatgtcttacttgcctcctattatcccgttgttgagggagagattcatgtcatggggttatgtggatggctgaacacatgacgtctgtcactgaacagacaagactgacagcagtttattagccacatatactcacatcccagggacgagggcactacatttcatgcaaggacacatgggggttcactggtgaacaaagagaaactcctgaagaaattgaagcagcagggtctgtgggaggcaggctttgtagtgtcaagagagtggggttccccgttccctgggaagatgtgattggtcggtttgaataactccacactctggcagggaactgaaactccctactcgtatataggcaacaattgtgcctcgtccccttgttaaggaggattgtttggctaggggaccttatctacaagagtagagtgggaaagagaacttgtggttatggcattcaaggccctcctaattttaccacctgcgaaggcagcacataatactgggccttaatttaggacttagatcacatatattcaacacattgttattcaacacattgttattcaacacctgctgtgtgcttagtaccattcttagtggggaggatacagtggtgaacaagacaaagtgcctgccttcatggagctgacattctaatacagaagacacacaataaacaagtatataataccaagttgtgataagtgctttaaaagaaaaaaagaagggaatagtgcctagagtgctgttttagttatggaagtcctctccaaggaggtgacatttaaactgagacctagatatggtgagtgagccattgaacaactggacaagagcatgcctgggagagagaagagtaagtacaaagcatctgtgctcaagatctgcttgttgtacctgaggaccagcaaggaggccatcatggcgggagtgagggggaaggtggcaggagacaaggtttaagagataggcagaggccagatcttgtagggtcttgtaagccatggtaagaacgcgagcatttttaaaaaaatacaataagaagcttttagaaggttttgagccaggaagtgacatgatttgacttatgtttttaaaggatcagtcgatgttcttttgagaataaacttgtgggaggcagaggtgggaacaggaacactgtcctactccaggggaaagctggtggtggcttggacttgggtggaggtggtgagaagttattactttagggcagtggttctcaacgggggtgattttgctcccgccaccctggaacatttggcaatatctggaggcattttttattgtcataatgtgggtgcagggttgctacaggtgtctagtgggtgtaggtcagcgatgttgctaaacattctacagtgcacaggacggcctctcacaacaaagaattatgtggctcaaaatatcaatagtgcctaagttagacaaacctaccctagagatacacacatattttgatgatagagtttgcaagatttgctgatggattggatgcaggtgtgggagtaaggaggagtcaagaatggtcccaaaaagtttggtctgagggactgagtaaatgccagtccttttactaagatgaagaagtcttaggggaaaggtttggatgggagtaatcaagaattcaatgttgaattttgagaagcctgttatatatctaaagattccttagaggagaataagaaggagtagccaaggaggaagaatgtgaatcaaaagagtgctggttacagaagccatgtatagaaaagatttcacgtgtcaaatgccacagaaaggttgaataagatgagtgagaattgcctattggatttggcaatgtggagatcattggtaatcatggtaagtatggtgccagtggagtggtagagatgaaaacctgcttggagcaggttcttgaatgagaatccacctccttatgatttctgtctaacagctttacttctatgtgttctggaatagcacagagaaacttgcacttacaaatatgatatttactcctcaaaataacttcacaccatgattaccatccccaattatagagaagggaattgaggtcttgtattaatcctgtcttttattttctgtattctgatgctttggcatcttggggccttactgaccctgaagggaccacccctcctggtgttagccacttgttagagatggaaaacaattcagtttgagtgtcttttcttatgcaaaccaagcaatacaaagcctataccccagctgccttcattatcagaatctcatggtctgtgtcactatcttcttgcctaatcactgcagggctaggtaccagataactagggacagactttttaccccagagtccacaaaattattcaaactagccgatcctaagcttgcttaccttgccttacccgtgtcttcctgcagaaaccacaataaatgctcttgctcacattttctctcacatcctctgtctcctgactggccttggtgcttccccacatggccctatgtggtgtggtgtgcctcctgcttctagggacctttgagtagtatactaaacccctttcttctgacagtcatttccatgtctgtatacccgattaaatacctgattaaaacaagtcctcagtttggggtggtgactcatatctataatcctagcactttggtaggccaagacgggaggatcacttgcacccaggagtttgagaccagcctaagcaaaatagccccatctctataaaaaagaaaaaaaatagccaggcatggtggcacatgcctgttgtcccagctactcaggaagctggcaggaagagagtttgagcacaggagttggaggctgcagtgagccatgatcttgccactgtgctccagcctggatgacagagttagaccctaaatcaaatatttggtaccattaaacatgactagaaggatgactactttgctcacgatcgtataggtagtgatggagcaacttctgaaatccaaatctccaaaattaagatgcatgctctttcttttaccctgtaaaatttgcttattttacaaatggtgtggagatacaggtctcaagaaaacactataaacatttaaatcctgtctgatcttttcataaagaatgagaattgctaacattttgtgacaagctctattgaggaatagaaagaaatgtaataaattataatgatgtcagaatcataacattggaagcccttaggggaaatgtaaacaacaataaatgattataggcttctccccataccactttctactatattaagtggtcctattgcatgcagagagtcatccttacttgtcagcagagtgccacctgaaattattcgcgagtgaggtcataattgtacgtttatggtttaagaatgagtaacatgcttgttattttctctgcctcctctgccttcattattcatctgtatttcaatagtgaatctggttgtcactttaggcctgacttcagtctgcggctaaggaggcagggacttaagtcctctggctggcccacagcccacagtgcctgaaggcgtaggaagcccaggctctgaagctatccatgggacatgtcccaaactaattgaggtcagttcccatatagacctggggggaaacctgttgggggcctttagcagtgtggcttgaaaatacttttccttgggctcaaacctactgtttctggtgggtggtttaataatggacccagcttgggaggccccagacagcttatcactggttaggggtcatagtgtagaggttaagaccactgaccgtggagccagactgagtggattccaatcctagctcctcttccttttggctttgggacctcgggcaagttatttaacatctctgagcctcagtttcctcagctataaaaatagaaattatggtacctaccccatggggttgatgcatggattaagtgagttagtatacaagaggtaatacaatacagtgattaggaagacaagggacagcatgggagcaacattgcttaagttcataaactggctcaaccactaactagttgttattagtctgtttcacactgctataaagatactacttgagactgggtaatttacaaaggaaagaagtttaattgactcagagttccccatggctggggaggcctcgagaaacttacagtcttggcagaaggctatggggaagcaaggcatgtcttacatggcagcaggagagacagcgagtgagctcaggggaaatggcagacacttatcaaacaaccagatctcctgagaactccctcaatatcatgagaacggcatgggggaaactgcccccatgatccgatcatctcccaccaggtctcttcctctgggaattacaatttgagatgagatttgggtggggacacagagccaaaccatatcactagttgtgggacctttgtcaagtgccttcacctctttgtgctccacttgcctcatctgtaaaatggggatgatgatgataatagggatgttgctaggattaaataagttaacctatgttaagcaattaaaagagtgcctgctttatggaaggactatttaaagtctgctgtcattactattaatttatatcattaacaaaggtaacatggaccacaagagttacagaccctgtgtatttcagagttcagagaaacaagggagctcagagagctgggaactcaagagaggcatcacagagcaggcaggccctaggaaccttgcatagcatgatggaaagcccttagccatgagcctacaagaactaagtttgaataccggctcagccacttgttagctgagtgaccttggacaacttatgtcacttcgctgtgcctctttctctgactacaaaatggagaggatgatagcacgtccttgggaggattatgtaaagtaatacagacaaagggcctagaatagtgcctggcacatggttagtactcagtaaatgaagatgttattcacgaattactactaagcctcatagttgtaatgaatacaaggagtaactctcattattattggcggactgcaagctcccagtgcgaaaggtaaataaggatttgggtaaataaggacttgggaggagaggtttaattcattaattaattaaagacagagtcttgctctgttgtccagacgggagtgcagtggcacaatcatagctcactacaaccttgaacctctgagctcctcccacctctgcctccagagtagctgggactacaggtgcatgccagcatgctcagctaattttttatttttattttttgtagagatggggttttgtgttggtggtctctatgttttgtaaagatggggtctctgtgttgcccagggtagtcttgaacttctggcttcaagggatcctcctgacttggcctcccacagcaccgggattacaggcatgagccagcacacctagctatttttttatttttatttttgtagaggtggggtctccatatgttgcccaggctggttttgaacttgtagccttaagtgattcttctcgcctagcctcccaaagctgagagggagaggtttagatactggcaaaggcaggaaggtgaaaagctctcagggagttctggtggtgatgaacagaccagtttgtatcctttaacaggtttctgaggagggagatttggtttaaggtagggagtgaagggcattggattccaaggtagggaatttattttttaatttctctagtgatagcctataaaccattgagtagaaggcataaagggttacagtaaggttctgttgttttgcttaaatgtcaaaagctataaaactacgatggatctggggcctccttttctgtctgtttcctcttttgtggagtctcctcatttcctaattcagagagttcctaacttatgatggtttgacttacaatttttcaactttataatggtgtgaaagcaatacgcatttagtaagctccttaacttatgatgaggttacgtctgcataaacccatagtaagttgaaaatattataacttgaaaaagcacttttgacttacaatattttcgacttatgttgactttattgggctgtaaccccattgtaagtagaggagaatctgtatgtacatttctataaaggggcaatctgctacttgcttttggccatggagaatgcctgctaccttttctatgaagtgttctctcatcatttaaactgccatatgtactcctcttctcctgtgttcccctataggactgtgcgaactgcagagattcttatcacagcatacctggtggaaaattcattcattacccactccatcccctaccagccttggagtccctagtggacctggactgtgccttgttcttgagatctccttatcccctacgcctagccccagcttagtgccttgtaccaaggagataatatgaagaggatagaatatgtgaggaagcatgaaagaggatccttcattgagcaaacaagtgggtagtgattgaggaaggacaggggactcactgtatgagtcctgagcaacagggaggtattaccccaggcatctgtgagatgtaatgtgtatgtggggagtggggtggtgaggtggatgatctcctctcttgtttagatagctgtgcttctcatttaaaactaatgatagtaacaggaattaacaggagagtgtgatatgtatttctggatagtagtgggtttcttggaaaatggaaggaacacctgcatcagttcctctgagaatacctggggactggagcagtgattttcacacttttaatgtagcaggaccctttaagtgaaattttaagctaagcccaatagatgcctacatgcatggatggatagatagataaaaagataggtccaatatatagatgacagatagataagaatgaccttggataagacacacatccctggaccttgatctcctctgtaccataaagtatagagcttaattgagatttctgaactgctgatattttggatttgttaatttttttgctgtgtaggaccgtcatgtgcattgtaagatggttagcagtaatcctggcctctaccaactctacaccagcagcacctccctttccagttgtgacaaataaaaatgcctccagatattgcccatatgttttctgttgggaggtacaaaattacccccagttgagaaccactgggttaagtggtctctggtgccttccttttttttacttgagtgattactcctaaaaggcctttagcacagtgtctggcacatcttaagttctcagttaatggtagttgataatactgttatatgcttcccttcagtagtattgatagcttggctattcctcatgtcatactgtgactgatatttttaatgttcaacttggtagcacagcgcatcttagaaagccaagtgggctgctttactttcttgttagcagtccccagggaagtatagtcatcagtaatcaggtggttgctatggcggagatgggaacatggtcaccctgtaccattctccctcctgctgtatgttcttcaatttggcctttccttccctcactaatattccccctggtgttcttttctctttttctggtgaacatgacacagtgctaaatggatttttttccccccgctctcctttttcttttcttcaccaacttgaaggagcaggattcaaccttcagcacaacttccagagtgtttccatggaaagacaattaaaatgagcttttaggtttgcaatgagaagggatatttgcttttttcatattaatattcatattttctcaagattcaaaaaatgccaaaacaatattcatgggaagaattcaactactagaaaagacaaagctataatagaattattatagtctgtaatatgttaattacccaaaacaagttggtctttgggataaattagaaatatttgctcctgcatttctttttgacttagaaggaaaaataccaatggaaataaagtatgccagaaatgagcaaaataaattaagaatactaaacctgatgtcataaaatgaacatcccactatgttggaatttatacatttttaatgaaaattagcaatgatcactcattgtatatttcttggtaagatttaaaagtagcccacaataagggtcgggttgcttttagttttctattgaaatcaagacataggttttgtatgacatgcttgaactgaacatttgggaacacttccctttagtctcctgcatagagtctggcgcctagtaggtgctcaataaaatttgttgaactgtattcacagaagtgatcctggagatctatgtatttactcattgagctaaagagcccttcatgattccaaaaacgggagtggcctggtgtacccattatatatcaggtattatccaagacatttgaatcactcatgtgaaaatatttattaagcttctattatgtgccaggcacatgctacaagatggtgaaccaaacatacagtctctgtagtcatggagttcacgtttctagttgagaagacaaacaacggaacaatagaacactgaaagaaaatgaacaattattgaaagctgttgagaaatgtatgaagaaaataaatatttgacctgagaatttgtatcagaaagtcattcaactctagataacagaaatctttcgaagtagtagcttaaatatgtttccttcaagtgaaagatgtctggaggtgagcattccagggtagatatggtagttccaggatatcaggacacaggctccttctggctttctgttttccagagttggaatggggctctcatccttaaagtcactttttggtccaagatgcctgctggccttccagtcaggaaggaggaggatggcgatgtggacgcaaaatggcttgcttaccatataattcagtccttttgaagagcaatccttggaagcctcacctagtgattgtcttttacatatcagttagaaaagaggataggacatgctatctgttagccagatatgtagtcacactgaataaaatgggagctttgttagtaagaaagaaggcagatatggatgttggataatcaactagcagatttgaaacagactggaaggatataaagagtaggactgcatggtaacatttactgagatggggaaggctgggaggaatgggtttagaggaacggcaagagttccatttaggacacattaattttaagatggctgtgagacttccagttgagttttcaggttgacataccactaccttacttctcctgtcaaccccaggttttcataaaagaaggacttatgattgaaagggagagctcagagacttaacatgaaaatgtatctgtataatacatacacttttatcttaaattgtattttaggtatttctaaaaatctcaaagttttctatagtttcttctttcttccagaactgtctaataagcatttagtataagtaaagcactgttataggttttggggatatatatttagaacaaaataaagatctctttcctgatgtagagcattctagtgaggcagacagacaagaaataattaacataaaaataaatagattagttaagtcatcatttatataatattgagaaaacatcatgagcactaactatcattatggatttttattgtgctcagtttcttcactgatgtccttattgaactctcatatcagtcctatgaggcagacttttttttcctcgttgaacagatgaggaaacaggctcagagaagttggataagtccaatgccttgcccatgtgttatctcctccaggaaagcttcctgtttaagtgtttcttccactcacaagccagtgagatcttcatgggcagctactgattgtactgagtttgatagtcctatcccctgacctggaacctggcatatagtcaatgctcagtaaatgtccaattgttgaacacaactggcctacctagtttacacacctagcgtttatttgtcagagccaggatttgagtctatccgtgtgtttgaacagttgcctcctgattcatgtattttgtacatctagattttaggtaattgtattttcagaagcagaaccagttctcttttttgcataatggagcttgcttactttaaggcaaaataactcagatcctccaaggcaaatcattctaaacaaagggcattttttcatgagcttgaattttcccattccctttagcaagccagcttccggttaaccaggccctgaggccttagaaggagacctgagctctctgttttactcagagtagctcatgatgaagtcacttgatgacttgccatcgaaggctgtaaagacattaattattgaaattaagtgggtgttaagagaatccgaagtcacttttgctttgcctagagacaccggagaatctgagaatattggagccagaatctgagaatattggagccagaagggcgcttagtcatccttgtttcagtcttcctcattttccggaagaggaagtagagattcagagtggcaacaggcacttggccaagtcaagcatttagtggcctcaccatctgcctcccactccagtgctctttctattctatcatgctaccacttattcaacaattaaaaggtattctcatcatgtataaggaattgtgaacggacttttactaaagggtaaagaggtgatttgttaaaatgtaaccacgtattttaagtgataagccaagtataatccacccccaacctggtttgaaataacaacatttgtgattgaatattgaatgattattttttagtagtgtttttctatctttgtgttacctgctaccattgcagaatacacaaagagggagtatacttttctttttaattcctgaagaaacattaataattctagcaaggtgggaatgtgctgtagccaagaggtcataggctttggtgtcaggtggcctgtttttaagtcatggcttcacagtctactagccttgtgagcctttggtaagaaccttcttggagctgttggagaacctggcaggtgtaggtacatacacttgaagaatatgagaaggggtggtggagagacagatgatgggttgatctggagctcttgaatgcgactgaatcccacgaggtctctgtggctgaatctagacagggattttgataatttggagcactgttgatagacacagcctccagttggcattggttgtgaacatttacccttttgttttcatgacttagtgtcttggcactactcaaaaagccactttaattttattttctggaatagaacctggtctaaatgaaaacacacacacacacacacacacacacacacacacacacacacacacactacataatcaagtaattaattcactaaataaatattgtgcttactatgtatgaggcactgttccaggtcctggagatgcattctaatggaatgatgtgaaacacaggtaaagaaaaggaagaggaaaataagcagaatgtatgaagaggaggatagcaatgaagatgcttgccatttatctggtgctccctatgggccagacattagccggtactgtgtatacattgtgtcactggattcttacaactggcctataaggcaggtattattatcatctccctcttacagtgcagaaactgagagctggtaaagcgaagcagcttgccaagggttatgtagctagtaagttgtagagcttggatttgagcccagttgtgactggatccagggcctaaggtcttggcaacattttatggggattaaaaaggactgctaatgggtgcaagcttttgtttctgggagacaataatatcttaaggttagactgtggtgatggtttcccagctgtgattttttatttaatatgaaaaatcattgaattgcatattttaaatgagtcaattgtatagtatatgaatggtatctcaatgttgttattacaaaaaaagcagggtaacttgatggttaatgattatggagagcctactatatgttgggcactgtgctaagagttttacaaatactattttatttcatctcacagcagccctgtgaagtaagtgtatcataacccccattttacggatgaggaaataaggactcagaaagattgagagacttgcccaggatcatgtacatagtaagtgtgggagccaggactcaatcccatgtttgtttgactttaaagattatgctttttctgtctttgtaaaataggaaagtgattgattttctttttggtatcaaataaatatggccctggtttttattggtcttagaatttatgaccatttctactactaaatggtcatggaataaaactttgcaatgtttctgccacatcactacccacatgttttatttttccacatagaaacagcccaggctgggggaggaggttgttcatccagcaatttaatgattaagttttaatctattaggcaaaaactaaggaataaaaaatgcttcatgtataaggaatttagaatagggaaaatatattaggtattcgttgtgctcattttccggcagtacagaagcattttattttaaatgtactgttcattttgggtgttatgttttgtttctcttatgtaaactttccccgtttatgagaagcagcagcgtgtgttttttctagaaatagatagcattcataaactgaaacagtttcattggggacattttctgtggcactgcaacagaactgtcttggcagaaatactggaatcctataaaatagagttaatattgatatgctttaatcaaaaatttctgtttagaagcaataaagttattcagtattaggcagcctcggttctatctttatccttactgctaaaacatcttcatctttagagtatgttgctataactatatatctccagattttctttccccagttctaaaagagaactcttaggagttgtgatgctactgaggatctcccagctttgcctcatcggggtggtatgcaattatatcccgtcctcttccatgtctgataacatgatcacgaagttcattttggtgcatcagttcctattgaacacctttgccagacgtgctgtgattggccagaggccgcttctcctcatggtcgcctgaaagtatgctgcatatacctgatctggctgttcccaccagctgggatgcatttactctccctccactctatctctgccttttgagatcttagccatctgtagcagtcaacattcatctgtaggtaccataagctaaaataggtattttagtgctgttaattaggtacttacaaaatctatggggtgggtggaagtgggggctttaggctgtgtctccaggaatgaaacctagaccaccaccacaaaactggccctccaaagggagctgcagctgcttttacgtgcagagaggtggggagttgggaagccaccactggaacgctagatttcaggacgcatagctgatgccgcagtccaaggggaagaagccaccaccactgctactgcaattgtctctcaacacctcaaaaataagtcactggatgctcaaatattgctgtgaatactccatgtctccacaactttgcttaccaggagtaaaaagctaaacagctggagacgtgggaagataatctttgccttactcttgtttataaaatatataggcacatgtattagtccattttcatgctgctgataaagacatacccgggtctgggaagaaaaataggtttaatgaactcacagttccacgtggctgggaaggcctcacaatcatggcagaaggcaaaaggcacttcttacatggcagcagcaagagagaatgagggagaagcaaagtggaaaccgcttataaaaccgtcagatctcgtgagacttattcactaccacaagagcagtatgaggggaaaccgcccccgtgattcaattatcttccaccgggtccctcggtgggaattattggagtacacgtgggaattattggagtacaattcaagatgacatttgggtggggacacagccaaaccatatcagcatataaaaatgaaagatatatatatctttttatgttttatatatatacattttatatacatttatatatacattatatgtacataagatgcatgtacacatctatttatagtatacgaatataaaatacataaatatttgaaatataaatatatttacataaaaacaaaaatatatgtagcttattatgttccaggcagtggtctacaaaattgttcccattttttagatgaggaaactgaggcacagagaaattaagtaacctgcacagattgtaagcatcttcttctatgagacacattttattccatccagcagtgttttgcccagatgctcagtaagtatttggtgaattaattgaaaataggtgtgtgccattggtaaatgatcttttcctcttcgaggctgggtcttcctttgagaaatgaagggcttggactcaatgatctctaaattctttccagtttatatccctaaggtctccttaggttgatttgtatagggcaccctaaagaagagctactgttatggttctctaattatgtgccaggctctgttctaagcatttaacatgcattgtttcacttgagcctctcaacagccaggtgaagaagttttggtcattattcactactgtttcagatgtgaagaaatgggtgctcagaaaaaagtgatggctggtctgtggtcgctccgctggtgagtggctgagctcaaatgccaaatcgtgtctgcctgactttaagcccatactcttaatagccgagaaagccctagttttctcaaagagaatgacatctagggcatgcatttgtcttcccttccttttctcctgccatgtcttctttttcattttcgtcatcatccaaaaacatactgcagatactttggcatacattttatgattctcatcccctttgctggtaataaagtgcttactccacatgtgacatgtgttgacatctgagagcattttttgttgctgagttggttgttaataaacactaatgagttggtcgcatctcccagagcaaggacagataccacaggaacaggttttaatacctgtcaagagaatacaaagtagaaaactttattgtggtgccctcaccatattgtcctggttcttccttgcattcattatttaatactttttattttataaaacttgcttatttttgtgataaaatattctcactctttaaacaacataactatatgtcattgctgttttaaaaatccatgtgtactttgcagccataaaaaggaacgagagcatgtcctttgcaggtacatggatggagctggaagccattatcctcagcaaagtagcacaggaacagaaaatcaaacatcgcatgtgctcacttataagtgggagcggaacaatgagaacacatggacacagggaggggaacaacacacactggggcctgttggggggtggggttgggggagggagagcatttggaaaaatagctagtgcatgctgggcttaatataataccttggtgatgggttgatctgtgcagcaaaccaccatggcacacatttacgtatgtaacaaacctacacatcctgctcatgtaccccagaacttaaaataaaagttaaaattaaaaaaaatatatatataaaaatccatgcatacaacacagaatgagaacttcgaatacacactagagggtattaaccatggttgtctataggtagtacagctacgacatattttagttgattttattttctcatgtatattctgagatttttctgtcatgggcttgtatgacttttgtaagaatgataaagtaaaatgttgaccatggtcttaattggtatcttcttatagctgagtctcttacgttttttcctctgtgcctctgcctcccagtcaatcagacacagcactcttctatgtcagctgcccgggcagagctggggtttcgagacattagggttgcatcagatgcctgactaaggcatttataagactgcccatagcttagaacttccagtgatctggaccctctaaatttgggactgttgacctttggaatatattttcttacataggtttctgtgtcttatttgatgtggaaacaacaagaaatccgtaccttactgagatctataactcacgagggacttcaaaactgcattatgtcaaaggcaaacagtgttccatcattgaaaatacaattatgaaaaatgataactaacttctgagtggtactttttagagtttacatgggctcttcacttccatcatctcatttggtcttcacagtcttcctggtgggtaggataggattatttcattttaaaggtgagaaaactgaagcctgatatggacagctagggagtggcagagccaagacttgaatccacattttttttttctttttttacttttgctgcttcactacagtattttcatgaattaattgaaataatcctagatatccaataaaaccatcactaccgccactgctgcctctcctctcctcttccttctcatcattgtgatcatcaccatcatcttttccttctgttcaatatccttctgtcagttaatattttatattttgagggtctgaatatccgatcatgaactagtctcataatccaagaggggtcaaagtcatccctcttgcatcttcttctctccctttcctccctctctcctttccctcctttcctccatatttctctcattcttcagttactttcataaatatttattttgaactgttcttcacaatattcacttagccctggcagatggcctgagaggtcagctttcataacctgatccttctcttttcagcaatgaaggatgaatatttcaggatcagcatattttatcaatgacctaaggctttctgattactttccatctgtggggtctacttcattttgttgcctgggctatttaaaaggtttcttgcatgtagtgtattcatgataaataaccagttgcttttgtttcagggaaagccatcttaaaggagcaagtcacaatatgcttctactctcacaaccataattttaggcattaacttactctataagcattattaccaggggccaggtgcctcttataatagtggctagcatgttgccactcttcatcacacgttatcatacttgtcaatttacttgttcacacccctcctccctactttattgtgtactccttaaggacaggactgtgtcttaatcacttttatatccccagggtctcatacatattaaaagtatgaaacaatgaaaaaaaaatagcatagctttggcacaaaggataattacaagcttctgaagccttccggagatatccggaggctcgctttcctcatctgttcagtgggggtaatagtggccttacagagatgctgatcagacactcttgctttcttccccctagtttcttagaatcttcttggtctcctctctggccctcatggcactggttgcataggcaaatctagactcttacacacttggctatgaagagtttaaaacccctttgtaaagaatgtcaaaactacatttgaactttatgtagtattttcattggtacatttggaatcctaactagatcttagaagtcactgtctttgctcacatattctctgagcttaagcacaagaaaatgattcattaaaatatttaaatcagctactagaaacaataatgaggataaacatctcggaggcccaaatccattattctgtgctcccattccatctgtgaaggctggtactctatccagcactaaaaatttataaatgcagggtcagtaagaccatagtcagcaggaaattgcaaaactctgggctcctgcaagcaaagcccaacttttcttcagaaattcatgacattggaatggaacaaaactatgcagaaggtatagtgacaagagtaacactgaactttaaacgccaactctgtggctgcccagctggatggccttgggtaagtcacccaacttttctgtggctctgttgagtcatttgacaaatgagcataatcaatcttgactgcctctgtggagttgccaggaggcttaagggcgcctctgtgtgtggaatgtgctctgtcagctggaagatgcctgtcatgtacatgggagggactcattttaggatggctactcagagatttttgcattagaagcacaggtttgctttagcctcagtttgcaaatgtacaggattagcattcccatgcagtgtcactctatctctggaatgctgctattgccaacagaagtcaaccaaatgcctctccacaatctgtatcaagcataccatatgtttttacacaatggaagtgatcttaaagaattgaataatattttcttgagggaagtttactttttgcaggaaacctgtgatgaattatttggtaagagaaaaaagccctattgtaatctcttctaatctatcaattctaaaagtttaggttcttttatgtaattttttctagacatgccagccaggaatgcattctaaagtattgtagtgttaacataatgtattctaaaaagatgatgatgtcatttagatatctactaaataaatagtgaatatttagtaatagtgctgataattacttgtttattgtttgcttactatgtgtcccaacctgtgctagttgctttatatgccccatcttattggatcctcactatttaacagatgaagaaactatgtctttaagaggttaagtcatgtatctgatgtttgagagcaggccaaataccagtgtgatggtttacatccaggcctgcctgacttcaggataggagttcgtgagcatgaaggtagattctggtagtttatattctatagaatttggaacctgcatcatgaggtcagacgagaacataaagaatcttaggttgcaaccagaagaggactctgtggtctagaaagaaaaaaaaattccctgagttattaaaaaagttagtggaaaggcctaggttcccactcagcacctgttcctccataccacattgtgtctgctacacacagcacctcatggtctatagatgtcaattgtagcatggccattgagggtatggaatgaattgtaaacaggccttatctttcaaagcatccagcagccctgagttccacgactctttatacctgaggtgagagttggccagatagggaattgatcctatgtcctactgaaaaccagtgttggtattagcaatggtcttggtaaaatacaatgaagaagaataacgattttaaaatgaaaaaaaaaacttgaaagaaatggaaaattataaaggacacagttgcaggctcaatataacttaaattaggggttgacagactttctctgtaaaaggagtggagtttgactgaatgtttgtctcccctacaaattcatatgttaaaatctaaccctcaatgtgaaattattaggaagtgaggcatttgggaggtgattgagtcatgtggattgagccctcatgaatgggattaagtgcccttataggaatagagcagagagctagctccctgcctttccttcatgtgaggttacaaggggtagttgtttgttttcaacctaaaagagggccctcaccagaatctgatcacgttggtaccctgatcttcgtcttcaagcctccagaactgtgcgaaatacatttatggtgtttataagccacttagtctatggtactatgttatagcagcctgaacagactaagacagcctgtttatgactgctttgggatatgtattctctttttatctggcaggcaggaaatggccaagcctgagtaaaggcagagtagtccagtgctgcccaatattcctggttacctttgggtagccaaaggccacatttctctgagggtatttcttactgatagactggctattaagtttcactcttctgcttggaaacccagcttaaaagctattttgggcagtgaagttccatcagctaatatgtattccaatgacaatgacaagaagtcccagcctaggtttcatcaaataccaggccctacagactgctcctctgaatttaaagcttcaccctctctattattgtccatgtttgttcaaaagtatttatgaataatgataatgatgatcattatggctaacatttattgaagatctcctatgtgtcaggcattttacccaacattaatacatttttatcatccaattcttacaacaactctatgaggcagatactaccattgccgccattttgcagatgagaaacttgaggctcaaagaggctcagtgacttgttccaggtcactgttacttagtggccgaggcagatctgaagctcatgctgggtgataataaagtctgctgtttaccactctgccacactatcatccctgtttaaggttctagaaggcacaaggagcctgcctttctaaagcagacattatctccatcttcctttcagtctagttctgagaatgtgttctcacttctccctctcccatgttattcaattctcagtctcaggcctacagtaattcacacttggataactgcagtagctcttaactgtttcttttaaaaacaactatattgagatataattcacatatagtaccatacaattcacccatttaaggcatacaattcaatggttttagtatattcacagaattttgccaccattaccacagtcagttttagaacattaacatgtcaaaaaagaagcccaaacccttcagctatcatgccactatccctgttcactgtgacttccctccccaccagccctaagcaactgctaatctgctttctgtttgaatgaatttgcttattctggactttcataggtagacttataatatgtgtccttttgtgattggcttctttcacttagccttagtactgtttataattctcacatgtagcacgtatcagtacctcattccgtttgatgactgaataatattccattgtatggacatgctacattttgtttatccagccattagttgatggacatttgggttgtttccatcttttggacattatgaactaaccagcctcttaactagattctgcacagcactctcagattaattttctgaaagtacagctctcattatgtcttccctccaattagaagtcatcactggtttcttattgcctctaggacactgtttaaacttttgagtttggattttattgtgggaaagtgcaaggcatggagtgagcacttatactggggaaggaatggcaagggaactgtgctttactgagcccttgtccttaccctgccttatctcccaagatcctcaacacaaactctctcttatatttacatggatctaggcatcattcttcaaatatgtttctcattgtcttatctagactctgtttctcctccttgaaatgcctttctgttttatggctaagtcaggcccttctaaaccctgcttgtccatggagcctttccacgttgctgcggccttcagctagctctcccttccctttcatcccctaagcctctcaccgtctgtacggcccatttggccgtcagcatgtggggctgcacaatgagatggggctgcttttctatctcattttctttggtggattgggaacctcttgaggccagggatcaagtatgacttattatcatgatcattagtataagagtaatccctatcatttgtcctaggcattgttatgtgctgggtcttttactacatccttacatttgttaacaagaaaagacgtcagggtaggagctgttattccagtttcatcaaagaagaaacagactcagagatcctaaataacttatatttggtgtctcagcaagtaagtaatagagcttaggtctatctgatgccaaagtgcaatttccacaatgctgtgctgacaatgactttttttttgctcatcctgtcccttctcttcctcttcctcctttgtcatcacccagcatcattctcattttgcagatgaggaaattaaggttcgtacaagtttggtattttttccagagccacgttcatagtaagtaataaagcagggatgttaaaattaaaacttctgtctccaagcacaaatttattttccttaccatgatatttgtgtatgttggggcctcagcaggctgttttataataattatcatgctataaaacaatagggaggagaagattcacatacacaaacaactagaagaactataagatactgtattgtggtggggattataaatgtcatagaaattttgaaaaaagtcatgacaacttcttagatgaaggaaggctggtgctagaccttaaaggatgggtgaggttagccaagcacaaaggagagaggcaaagagaaggagagagacaaagacattcaagttttcttgtggagccattctcccagcccagtcctccacatcgactcaaattctctaagaaagagtgtagacgctggtcttaaccaccattgggacagctgttagaaggaaacaaatagttgcataatattgaaatggttgtgtggctttgtaatatgtttatatttatcaaagggaaaggcaaggacattatacaattcgatgaagtcctgatttaaaaatctgtattttcacttactacagtgtgaaaggggatagattgaggcctttatttattcgtttaattgcagacatatttaatatttattataaagattttatacttcctcaaattcaaatttttattttccaagtatgatagttcttttagtttttgtgaaaggcaaaataatacccaatccgtcgaatattctttttcaaaattgcaaatctgtttcacacgtaaaaatataataccaagtctgattataaaccacaaacaacaaaatgtgtttaaaaacaaatgctgtagttggaatagcagtaagataaatcacacaggtttttaggtatttgcagcagactattcagtagctgttggcttcaaggatgattaaaaagtagatttattgatttctaacgaaaccataatattaataatctgtggagggatagtagactattggctttttgccagaatggctttgaggagagtatggcctttggtactaatagcagcttctcagcagcagtcagaattgggtctctgagtccagtgcattaatggttcagcagcaaagttttttcagtactcaaatatgacttatgcccatcagtccctgatgaacttgttcaatttaaatgggcataagtcatatttgagtactggacacattcagagcatctcacccttacaaatgattgctcttcttgcttgattttttgtgtctttttgagatgctaagccatagcaactgcctttattcattcatggtatcacaggagaagagtagataatggatgatattaatagtatatccatttcttatacttgggccatggaaagtggaccacatagaaaaccacctacgggaccacgtaaggttagtgatcccgctttccctgttagaatacaagagattgcatccgtgaaccgaggccctgggaatgctgtgatgtcttcttgaatgtgatgcttggcttctgagcttttacttttcaagaaagtggtaattattacaaagcttttcacctttcttggctagtggaggaatcctatcatttgcaggtttccacatttttcaaaggaaaaacgctttttatcgtctttgttgtattgtagctccactgaagagttctcatcatggtcctttaaacgtaagtttttttttcagttggtagtctgcctttccctgagttgatcatcttttggggtttgggcttcagatcaaattcctagtgttgtttatagtcagtgctgcacagagcctctcattcttgttcatatctgcctattatcgtctctactcttctccttccctctctctttccctttctccatccttccctcctctctctctcccaccatctctccattcctctcacttttaagtgctaacatgttcttcctgaggtacatatttgatagctttacctcgcctccttaatctgctcgtgtgtccttggtttgtggcctgttgtacatggtaaagcaatgttccaagctggggccatctgctttgcaaattccaggtcatacctaatctttctgatgccatactattacaatgagttccagccccagagaagttattttgcctccctggcggttactgaacatgtgtttatgtgtgtgtgtgtgtgtgtgtgtgtgtgtgtgtgtgtgtgtgtgtgtttgctttccccagtaatgggaaggatgacccacatggccattgcattatttttggggttgtgggtgggccctgatcactttcaattctgcctctcagttgctgccaccagtatttcaggctatggttctggacttaactaatctaaaaataaatcgccatttttatgaccagaagtctactaatgtagcagttttcacaccttttaaggtttgttttgctttgttttcttctaacagtaattaaaaaaattctctctgaaatcttatgtaaagtttagtgtttcaaacaggtcaaattgtagttgctgtgcttgagatgttgatggagaattcagagttttccttcctcctccccacctcagctacagttctttggagcagactttgatatacccttggattggttctcttttctttcaattcataggtgagaaccagagacaaggacaggggagaggacagtaacataaaggctcaagggcagaaagttgaagtaccttgtgaccagggcctggtcattggtcctgcatgaagcaaaaggacaaccattgatcctacctacgtttgtcagtactctaacaactgtccagccagtattgaggcttagcaagtagagtttttgttttttctttccttttctttctttttttttttttttttttttgagatagaaacctcttcaccactattctctgcagccacaagcctcagacagaaccagttgtggatagcaactcgacaggttgccatgcttttaatagatagtttaagtaagttctgttcttataattaggttgttatttctaacttttattctatgtgaggctaggttagtcagacccagtaaatgcatatttgtttgattcatttggctacgttattttaggccatggctaagatgcgtgtgtccataggcagggagtggccagaggaagcaaaccgaggtgagatgagaccatcatttgtagccatgggggccataagagatcagctcccattttctcctagcaggggtacagagggagcaggctgtcaggaatgacgctctgtggcaaaggttgctaactcaggggagtcctcattgctagataggtgaagagtggctctgtcttgccttatttttgtttatttttgctgttcattcttttctttttaaattttagattcagtgggtacatgtgcagatttgttacatgggtatattgcatgatgttgagatttggggttctattgaacccatcacccaaatagtgaacatagtacttaataggtaatttttcaatctttgtccctctcccttcctcccctacttttggagtctccagtgcctattgttcccatctctgtgtttctgcgtacccagcgtttagcttccacttacaagtgacaacatgcagtattggttttctgtttggacattaatttgcttaggatgatggcctccagctgcatccatgttgctacaacaggcatgatttcatttctttttacggttgtgtagtattccatggtgtatatgtaccaatatatacatgatatatatgtaccaatccaccattgaagggcatctagtttgattccacgtctttactattatgaatagtgctgtgagaaatatacaagtgcatgtgtctttttggtagaattatttatttttccttgggtatatacccagtagggggattactgggtcaaatggtagttcgatttttagttctttcagaaatctcaccagtcagaatgaccattattaaaaagtcaaaaaacaaaacaaaacagatgtgctaccctattcagatccctctcgctctctccatccccttctgagctcagaggtgggggtcatgggcttcttctaagagccctaacctggcccatgctcgctgtcactgatctgtttcacacccttttctccctcgcctgaaatagtagagcataacactcatctttctgcctccaaactttttgtttgtgtgtgtgtgtgtttctaatgtttatggtgaaagatgcattcaaaaagtgcatatgacacatccatgaagattaaaaataattataatgaaaaaataaaatgaactcccatgtatttaccatatagcttgagaaatagagtgttacctatacttaaaagcctggctctggcaaccttgttaaattctcttaataaaattctaataatttgtaacattcttttattctatatagtcaatgatatcatctacaaataatgacacttttattgcttgctttctgatccctatgccatttactccattgttttgccttactgcactggttaagacctgtagtccaatgttgaatcagagtagtagacactcttcttttcttctagacttttaaatggaatactacaatattttattctgtgaatggatgttgacttttatcaaatgcatcttctgcgtcttttgagatgatcatatagtgtaatttatttatttttctctctcctttaaccctttttttttgccaccttttcctttaaattcagggagtacatgtgtaggtttgttacctgggtatattgtaggatgctgagggtttgggccatcctgaatgcacccgatctcatcctttaatcctttaaagcaagcttgtccagcctgtgggccatgagccacatgtggcccaggatggctttgaatgtggcctaacacaaattagtaaacttccttaaaacacgagattttttttgtgattttttttttaggtcatcagcaatcattagtcttagtgtattttatgtgtgtcccaagacaattcttcttctttcaatgtggcccaggaaagccaaaagactggacacccctgcattaaagcaatatggcactttacattcatagaacttttaaagtgaaacttaaattcctggatttaatctgagttggtcatgatttattttgttttctatacattgctggatttcatttcttaatattttatttagtatttttatatttatgatcacaagttatgctagtatatatttttcctttctcatgttattgtctattttggggtgacaaggtgagaatagctccataaaatgagttgggaaatattcttgtcttgttttctctggaagagttggtataagattggaattatctgtttctttaatatttagtaaaacttgactgatgtttgcttaatgggaagtttaaaaaaatttagtgcttataagaatgttcttgagtcaattaaaaaattttttttctactaatgtcgatatcttattgaaattgttaaatttatgggtgtaaagttactcatagcattgactgatcttttttattatctgctacatctgtagttatgacccttttaattctcaatattgtttatttgtgcctctgcttcttgtattactccttttatttcaaagtccacataattgctaaatcaatgttattaaacatgttattagtcatataattatcttcctcacttacaaatcacaggaggactttcagtgccctttatgatctagctccagcctagctttccatttacaaaacacaatttttctacttgtgattttgagttccagccacacaaaactagtgtacttctcctgatatattcttaactttcataacctggtacctttgtttatacccttctcaccattttgaccaccctttcctatatctttatcctttgaaatactcattgcttctcaaggctcatcgcaaattctacctgatccatgaattcccccagtttcccccagacagaatagataactcattctcctgtgtttccagcacacattccctcagactttttcatagcaagtattgtgttgttttattttaatgagttgcttacatgactgcaaactagtaggttgtgagcctcttgaaggcaaatccttgtctttttcatgcctacattctaaacacttagcaggggactactcagaatctgttcaattcaattggaatgaattaaagtggaattgaacaggcattcatactggagtaatgtgaagatttccttaccccccagaattcccccttcaccatctggctgaagtctgaaaatccactatttgaactccactaatttttcttattgtgtttctttcttgttaaaaatgctaactggtcttggaaagcagaggaggccctccctggcattgcaccctacccctcacagttttccctgttacctaacaaatggtagctttcctagatcttttcctgagagcagatatacaggcaggacatggaaaaggaacatccctaagggagaacaaagatgcagaaagtggtgggtacatatggttgttgttcttaatttagtatctactgtattccaagtattgtgccaagtcacatgtaatcttcacaccaaatcaaagagctgggttccattatcatctccagttttaaagatgagaaaactgagactcagataggtagaacaattaggccgaagccactcagcctgcaaatggaggagttgagattcaaagtgaagtctgatagactattattctactacccaagctatctcttctctatgacctcatctcaagacctcagctatttgtcaaacacctgttatgtgagtaacctctgcccggctccacactgttccacagtcagtttttcaggtatttattttagtggtcaaaagtgacctcatctctgctgattgatctctgaagctgctggaatgaggcaagaatgtgtgatgtgtgcaattcctttggctgcttcttgtccctacagcatcttactctgctccctgagcgagggcttttgggttttgaaaggatctggaactttttttcagaaacaagtctctgctttgtcaggtagttccaaccccatctgtaggatcttcctgaaggctgagcacaccaacatccagctgttggaaacaacagcttcctcaattaaagaagaggcagacaactatctgaaaggaagctgggaacaaaggttatcctcaggagattgctcaggaggccagccagagggcatgaatgtttggtgacagcatatatttgggggcaatttgtactttgctgtttcaagacagagctctgctggctaggagagcacattttttcttcccttactccactaattggcagcgccatttagggctgtcacagcaacagtcttacagatcttgtggtccagacccgtcactgtgtagataaaaagctaaagaccagaaaggaggagtgtctcatccagagtcacatagcagagtgggagtcaagcctgcatcaagactcaggacttttgatggaacgtcccaggctgggaaactttatttggccctcagtttagactaccctttttatcagttatcttttctatggaatatgttctttattttcagttagtccttaagtgccttgaagactgaaaacatattttgtaattgatttttggctctctaccatgatttgtacatataggggtttgttggtcaggtcagccctctcctcttctgactcttattaaacatgactcctattatctctgtatggccttgcccttgccactatgcagccctcaactgtatgcaactcctctcacctggatatggctcctaagtgtgctgaacctcagcttttccacagccagtagctccattagctctagttccttgaagtccattccaaactctgtttctaattcatgtaggtttgaaaacagtggttttgcattgtgtacatacagtttgtatagttttcttcactgaactttagaactacatgatagttcttcatgcagcaccattaacagagatatatagctctgtctaccatgttcataagatgcagagtaactcacttctcaatcttagttttctgggtcctgccacatttttaagaaaggaatcctctcttgggatattcatctaaaaaaacaaaaaggcactagagacggcctgtatgacaatgtgatatctgaaaggcatatcagatttgctagtcttttcttcattcacatttctgtattaggctgaggtgctatccctggcgtcctctaccaagcaaagtgactttggtcaagtcatttcattgctcccagtctcagatccttcatctgttgatagagataaaaaccctgaccatgaaatgttgggagaatctaataaagtaatgtctgccaaagcacttggacatgatgtattcagttctctgaatagtagcattacacttgttcgctattggagggctcagttatatggggggtgttgtgacagcagagatactgttgtactcttgcacgtgttcctaagcccagcgtcctgagtgctacccaacatgtgcatcttggctccatggaaatccagcaggctggaaccactagcatccccagtagactgaggccattagtagtcctgcccaagaagagcagcttgtaaaagtaataccccagtgtagattctgggatcacatcttcctttaacatccagaataatagatgaccaaatcctgaagtaagtttagagcccacttcactatctctggaagtttttagctctctagtgggaggtttgagtttatctctttttcttgagtcagttccatctgtcgcttgcttctccactgacccttggttcttctcgcaatagcagatgtttcaaagtatgtatgaccagctctgaaagcagcttccaaggaggagctgtctgaaagttgcatgcacaggcagggtagtaaattagaatcaggatgggacaaatttgaaggcaggaaatcacatggctgcgaaagctgaggtgtgattgtgacaactatccccagtctcctagaaccataccctccacctggtgtgttgcagaaagctgaccaactgactaattttacatctcttttcatagggatgattttgctcgccattggttctagtaaatagtgctccacaggtatttgcagcatgccccagtgctcatccctgtaaggctgatgcctccttctttattattcttttccctgctgatcactccaagctcttttgcttgcttgtggtggttccatttttagtctttgtgaaagttgttaaacagactttgttgtagtaagatttgagatgtgttctgttggtacagagatggctttactgagtattattgccttaccctaagatcagtaacttatcttagtggagaaagtcaaatccatctagtttatttttagcagatatcttcactgaatggtgggaggatagtgcagattgctctgagtaggtcaaaagtaaacatgcagtgccaaggactaatttctcttgtggggcttttggggttcttggaatgtctaagaacatggtggagaattaatcagggatctcctgccctttgcctcccagctacttttgaagcatttcgattggtaaatgctagtttctgaatgcacatatcaaattgccaagtagcgccgatcctgagaggcagatgccttttgttgtttgaggattggtgcagcaagaagctccaactagaagctaagacccagaaaagcagtggtcacagacaatgggatgcagttgttgatgtgatcacagtttaagggctgttgtttgaactggctggcttctgcctgtgcatcccacttcgatacttttctctgacaagaaagaaagcaatcagtaggaatgtgttgatgagatcataaaatttaagatttgagaatgttaaaaggtgttcaattatgccagagtttgaccaaatgcaggctggaatagaaggactgaataatcagaagctatttagtgagtcacatccttttagggagcaaaagtatctaaggaataagatgggtgtgagttgggactaggtattgcttcaggtcacctgggtgccattcagcaattaagcatagccttaatggaagagaagcaaaagtgtagctggcagccacccctcctttcctcttcccagggcatttctctatttcatttaggcaggcactcgatacctcttgcctgtatattgcaacagatagcctcctagctgttcttcagcttcccatgccttccttctctggcctcttctctttccagcatttaacataaagtggtgccaggtacctctttctaaggcttagttctatcagcttcgtcctgtactcagactacgacagctaaggaacagaatctcccctccctagcttcttgtccataggctttccaataaactgagcagcctatgcccctctgttctccttcatgtgcgctcatttccagcagaactagaccccttacctcttgctgaacacaccctgaagttttctgcctctgatatatagcagtttacctaaatgtatttctccttcttgtgattttacttgtcttttgtcagtatcatctattttactaagcttcttttgacaccctaacaccaaatgaaagggatttacttcctcagaactcacattgtctgtgtgattgaacttctctcctggcttaaattcatgtgctcatgacttgtttgtctctctcagtggacagtaagctccttgagggccaggacctgtgccagatgcatgattgtcacattttgcctctgggccctacagaacccatgataaatgttgtagtggccttaccccaccagactccaaagcttgcaaatactttgagatcctgtgggagatgataaactgcattgctccaaattaatattttcctgatcctctccctcctcccaccctctgcttgcagagcttgcaaatactttgagatcctgtgggagatgataaactgcattgctccccttctcaggacttcagctttctggactacaaatcagggggtttgccaagtttgcttttcaaggccttggctagttctaggattctgacccaagtttccaggaagggtttgtgtttgtttgtgctctacttagatcccaaattgttcctctgcagcatgggcttttgttacctttgcttccttctttagacaaagagagagagcaagagatagcctctgctttttttgcatcttgacaccccagttctctcaatatttccagtgcctttctaatttataaccctggaaaccaagaatacactgtacacagtctttttttttttttttttttttttgagacagggtctccctctttcacccaggctggagtacagtgacatgaacatggctcactgaagcctcaacctcccgggctcaaacaatcctgctgcctcacttccccaagcctgctgggactgcagccgtgcactagcacacccggctaatttttgtaatttttgtagagatggggttttgccatgttgccaagactggtcttgaattcctgagctcaagtgatctgccccaccccagcctcccaaagtgttgggattacaggcgtgagccaccacactcggccttagatgcagtctcaatgcacgtttaacagcacacactggggcctatcggagggcagagggtgggaggagggagaggatcaggaaaatattaataactaattggtattaagcttactacctgagtgatgagataatctctacaacaaacccccatgacacaagtttacctatgtaacagacctgaaatgtacccgtgaatttaaaataagagtttgaaaaaaacacattgggtattgcttactacgtaacaggtattaatgcctgttatgtactaagcactccatgagtctttgctatttttgttatcattattaatagtcactttccagtaagacagacctgagttcaaatcctgactttatgatttactagtggtgtgtgactagtgatgtcaggttcttgatctatgggaatctctactggaaacttactttgcagatgcattgttagggttaagcaagttactttatgttaaaacagctgctgtggtcatggtgcttgacacattatagctcaaaaatgtagcttattattagtagtagttttatgtgcatttttatggtataggaacttgataaattcattcaaaagccaattttaagtgcctactgtatcctgggagctatgaaaagcaccttaataataatgttaaaagccaggtgcagcggcttacgcctgtagtctcagttacttgggtggctgaggtgggaggattgcttgaggagaagagttcaaggccgcagtgagttatgattgcaccattgcattccagcctgggtgacagaggtagatcccatcaataataataataatgatggtcacaaagatgatgttactattacctatcagtaacacttattgagcattttctctgccataggcaacttgaagagctctacaagtatcttttctttaaatccttaacaggcctaggagagaagtactattattatcttcattttatagatgatgagagcaaaccatagagaaattgaggaaatttcagatagttgctccaggatttcagttgagatgaagaaactgaggcatataaagctagtcaatggcagataaaaaaaaattgagtccaggtcttctgtctctaaaatccatcctttatatcagcccataaccattgaatgaagttaatcatgtggaggctgacatgggcataaacatgacatctgaagcatagttttcaccccttcataagagtccagttgggtaccacataaatgtggccacaagaaagttatgatacttaaaaatctcataaggataatagtattttttattcaagtcagttattttaaacagtgcaaaggactttagtatgtatgcagtccaggagtttccaactttgatttaccttttgaaataaattagagtctatgagccacctgatttcctgtgtgccaagatttacctggagtacttcagccacctgtcctcagctgcctcattgccttgcttcctcccactttctctccaacacacatgcgtgcacacacacatgcacacatgatttatcataatctgggtaaccacctgtcttagtccatttgggctgctataacaaaataccatacattgagtggtttagaaataacagaaatttgtttctcactgttccagaggctgaaaagtccaagatcaaggcactggaagatttaatgtctggtgagaccccactttctggctcatagatggtgccttctcactgtgtcctcacatggtggaaggattgagggagttctctgtggcctcttttataaggacactaatcctgttcataaggcctccaacctcatgacctaataacttcccaaaagccatgaacttcgaggctaggatttcaacatatgagttttgtggggatgcagacattcagactgtagcctcctcgatggagtgtgttccttgcttgtgtgtcactgtggaaaaaaaaatgtggaaaatcacagcagtcaaccttctcattttatccctgaattggagattgtgagaggggacatatcactggcagtcctttcaaagtttggtctacatctatctatgtatagtggccaaatttagtgtcaatgatcatttgttttgagtttttttttttttttttcttgcaagtaatgctgagtgaatccaactgtagctgactttgttgaatctgcctgggaaaactcttgttcccttgcatcagaagccccaccataaaattggccttggttcaaaattgattatttgcacagattgggatatgttaacaaatagaattccttctcctttctttcctgctcaagttattacttaccaagtcatcaaccgttctctgataggcaagaaacaaactgaactccttaatcttgtttgttctaaagcttaggaagtgattttgaatcactatatagggtttcactgctaagatgtgcaatgggtaaacccccagaggctgggatacagattcaaatcagatcattcgctccaaatgtatcagaactcctaacaatgtcatagctgcccagcatgttttcgaaaacctgccattttgcaggaataacatacttcacgtcagactccaaatggccgcatggatgtgttgcaaagctgaaaattaatgacatgaaacttaacaaggtgttccagaaggtccttgctgcctccctcatgtcaatgctcctctgattccaaataggagagttcactggcaactgtactgttcaactgtggagaaaaatttgaaagccacatgatcataggctttctcagaaattaatctatacaaagatcaagtaaggtataattttcttggctgttgatggaaatatgtttttgtccagcaaataaacaatctagctgggttttggaatcagggcagtgtaaggggcacagacacagaaactgctgtgttaatgatagtgcttttgagacccagataaaacctaggtcttcagctttcccaggaataaagtggtagggccgagaaggtgtggagcattactgagtcaatccaaaacccatcacctgcttctcacaactgaaataactatatcaaacaaggatgactttgctcaatataaccatcaaaacacatggcgtatgtacagtttatcgaaagattttgggttcacaaagcaaattctggaaaatggcatgaaggcagagaatctgatcaaagagtaaatatttatttaaaaaataattcttaaagaggcccagaaaaataaatgaagaaaagactagctgtagattatggtggaaagaatgctgaacagggacacttgaattctaaatctgttattttaacttacttctgtatttaagctttttgttctctcacctaagtttcttattcttttttttttttgacggagttttcactcttgttgcccaggctggaatgcaatggcgcgatctcggctcactgcaacctctgcctcccgggttcaagcgattctcctgcctcagcttcccaagtagctgggattacaggtgtgcaccgccacgcccggctaattttgtatttttactagagacggggtttctccatgttggtcaggctggtctcgaactcccgacttcaggtgatccacccgccttggcctcccaaagtgctgggattacaggcgtgagccactgcgcccagccagtttcttattctttaaaatgaactggctgagctgtttttcagttctgacgttctatgactatgataacaacgtgatgaaatctgcatattggttaataacatacatctctccccagcaaagtgaaaaggcttctgttaaaattttggtctagttgtgcaggtgtttacatgttggccacacaaaaacttaagaggcaaaaattttcacatgaataatcaagttacctgcacttagttggtgacttaatttttatttttttattaaagtgaaattcacgcaacacatattaaacatttttttccatttttaaatttctaattattatggatacataatacttgtattttattaatggggcacatgtgattttgatataagcatgtagtgtgttaatgatcaaatcagagtacttgcggtatccatcatctcaagcatttattattttattgcattgggaatatttcaactcttctagctattttgcaatatataataaaatagtgttaactgtttctaaatgtgcaattcagtggtatttaatacgttaacaatgttgtgcaaccatctgctctatctagttcccagacactttcatcacaccaaaaggaaacttcatacccatttaagtaatcactcctccttgtgctctttcttcctgaatggcataatttttaaaatttatattttgcctttatttatctgacacagtatgtttggggggcagtaggtaggtgcctgcctgtgcttactgggaagctcaaatctccctgaaaccagcacgtcagcctctgaaaccaagttttggctactttgagagacttagagactaagggctagggatgctatctgtcatgatactgaacagatacaagttcattgttttaaacaaattattaaaaacaaaaccctgaaagtttttcaactaagttcaaagaagaagtaaaagtcaactaagttcatgttatccaggcataatcaccatttcctgtaatatctttgggaatcttcctctgcattttaacatatatactatgtatttgcaaaagtaagatcatatggtacacacttattttatttacaaggtaaaaaattgttcaaattaatacaagataggtttataaaatagaaaatagaacatctgtttcccaatcttattttttgatggagagtacatttcagacatatttttgtgtcaataaatatagtttcagagcatcattttaattgctgcctagtagtctattgtatgtagatgttacagtttcctcaactaggcttttttttgacatttaggtaggtaccatttgtcagctatcataatgatgctacagcttgcacctaaatttgtgcctatatctatgattatttcctttgaacaaatttgaatatgtgacctttgctcatgatgataatgatgcaatataatgaaactaaggctaaaatgtagctgctcacattagagtcacctattttgcaaacacactttgggtggctctttttattttacatagcatacccacacccatcatttcatttaatactatcagtggctaatagctaatatttattggacacatatgtgccaggcattgtgctatgtgctttagagaaaggtaccttattcaatgttatttgttatgtactattattatttccattttagagatgaggagagtcaggaggctcagagacattatgtaaattgcccaaagcgcagtaagtggtaaagctaaaattttactttggtcttttgggttctagatccagtattattcctagtgtatgacaagtcctttttttgaattgtaaagtattctgagcctacatttgggcaagggatttagattccgcaccagttatcttggaaagatttaacagtaaggaagcaacatggtgttcgtagactgtgccccctccatttctagtctaggctggcttcctctggggatacctgcctatagttaatttctgtggaactgtaagtgtagttcttgtcatgctggatcctttcccaaagtaagactagagtggctgtggctaagacagcgaggtgtgatttatgaaagttcaaaaggggccaggagcagagattgggagaggcctcatttacattaagagttactgtgaattaggttctggggcaaagtgctcaaatgaatttatcattaaagagccaataaaaagtattaaaggacaaattggctgaatttcattggaccgttttattctgtgcagaggaacaaatgatagcttgtgctatttattttttaggaaaaagaactgtaaaataagatacacatcagcaagcccccaggaccaatgtttttctgggaataaagctggggactatgggaaggcagctaaggttcccattcatggactgaagtaattttggcactgggaatctttgcctgttttcaaggacatctgctaagtccccaaactgtgtcccggttggccttgatgcttcgcggctccactgacccagatcacagagctaaacaggcgaatgcaaagattatggacttaaagaggtcagagttgtgcaggtccttggagagcatctaaggagtgaactcctcaaattgactagtggggaaaccagggcctaggcaaggaaagggacttgtccaaggtgcccaaacaagtgactgccagagtgtcaaaagtttagtggtcacatttgcaatcttctgtatgttatattcaccaatgacatgtaggactaaatgaacgatttctcttccttctcattttctccctcctttccctcttctaccttctccactccttctcctcttccccattttctctttctcctcctcctgttttattttctttttctccattatcatattcataacaacatctctggtatgtatcacgtatgctagctaactaacaagctactgttacctccattatctcatttgatccttcatgtatcatggctgtagtgctcagaaactgaaaatcttaccctgatgcagaatgtgcaagccaacacaccagtcccccatctcggcaccccccgactgaaaaggctgactggcttcctgagcactgtgcagatcctgtatacaagccatggactctctccctgggatactttctttctttcttttttatttatttatttttttatttgagaaggagtctccgtcgccaggctggaatgcagtggcgggatctcggcttactgcaacctctgactccctggttcaagcagttctcctgcctcagcctcccgagtagctggaactacaggcgcatgccaccacgcccagctaatttttgtatttttagtagagacggggtttcaccatgttggccaggagggtctcaaatctcctgacctcctgatctgcctgcctcggcctcccaaagtgctgggattataggcgtgagccactgtgcccggccctccctgggatactttctataggtgtttgagggttaccacattctctggcataatctcagactcagtggcaaaaaaggaaggaagtcaagaagctttcctgtcattggatccaggtcttaaatcaagctttgcttgacaagcatacttcccatatttcctggctggcacttctctgttggaaaggcctcactcatcggcactctttagtcaagaccaggttctatctaaggcatcatcactcacatggaagcccagtttctgagcactggggcacgatacatgaagagtcaaatgagataatggatgtaataatagcttgttaattggatagcatacatggtacataccagagatgttatgaatatgagacgggagaaaaataaaatgaaataggaggaggagaaaaagaaagggaaagcagggaaagggaacatcaacttttaagaacctagactcctggggcattagatttctctccaaaaggtaagagggggaggagagagagagggagggagacagaaagcgagcactataagcatgcaaaacagaatttcacacatagtgagaaattcatgtttttctttccttgttcattttttcattcactcaggtgacattcattgagtgcctaataagtgcccagcactgcttttatctccatgatacagcattatcctcaaacatttatattctagtgagggagacagacagtaaacaaatagacctatattatattatcatgtaattgccataatgccataatgctatgaagaaaaatgaaacaggtgtagtaatttcctaggatggccataacaaattaccacaaattggatggcttaaaataatggaaattttttcgttcatggtactggagattagaaatctgaaatcaaggcatcattagggccatcttccctctcaaagctctcaggaatcctttcttgacttttcctagattctggtagttactggtaatcctttatgttttttcacttttgtctgcatcactctaatccctgtctctgtcttcacatgggcttctctgtgtgtgcctgtacgtcctcctctcgtcttacaaggactccagtcattggatatagagcccactttaatgcagcatgacctcatttaatttgattacctctgaaaagaccctctattttctaaataagatcacattctgatgttctacgtggacatgaagtttgggtggagggaggcattaataaactcactgcagatggggaaagagaagggataattatggttggtctttagatagaatggttaggaaaggcctttctgaagaggggacatttgaggagagaactgagagaagtggagccagccatgcggatatctgagggaacagcactctagacagaggaaaggctaaatgcagtggctgtcaatctgaagtgtgcttgttgtgctagaagagaaacagagatcagcacagctagagtgcggtgtgaaggcatggagtagagtggtagggaatgaggtcagaggaataaccagagatcagatcatacaggaccttaaagatcgggggaagcaatctgggtattatttcaaaggcagaaagaaaccactggaaacttttgagcaggagattgatgtaacctgacttcaatttgaaaatgatcactgtagttgttgtgtggacaacagtcagtcacagagcaagggtagtgtcctaggagcaaatttggagattattatagaaatctaggcaaaagatgatggtgtcttgaagtagtgtagtcatagtagaggtgatgaaaagtagtcagattagttacatcatttgaaaatagagatgaaaggatttagtgcaacacataagagagagagagagagaggaattaagaatggctccaaggtttctggtctgagcacactcagtggcgttacttactgagttggagaaaactgcaaagcgagagggtttgcaggaaaaaatcaagacttcagtttcagatgagtaaagagtgagatgcaaattagaatgcagatgcaggtggcaaataggtaattggatatacaggattggagtacaagggaaagactgggatggagaatataaatctggaagccatccatagagatatgagactggatgagatcataacgaagtgtagatggaaaagtgataaagtctgagcattctgttttgggttactctaacattaaaaggtcaggtgttaagaagaagccaacatagagatgagaaggagtggctgatgggtatagatataaaattaagagagtgagatatcctagaaaccaagaaaatatttcaggggtgaaggagtaatcaactctatgaatgctgcagagagttgtacaatataaaggtaaaaattttctcctagatatcacaacagggaggttggtgatcttggttagagtatttttagtagtgtagtggggatgaaagattgcttggcagggcgtggggggcatttcaaaagagaatgggaggaaacgaattggagcagtaagcatggatggacaactttttcaaagagttgttttctaaagtggaagggaaggataaggtggtggctggaggagggagaatgcgtagtcaaggaataggtttatattttttaaagatgggagttattgtaatgtgatgaggatgatgcagtggtatagacatgagagggagtaattacaggggcaaagtctttgaataattaagaaaggatgggagactgtattgtacagatgctgggtaaatgtggtagtgggaggatgtagaatgtcttttctaattgcttctatttcctcactgaaatcagaagcttggacatcagttgagacaaaggaagagggaaggataattaaaaaagggaaattatgaaataactatccaagagaatagatggcagacagcaccgatggcccacacttggggtatgaggccttcagtttaaatgagaacagacagcatggttgtgtgtttttctagccaaaataagctgcttgggagcaggcatgaagtcatcaaagggttggacttaactcaaatttgggttttgccaaagatacgtgacagaggaagacaggagcctgggaattgaggatgtatacaaacctcttcttggattcatcttcttcagcctcattaatgtctcctccttacctttttgtgccttctcttattttataacatgacagataatacttctacacaagtattgaatgtggagtatgttccacttgttacaaacaggtatggaagagagagtgaggaaatgacacagtcccagaagaagcacatgtatgttaccaagagagattggcatggaagaataaaaatttttgcctaaatgtcacagcaaggaggttggtgatcttggttagagtatttttagtagtgtagtgaggatgaaagatttcttggcagggcatgggggccttgtagaatatttaatattaagaaactttataacatgtattttggggaaaaactcactgtggttctactttgtgtgtgtgcgtgtgtgtgtgtgtgtgtggtaatattttctctattttggtcaatgtaaaaacctgatcatttgatgatgatgatgatgatgatgatggtgatgatgacggtgatgttgatagaagcaactaacatttgctgagtacttaccatgaagaaggcacttcactaagtgccttcatttgattcagtaatttatttaatcctcatgacagtcataagaattcagaaccattactcccattttcagataaggttaggtaatttatccagtgtatgactaacaacattcaaaattagattttgaacccagaacattatgattccatagtccacactcttaaccactcctgcattgcctttcagtgccaaagactttacatgttaaagttggtacacttgtccatctccctatcccttcagtagaactgtcccaatgtccagtctctttgctaagtgattgtgttagttgctagttggggcaaaggtgtgggtgaagttcagccccaaattcttcatcatttttgtgctcatatagggattctgaaagaagctagagggaggatggtgtttgtcctgcaaagctgttccagagacttgtgttctgggctcataatatatattctgaagacaaagcctttggggccattcctcttcttccttcatctctcagacctagttttatcttctgttttttcttgatccatggatattaggcaactgtcttgttctccatattgtgatcccgtctcttgcccctgccctctctataagctctcacctttgtctgagacctgctcctggctcccacttcatcaggcttggcgtgacaaattgccttcttatcatacttaatgccagcctgtaaaatagggtatgctttctgctcacatgctgtcatcatctcctatatccatctagatccaggaggcctatttcatcaacataaaatccacagaagcaacacacgctgcgaatcggtgctccatgtcagagctgatgaggatggattggtgaattctgtagatcacatctgtcctaagcagcaaattagctatgcttgaattcagctactacattttgcctgctgtgaacttgctttactcttctatgaaatgtattttgtagcagtgcagaagaaatacacaagattgattagagttggcacgatttgtgcatacttctgcagttattattgtagtagctgctttaaaagactaaaaagattctttcaccaattttgttcctctgtaaagtttcatttaaacgttagcgggtatatttatgtgtaaatcggatcagcttccaatgatagttccttattgttagcgttttgatgttctgtttgcctgagcagattgatttgccattatgagagaacgtttgaactgaaaaagtcctctgaactttgttcactaatcttatcaaagaaaatagaagcagaggatgtagacagaaacctgcaaattaaatttacttttccaattcaaatgtatttgatctgcatttgttatggaactgggacagtagttgcttcttgattgtgcaatagcactgaagtttagaatatttttcaaagtcttaacaaattcagtgggggaaaatcagcaatgttaactgaaaatagcatctacccttttgtattaagttagtacagcatgtagatcatgtcattgtccttgtactcccatctatcaggcttagtgagcactgtgcaatggtaccataaatggctggaccatctctgctatgaggtgacagattgtttagggcaagccgctggcaacagaagtgttagcatgcttgatttgcagcgaagtgagggcccagtatcttctgcttgattcacatggatgggttatttcacatagctttactcagatttggagaactgtgctaatggcctgagcagtttgcttccttcttccctccccatcactttctctctctctcatttaaatcattccgaatttctgactcaagtaggcatatgaatcagaatcactgtggaaactaaacaaacaaacaaacaaaaatccaccacaagcttaagctctggctctggagatgttgcttgaatagctcaagtaggtgtaagacagtagaaaagtggaggacaaatggactttggtctgactcctgattccatcacttgctagtcgtgtgcccttgggcaatcatttattttctcctagcctcatcacttttttttcatttttcaaatgggtaacacgatagccctgctttcattaggttatgggaggagtgaatgagaaaatgcaaagtgactagtaatcactaaaaaatatacttagtatttgagtgcttcctatgattcactcttatgtggcaatcaggcttctgcattttaagtttacacattatctgcaggtcaatccccactgagaatcactacacttaaaagattcttaaaagctaagtatatgaagcacttgtttcaagtctgtgttcaggggctggttccaattttatgctatggtgccacctcataaaagtatatatgtatgtgtgtagctactggatatttatgctgtgcctggcaccgtgctaggtgctgaggacccagagatcatgaatcattgtccctaaccctaagaatgaaattgcctaataccacattctactctgtaataaagtggcacagtattgcaaatagagtataacaaaaattccctgtgacattcaaaggcgaattttatttcaaacaaacctaagcttctccaaacagaattgtcttagaaactaatcaataacaaacacttcactggtaatctttattttagttatcttccattggcttttcaaatagcgatacattttattaaagcttaactggcatttattgaatgctaccaaggggtctgatggcaagtggagtttactagaaagcagtgacatcaatactgaatcaatgcacttgaacggaagctgtgccctaagtgccattcagcatcacactgtcccattcttttgcagaacactgaattgatccccaaaacagtgcaggtgcagtgatacaggacaaacagccctgcggttccccaaaacccacctcttcaaatctgaagagaacattctttcttttctttgtcatcaaataaacacacctgtactaggtgctggtttctccctggaccgtagtgtagtgggagatagactgaaatacctcctcttatacttctgggcaaacctcagatacataatttgtgcatgggccaaatggccctcaagatattgggttccctaatagagctaccaaaagatcagagaatcataaggtaaggcactgagaaaaaatgaaactttccttctttcccaacgtcaaggtgatagccagattccagcctcagttgagcgatttttttttcagttttccagtgtttagttgtgtgcattattataactcagaaacattatggtagtatagcgttgcattttttcagatttctatttagtattcttatttcactggtcaatgaaatgacagaagagaaaatatcagctcattaaaattaaaaagacaccacccactaatgttgattgctttaaagcaaattaatctctatacatgcagaaggtgctatggttccctgttttgtgtgtgtgtgtgtttgttttttttacctttttagatctggtgaatgcgaaaaccagatactcttgaaagtaagtaagtatccaaataagtgcaaattgcacttccataccagtgtatttactccagtgattgcatggattttatttgaccatgtgataattagagcacattcaaatcacaaattcccattttacactttttgagtttttttaaaccagaatgcactaatggcctacagagtacttcagtgttaggtgatcagagaaaccatttatatgatgttcttgctaatggggaactttaaatgtggggaaggctatcgtcatgcatggaggctctaaatggccagaaaagggaaccagtataatcatcagagagcagttttacatgtgggtgagttgaatgattgttatagattcaagctatataaatgaaggtactttaagaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaatacacatacacagacacacatacacacaatttgctattggtttggtatggacaaattaatgtacagataatatacaggtttaaaaattaaaatacccattctgcactaatggcaaatgggaaaatagacgggaaaagagaggcaggtttagcctgtggacaagttgagagccttctttttctcctccatttctttttatttcagttccttctttcatctgtgcctaagcccactctgagccaggtgaagagaatggactcataaaaatgttgactctgaggtgtggacaaggcaagtgttacctttcccacaataggcttataaggattttgagagggatatatggagacagccattcttattggatggaacaatatcctgatggtgacattttaagcattagcaggtaattgcctcttctgtgtatgaggaaagctctccctggacaaagatcagttgccaatgtgtgtttagatgaaactgagaatagtccccactgagccaccagtgggatcgggtagtgcctgttgtgaggagaccactggccagacaagttggggacaaaggaacagaggagtggagaaaagcagaatgggaagatagagtctgggtaatgggagagaatagggcggggatgaatccctgggttcaaatcctggactactacttaactaacgatcattttgtagcttaatacctagtcaggaagtgagttgttaatcaagttattcatatgttcaccaaatagctattgaacttactatattacaaacatggtaggtgctatgaggaaaaagtacatgtcacgagagacctgatctagtctggggcatcagcgaacttcactgatggagcttcacattctgagacagtgaaactcgagttgaggtataaacaaggaatatgaaaaatgaagagttatttagacaagggtatgtgaagggaaaattcctgaaggaaggaagagcaggcttaagattcctaaggcataacaagagaatacagtatgttctaatgcactgcatgaaagccagcatgtctggagcacagcacataaaagtggagaaagctgaggctgaggagttgagaagggggcggagacttccaggtctacctgtccatggtaaagcacttgaacattagtgtaaggacaatgggaagccattggcaggttttatggaagatggtgttttaaatagatgtttctggaagtgtaaggtggacaatggattaaagtagacaccacactgaaggcatggtgactatttaggcagctgttagcagcagtctggacaaggtatgatggtttcttggactaaggtagaatcaaggagaaaaatgaatggattgtgtgaccttgaacaagtagcttcacctctctgagcctaattaagcttattttctttcaggtttggcctaacatatctaatgaatacactgggttttgcctctcagattatctgctgcgcataacctcccttatacgtgttaactattcaaaaaaaagttttatgtccacacttgatttatgaatgaaacatagaactagcttggagtctttagaatttattcagaattgtattaaattacttcctttaggctgctggtctggatgagttatacatttttgtaataaaaattggctttcaaatgaataaaagaacactgacatgccaccacacatgttattcctctcatcctaaagtactgaacaaaaggaccaatagaagactccccagcattcagcagtaattaaatacagatacacttatttaggaaactggtaacaggaaagagaaatttagcgccagctatctgagaaaagacagcccaaggactacattttgttctgagagttacaaacacttccaaacagaattaaaaagaaagtgcctttcagggctataacatctttccatacaactttgaaacttggcaaacatttcttgccagctcatcacactaaaccctgtaataattttgcacggtgtccaattgtgataggaaactagtagctctgtgagtgaagatttctattctgggtatccaaataacattcccagtggagaggagaaaaacactgaaattagatgcctatgtctttcaaatggttcagttccatttgattgatacgtgttgtggtacatgttctctgggcaagggcttgggctagatatcttcaaagaaggtagtcatggggctgtccaatcacttccttatcccacttgactaagcaagaatccttttgtctaataggaaggctaaagttagaaaccagggatctgtaacacaagaaagagagatataattaccttaacaccttaagaaagggaaaagagtgagtgaaataggggtgattcaaaggctaatgtttattaaaatcttctgtacaccacctactttaacctcattttatcctttgggcttcataacagctcttatgatattattatttttattattatcccttactcacaactgagaaaactggggtttccttagttgtgaagcttaagcgacttgtccaaagtcattccctgctctatctgatttcaaaagatatgctctttgcactgtactgggaagcctaagccaagtgttcgtgagttttgtagagaaaagtatagaaaactcaaattacaaaccccatggggaaatggagggagcaatgtgagacacagaaaaggggggggggaaaaacagctccaaactagaaaaaataaaacaatacaatgaaacgttgagacgattaactagataaaggaaggattagaaatgctaatgagagaaagtatacgatgacaggtagatttgaaaagaaataaatataacttctagaaaaaaatgatgattgaaattttaaaagggaaggtcaaaataatatttgaagaaatcacgcaaaatgcaacacagaaacataaaaagatacaaaagaggttcaaggacatggaagtagaatgaggaggcccagtataaatctaagaaatgttccagaaggaaagaatcaagaaaatcttgaaagtcaatattcaaatagataacagctccaaattttctagaattgaagaaagacttggatactcagttcaaaggagcccattaaatcctaagcagagtaacaaaaacaaataaacctagacatattgtagtgaaactgcaaagccctgaaaaagaaaatcttaaaagtcagagagaaaagagatgacctattagaagattgtaagttagaagacagtggacctgatatcagcaacaataaaattatcttccaataggtgagaaaaaatagttattaacgtagaactttatatccagttaaagtcactgtattagtcttctaaggctgtcataacaaaataccacatcttgggtggcttaaacaacagaaatttattttctcatagttctggaggctagaagtccaagatcaaggtgccatcagagagggtgtctggtaaagtctccctttctgacttgcagaaggcttcctattgctgtgtcttcacatggactttcttccgtgtgtgtgtgtgtgtgtgtgtgtgtgtgtgtagagagagagagagagatatttctgatttctgttctctcttccttttcttataaggacaccagtgctattggattagggccccacttttatgaactcatttaaccttaattacctccccaaagggcctatatccaaaatagttacattacaagttagggcttcagcatatgaattttggggagggggcacaattggttccgaaacatcactgttgaagcaggagagaaaagagaaaaataaaggcttttttttttttttttttttttgagatggaatctcgctctgtggctggagtgcagtggcacaatctcggttcactgcaacctccacctcctgggttcaagtgattctcctgcctcagcctcccgagtagctgagactacaggtgcctgtcactgcgcccagctaatttttgtaattttagtagagatggggtttcaccatgttggccaggatggtcttgatctcttaaccttgtgatctgccagcctcggcctccctaagtgctgggattacaggggtgagccaccgcatccagccaataaaggcattttgagatgaaaaagctggagaaattctatgaataacaggtccttaataaaaagtactattatagggtggactgtaatggaaatttattaaaacaaagaaagtgtgagttgtaagaagcaatggggaccagtgttattgataaagtacataaatcttaataagcatgggctgcataaacaacaataatcattactttaagaaggttgaaataagaaggaataaaactcttggacaacagtaacatggaagatgaagagaggtaataagatttaaaacattctgaatctttgcgttttgtaagaggaagatgaagatattggtcaacttcatgcttttcaaagttaagtattatgtaaaaaacttgtgtgtaccactaaaaggatggtaataaaacataaaacttccaaaccaatagaaggcataaacgaaaaaatgaaaattgtcaataaaatggtagacagagaagtagagacaacacggtaaatacaaaactcaaaattaggtcataggaataatcaggaattataataagtatagataaattacttggtttaaagataaagattctcagtgttggattttcttttttattattattatactttaaattatggggtacatgtgcagaatgagcaggtttgttacataggtatatacgtgccatggtggtttgctgcactcatcaactcgtcatctacattgggtagttctcctaatgctatccctcctccaccccccagtaggcctcagtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgtaaaggacatgaactcatccttttatatggccgcatagtattccatagtgtatatgtgccacattttcttcattttctttatccactctatcattgatgggcatttgtgttggtttcacgtctttcctattgtgaacagtgccacagtaaacatatgtgtgcatgtgtctttatagcagaatgatttgtaatcctttgggtatacacccagtaatgggattggtgggtcaaatagtatttctggttctagatccttgaggaatctccacactgtcttccacaatgattgaactaatttacactcccaccaacagtgtaaaagcattcctatttcttcacatcctctccagcctctgttgtttcctgaatttttaatgatcgccattctaactggcgtgagatggtatctcattgtggttttgatttgcgtttctctaatgaccagtgatgatgagctttttttcatgtttgttggctgcataaatctcttcttttgagaattgtctgttcatatccttcatccactttttgatggggttattcgtttttttcttgtaaatttgtttaaattttttgtagatcctggatgttagccctttgtcagatggatagattgcaaattttttctcccattgtaggttgcctgttcactctgatgatagtttcttttgctgtgcagaagctctttagtttaattagatcccacttgtcaattttggcttttgttgccattgcttttggtgttttagtcatgaagactttgcccatgcctatgtcctgaatggtattgcctaggttttcttctagagtttttatggttttaggtcttatgtttaagtctttaatccattttgagttattttttgtataaggtgtaaggaagggatccagtttcagttttctgcatatggctagccagttttcctaatgccatttattaaatagggaatcctttccccatttcttgttgttgtcaggtttgtcaaagatcagatggttgtagatgtgtgttgttatttctgaggcctctgttctgttccattggtctatatttctgttttcgtgccagtaccatgctgttttggttactgtagccttgtagtatagtgtgaagtcacgtagcgtgatgcctccagctttgttcttttggcttaggattgtcttggctacacaagcactgttttggttccatatgaaatttaaagtagtttttttttttaaattatactttaagttttagggtacatgtgcgcattgagcaggttagttacctatgtatacatgtgccatgctggggcgctgcacccacgaactcgtcatctagcattaggtatatctcccaatgctatccctcccccctccccccaccccccaccagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttccagttctagatccctgaggaattgccacactgacttccacaatggttgaactagttgacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatgatgagcattttttcatgtgttctttggctgcataaaatcaatgtacaaaaatcacaagcattcttatacaccaacaacagacaaacagagagtcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaacatcgtgaaaatggccatactgcccaaggtaatgtacagattcaatgccatccccatcgagctaccaatgcctttcttcacagaattggaaaaaactactttaaagttcatatggaaccaaaaaagagcccgcatcgccaagtcaatcctaagccaaaggaacaaagctggaggcatcacactacctgacttcaaactatactacaaggctacagtaaccaaaacagcatggtactggtaccaaaacagagatatagatccatggaacagaacagagccctcagaaataacgcagcatatctacaactatctgatctttgacaaacctgagaaaaacaagcaacggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcatagcaaaagaaactaccatcagagtgaacaggcaacctacaaaatgggagaaaattttcacagcctactcatctgacaaagggctaatatccagaatctacaatgaactccaacaaatttacaagaaaaaaacaaacaaccccatcaaaaagtgggcaaaggaaatgaacagacacttctctaaagtagttttattcaattctgtgaagaaagtcaatggtagcttgatggggatagcagttaatctataaattactttgggatatatggccattttcacgatatcgattcttcctatccatgagcatggaatgtttttccatttgtttgtgtcctcttttatttcgttgagcagtggtttgtagttctccctgaagaggtccttcttgtcccttgtaagttgtattactaagtattttattcttttagtagcaattgtgaatgggacttcactcatgatttggctctctgtttgtctattattggtgtgtaggaatgtttgtgatttttgcacattgattttgtatcctgacactttgctgaatttgcttatcaacttaaggagattttgggctgagacgatggcattgtctaaatatacaatcatgtcatctgcaaacagggacaatttgacttcctcttttcctaattgaataccctttatttctttctcttgccttattgccctggccagaacttccaatactatgttgaataggagtggtgagagagggcatccttgtcttgtgctggttttcaaagggaatgcttccagtttttgcccattcagtatgacattggctgtgggtttgtcataaatagctcttattattttgcaattatgttccatcagtacctagtttattgagagtttttagcatgaagaggtgttcaattttatcgaaggccttttctgcatctattgagataattgtgtggtttttgtccttggttctgtttatgtgatggattatgtttattgatttgtgtatgttgaaccagccttgcatccgagggatgaagccgacttgatcgtgatggataagctttttgatgtgctgctggatttggtttgccagtattttattgaggattttcgcatggatgttcatcagggatattggcctgaaatttgctttttttttttggttgtgtctctgccaggctttggtatcaggatgatgctggcctcataaaatgatttaggaaggagtccttctttttctatcatttggaatagtttcagaaggaatggtatcagctcctttttgtacctctggtagaattcggctgtgaatccatctggccctcgacgttttggttggtaggctactagttactgcctagacttcagaagttgttactggtctattcagggattcaatatgtgtccaggaatttatccatttcttctagattttctagtttattcgtgtagaggtgtttatagtattctctgatggtagtttgtatttctgtgggatcagtggtgatacccctttatcatttttcgttgtgtctatttgattcttatctctttccttctttattagtctgggtagtggtctatatattttgttgaccttttcaaaaaaccagctcctggattcgtttttttgtgtctctatcgccttcagttctgctctgatcttagttatttcttctcttctgctagcttttgaatgtgtttgctcttccttctctagttcttttaattgtgatcttcggatgttgattttagatccttcctgctttctctcgtgggcatttagtgctacaaatttccttctaaacactgttttaaatgtgtcccagagattctagtatgttgtgtctttgttctcattggtttcaaagaacatctttatttctgtcttcatttcattatttacccagtagtcattcaggagctggttgttcagtttccatgtagttgtgtggttttgggtgagtttcttaatcctgagttttaatttgattgcactgttgtctgagagactgtttgttatgacttccattcttttgcacttcctgaggagtgttttacttccaattatgtgggcaattttagaataagtgcgatgtggtgctgagaagaatgtatattctgttgagttagggtgcagagttctgtagatgtctgttaggtctgcttggttcagagctgaattcaagtcctggatatccttgttaattttctgtctcgttgatctgtctaatattgagtcgggtgttaaagtcccccattattaatgtgtgggagtctcagtctctttgtaggtctctaagaacttgctttatgaatctgggtactcccgttttgggtgcatatgtatttaggatagttagctcttctggttgtattgatccctttaccattatgtaatgcccttctttgtgtcttttgatctttgttggtttaaagtctgttttatgagagatgattgcaacccccctttcttttttctttttcttttttttttttttgctttccgtttgcttggtaaatattcctccatccctttattttgagcctatgtgtgtctttgcacatgagatgggtctcctgagtatagcacatcaatgggtcttgactctttatccaattttccagtgtgtgtcttttaattggggcatttagcccatttacatttaaggttaatattgttatgtgtgaatttgatcctgtcattatgatgttagttggttattttgcccattagttgatgtagtttcttcatagtgtcaatgatctttacagtttggtatgtttttgtagtggctggaactgattgttcctttccatgtttagtgcttccttcaggagctcttgtaaggcaggcctgttggtgataacatctcaatgcaaggaagctaacaaccttgaaaaaaagttagaggaattgctaactagaataaccagtttagagaagaacataaatgacctgatggatctgaaaaacactgcatgagaacttcatgaagcatacacaagtatcaatagccaaattgatcaagaggaagaaaggatatgagagattgaagatcaacttaatgaaataaagtgagaagacaagattagagaaaaaagaatgaaaagaaacgaacaaagcctcaaataaatttgggactatgtgaaaagaccaaatctacatttgattggtgttcctgaaagtgacagggagaatggaaccaagttggaaaacactcttcagcatattatccagaacttccccaacctagtaagacaggccaacattcaaattcaggaaatacagagaacaccacaaagatattccttgagaagagcaaccccaagacacataatcatcagattcaccaaggttgaaatgaaggaaaaaatgttaagatcagccagagagaaaggtcgggttacccacagtgttgtattttataaagaactctgctctatggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaaaaaagaaaaaaaaagaactctgctctatgcttattaaactggacattactaaaacataatgacagagaaatgttgaaagtaaatagatgaaaaaataaacaccagacaaatattaacttaaaaattttggtttaggcaatagttgacaaaatatatattaatgaccaaagcatcattaaaaataaagaaggacattacttaatgatacaatgaataatttcatacacaaaataaccatcctgaacctggttcatctaataacataccttcaaaatatatgcagcagaaattgacagaattataaggagaagttgatgagtacacagtcatactggggaattttaacatactgtactcgtataaactgatagatcaagcaaacaagtattgagggtatggaagatttgaataacaaaatggttaaatctgatccaatggacctgtatacagccctgcacccaacaataaggtaatacaaattcttttctaacaaatagggaacatgttcaaaaatttaccttttactgcatcctgaagaaaatctgtagtaccaaaagccagtattctatagaccagattatttgataaagatgcaatatagtgtgaaatccacaactataaactagattataggagaaaacaaaaccttattgtcaactcagtaggtacataaaacactctataaatttcgaaaaataaacattaagccacctgacaaactggaaatagatccttcacctgataaaggttatctagcaaaatcctatagccaacattatacttgaacttgaaatactagatgtccctttcaagtcaggaagaagactgataagaaaacctctcaccactatttttattgggcattataattgccgtcctaactaattataaggcaaagaaaaatgtaaggtcaaaaatatattgttagttttcacagatggtatgttttctacacagataatgtaagagagcatgtagacagactaacatagagttcaaccagtcttctgggtatgggatcaatatgtaaaaatccatagtcctcctctataatagcaagaaacaagaagaaaatgttataaaaacattttctgacaacagatatggcatccataatcatgcactgctgtctctcatcttacttctgactttctttcaggttttaagttgtttctgcaagatttgttacctccttcttccctgccacaatatgcttgagctatgaggttttctcttattttttccagaccctctaaatagcagttaaccaatttaaagcaaaaaatacaaattaaggtgaacaaggtagttgagaagaacttagagaatatccctcagtcatagttcctctttcaagtatttagtggctttgatttggctactgctatggaaattgaatatcaaagtgaaaatgctgatttttctggtaccggcttaagcaaaattcaacttattcctatctacctaagtaaaggatcccccactagggattgtgtgcccccctcttagtgtattcaagcaagaagtccatctagttactttccctttaaaaaccagtcccattgaggaaattgaaaaaggtaaaaataaatggaaagatacctagtgttcatggactagaagaattaatattaaaaggtccatgctacctaagatgatttacagattcattgcaatccctgtcagagtaccagtggcattcttcactgaagtagaaataacaatcctaaaatttgtgcggaatcatagaagaccccagatagccaaagaaattttgagcaaaaagaaggaagctggaggtatcacactaccttacttcaaaatatactataaagttacagtaatcaaaatagcattgtcctgacacacagactagtgggacagaatagagagcctagaaataaatccatgcatttacaaccaattcatttttgataaaggagccaagaacacacaatgaggaagggacagtctttaataaatgttgttgggaaaactgggtatccacatgcaaaaaaatgaaacaagatctgtagcttacacctatacaaaaacaactcaaaatggattaaagatttaaatgtaatactccaaaccacgaaactactagaggaaaacatgggggaaagctccgtgacattggcctgggaaatgatttttttggataagaccaaaaaagaacagacagcaaaagaaaaactagacaaatggaattacataaaactaaaaagcttctgcacagcaaaagaaacaatagggtgaagagacaaactatatatgggggaaatattttcaaactatacatttattaaggtgtaaatgttcaaaatatataaggagctcagagaacgcaatagcaagaagacaagtaacctgattttaaaatgggcaagggacttgaatagtcatttctcaagtgaagacatacaaacggccaacaggtatatgaaaaaaacactcaacatgactaatcaacagggaaatgcaccttaaaaccacaataagataccacttcataccctttactgtggctattatcaaaaaaacaaaagttaataagagttggcaaggatatgggcaaaagggaacccttgtaccctgttggttgtgcatcttagttcattttctgtttctgtggctgaatacctgagactcagtaatttattttaaaaaaaaataagtttatttattgcaattctggaggctggaaagtccaaggtaggtgggctgcatctaatgagagcctcatgctacatcataatattgtggatggcatcacatggtggagtgcatgtgagagtgggcatgtgcaaaagagacaaaacatgaggagtgacctcgctttataacagcattctctctgggtaactaatgtagtgccataagagtcagaactcactcactcatttgagactgcattaatcccctcatgagggtgaatccctcataacccaaatgccttttgaagctcccactaccccttaacacagttacattgggcatcaatcctcaacatgagttttggtaggagcaaaccatattgaaaccatagcagtgggaatgtaaattagtacagccacccaggaatattggtgaagatttagaaaaagatcatggatgattgtagacataaatatttaggtagctgcagagcctgttggagagtcaattgtagaggacagcagttatcttgaacctgcagattaatgtgatacaaagtttgtgaaaggtagttcttatatattaagttctgaattactaaagaatatgaaactatatctaaaatgaggaaaatggtgaagaagctgcattgtctataaagaagagattttaaaaaatgaaaaatttaatggaaaatagggacagaaggactagaaatatagaatagttggaagggaatacaaatgcaaaacaaagtaaattgtgaaaagaagaagcactttatatagaaaaaaaaacagaaaaagtatgtttgcatgtgcatgtgtgtgtctgtctttgtgtgtaaataatatgttctccaaacccagagccttctaatgagaaaaaagttactttgaacaagtatatacgttaaatgaaaattaagcaccaacacatattctaaagaataaaaagaaaaaacttgcatatatgattaccacaatggagaggagtcatatgcaggaaaagtagaagcttttataggaaaaatatcatttctgaaatatatatattgaagaaacaatgtcaaacaaaccaaaaagcagtctgtgaacacattaggaattgccctactttgttaaatggaatgacaaaattgactaatatttggtgagctcagggtgtctgctgctttcaagagcataagatctgtatcgttagctagttatttaatttatagaaatatactagaattagaatttatttgcaagagaaaatgctaaattgaagatggaaaactcccattcactatagcagcaaaacccatattagatctagaaatatacctcacaaaagatatgcaagatatgtaagtacatattatgagattttattgaagaacataaacaataatataaatataaataatagaagaaatatgccattttagtgatttggaaggctcattgtcataaaggaattaattctccacagattaacatatgatccaaggtccccaagcttactagtaatgagggaaatgtacattaaattcaaaataattcacaaccatcaaattagtatatattaaaaagcagaataataccaagtggtgatatcccaaagatgaaaggaattgggacttttgagggactatcaatttatacacctgccttggacagcatgtggcaacacctagcaaagtcaaagatatgcacaccttattataatcccaactcccacttctagatattttccatggagaaatcctggcatgtgtatacaggagacataaacaagaatgttcatttccacagtataaaattaatgtccaacatatgggaatggattaatactatcaatagcagcatgttttaaaatggaaggctatatggcagtttaaagtagctaatcacatccatatacttctacaaaaatgaatctggaaaatagtgttgagtgtgcaaaagaatttagaaaacattatgttccatacatttatgcaaaaggacaggaaaattggtcatgcctagagggtctctcagggcttttgtgtattgggccccacaaaaccgaggaaagttctctgaggagattgttggaaaagttcagtactgtctcctcgtgcctgacaaacctgaagcagtgaagcagagaggtcctcctggccttttttacttagagaatattctctctctctctctctctctcttttttttttaagaacattcttcactttatcattggagaaaagcctggtgttaagaccatctattattgtggcagtgactcaggtatactgtctggtggctctctgccaaagagagttgaggggtcaaatgactaaggtttctagattaaaaggacgagtttacaagctgaaccagaggaacttaaattgtgtttttttttctctctcttttttacgcatcactgaaaactttttgaaagaaaaagttcttagtggttattctaatcacctagcttttggttggtttttgttaaagattagaacgtcacttctcaaaattcagcacaattttcatgctttgggccataataataatgaaagtgatactaaaagacttttttctttctccacccccttttctttcaatctcagaacacaaaagatgaaggcagttttgaagagttaactttttggttgagtaatccccttgaatgcaatgtaactttaaaagagagaaaaagggaaggctagcagagatcaaatcaggacctcatggctacccaggctcctgtcaccatacgtaggtggtaaagttaggtggtagggttcatgggtcctggggtttgatctgaaatctcctctgcatatacgaaagagcatggctgaattatgtattcatttggaactttttctcttcattccaggaacctgcaactattataatacatttgttgatgtgtaactttgtgctaataaacagttctgatgcaattattgatttacagattttttcatcttactttagtatgttcacacattatgttgagaatcagtgtgtacagatactattttaatattatagagttaatggtcaattctaacaactgatatagaaaattggacctggtcctctgtctaaaaaaggacattttactcatttatatgactaaattgtgactgtggaggtttatgagtcagtatttgttaaataaatggattgatggatgggcagaaggaaggaagaattgaaggaagaaaggaagaacagacagaacagacagatggaaaggagaaatctgcttgaaaatagctttcatgaagaagatattcactttataggaacattgtcttttatatttaaaatatctgtcctcttactttggatacccagagtgccagccacaggatgcttgctatttatgatcttgaaaatgtttgaagcccttccagggagtaagggaagaaaatcacatcaaagctacactgcgccttttccttttctggttttgtgttcaaacatagcattcaagacgatgcaggtatttgattgtgcagagttaatattcccccagaaaatcaaaatagctgaattataaatagcctctttagattttttagtatagttctttaggagaatgacattcacacaaaaaagtgcacagatcctaagtgtatatctcatcaaatcttcacgaattggagaaaccatagtaatcagcacccatataaagaaagataacattaacagcaccccagaatttcttctgtccttttcttctaaaccttatttctcaccaaaaggttaagtgctataacttttaatatcattaatttgatttccctattctggatattcatataaatggcatcaaacaatatgcagctcttgtgactttcttctttcagttagcatatcgttttcaaggctcatccatgttgtgacatgtatcggtaatcattcattcttactgccaaataatatttcattgtatggatataccaaaatatttgtacccattcatcagttgatggagatttcagctttttctactttgtggtggttatgaataattgtgctatgaacatttatgtacaagtttctgtgtggacatatgttttcaattattttgggtacacgttttctctgggtatacattccatttcttttgggtatatacctggtagtggaatttctgggtcatatgcaaaactgttttcaaagtgacggcaccattttaaatttgtattagtaatgtataagtgtttcacttgtttcacatccttgccaacactccgtatggtcagtgtctttaattttagccattctggtggaaaagtttgtttttttttttcttcttgacaggtttttatataatgttgtgatactcagaaaataatactgataccaacttctataaattaactaatcttaagtcatttcctatccagggatttaattggagcgacaagtattttcctgtcatttctaaaatatgtggacaaggccttcaagatttagctcagatgccccttcttatagaatctttgcatccaagttctgggagggcattagaggtcatctacccaatcccatcattttatagatgagacagttgaagctcagggaagggaatggacatgaccaggcaacatgggcctagtgggcaagtctcctgactttagtccatggttctttctgtctccccagacagctttgtctactcatctttgcttctccttcgctgctaatttgaagagattgaaattcatctttgacaggaaaaaagttgtaagtttctagggcttaaattgaacatcaaagaagcagctctcctcccattgaaggctcgcatgctccatcactgaaaactactatcatttaagccagagaaagaaaacttaaagtgacttttcagcaaataccatttttaatacacacataatatcttctgttttatactctgatcatgattaagaatttcaaatagctcaggaagaattaaggagatttacacccacattattactcataaccacttagagcaaagaaggaaatcttttaaaaggatgtttattgctttcataccaaatgagaatctgaattaaaatgattcctagcacagtctttcgagttgaaagtacattcagccgttttcaaaatcccttgtaataacaacaatgcttggtaatttcatggagtttgtattttttcaaaggagattagggtaaatgctgtaaacatgaacttcctaatccttattttgtgatgactgccctgggccggtcttgctatccttggtcctcagatggagatgctaacacagagtggctgtccaggtttcaaggtttgatctcttggctcactgtgaatttacttcaagtgggagaaccttagttcttcagtaattatctaaccctcagttcctgagctgtaaaatatgaggattatatacccatttctgaggattaatttgtgtaaaacacgtagtactagtaggtgttccttatatggttggtacttttagattctttgctggagaaggctgttgtctaggaacaaaagtggcaggctttggggattccccagacacttatattcattcattaatatattgagaaagcaaagattggttgcttcctaaccctgtatgagaggacttcaagaagttcatgaaaaatatgtattataaaaaattgcacatgaatttctatttatttttgcaccaaaataaactcatactaacttggtataacatatctgaacaggacctagttttgaggcactaagaaagataagacattagtttgaaaagagcccttatcacagcaacatgaattctgctagaattgaagcaaaaataaacataaaattcatcttgaagattggtggaaaaatagtgaaatcactgatgctttataaaaagcttatggggcaatgccccaaaggaatcagcagtttacaaatggataacttgtttaagaagggataagacgatgttgaagatgaagcctgaagcggcagaccatccatatcaatttgtgaggaaaaaaatcatcttattcatgccttaactgaagaggactgacgattaacagcagaaactatagctaacaccatagacatctcaatttgttcattttacacaattctgagtgaaaaattaaagttgagcaaactctccactccatgggtgccacacccattgcatccagatcagctgcagataagagcagagctttcaatggaaattttaaacaagtagattcaagattctgaagcatttcttcaaagaagcataacaggagataaaacctggcttgaccagtacaatcttgaagacaaagtacaatcaaagcaatgactacaacataatactgaatggggaaaagttgaaagcattccctctgagaactggaacaagacaaggatgcccactctcaccactcctcttctacatagtactggaattcctagccagagcaatcagacaagagaaagaaataaagggcatccaaattagtaaagaggtagtcagactgtcactgctgacaatatgattgtttacctcgaaaaccctaaagactcctccaaaaagctcctagaactaataaaagaattcagcaaactttccggatacaagattaacatacacaaatcagtagctcttctatacaccaacagcgaccaagcggaggatcaaatcaagaactcaaccccttttacaatagctgcaaaatacaatacaatacaatacaatacaatacaatacaacacaacacaacacaacacaacacaacacaacacaacacttaggaatatacctaaccaaggaggttaaagacctccttgaaggaaaactacaaaggaagactacaaaatgctggaaagaaaactacaaggaaaactacaaaatgctgctgaaagaaatcatagacaacacaaacaaatggaaacacatcccattctcataaatgggtagaatcaatattgtttaaatgaccacactgccaaaagcaatctacaaatttaatgcaattcccattaaaataccaccatcattcttcacagaactagaaaataaacaatcctaaaattcatatgggaccaaaaaaagagtacacatagccaaaacaagactaagcaaatagaacaaatctggaggcatcaggttacctgacttcaaactataccagaaggccatagtcaccaaaacagcatggtactggtataaaaataggcatgtagaccagccgggcgcggtggctcacgcctgtaatcccagcactttgggaggctgaggcgggcggatcacgaggtcaggagatcgagaacatcctggctaacatggtgaaaccccgtctgtactaaaaatacaaaaaaattagctgggcatggtggtgggtgcctgtagtcccagctactcgggaggctgaggcaggagaatggcgtgaacccgggaggcggagtttgcagtgagccgagatcgcgccactgcactcaagactgggcgagagcgagactccatctcaaaaaaaaaaaaaaaaaaaaaaaaaggcacgtagaccaatcgaacagaacagagaacccagaaataaacccaaataccttcagccaattgatctttgaaaagcaaacaaaaacataaggtgtggaaaggacacccttttcaacaaatggtgctgggataattggctggccacatgtaggagaatgtaactggattctcatctctcaccttatacaaaaatcaactcaaaatggattaaggacttaaacctaagacctgaaactataaaaattctagaagatagcattggaaaaacccttccagacattggcttaggcaaggatttcatgaccaagaacccaaaagcaaatgcaataaaaacaaagataaatagttgggacttacttaaactaaagagctttttagacatcaaaaggaacagtcaacagagtaaacagacaacccacagagtgagagaaagtcttcacaatctgtacatcggacaaaggactaatatccagaatctacaaggaactcaaaccaatcagtaagaaaataaccacacagtcccatcaaaaagtgggctaaagacatgaatagacagttcttaaaagaagatatacaaatgtccaacaaacatgaaaaaatgctcaacatcactaatgatcagggaaatgcaaatcaaaaccacgatgcaatacctccttactcctgcaagaatggccataaaaaccaaaaaaaaaaaaaacagtagatgctggcatggatgcagcaatcagggaacacttctacactgctagtgggaatgtaaactagtacagccactatggaaaacagtgtggagattccttaaagaactaaaagtagaactaccgtttgacccagcaatcccactgctggatatgtactcagaggaatgatatatgatatatacacacacacatatctatctatgatggaatactactcagccataaaaaggaatgaattaacggcatttgcagtgacctggatgagattggagacttaagtaaagtaactcaggaatgggaagccaaacatcgtgtgttctcactaatatgtgggagctaaactatgaggacacaaaagcataagaaggataaaatggactttggggacttggggggaagggtgggaggggggcaagggataaaagactacaaatagtgtgcagtgtatacagcttgtgtgatgggtgcaagcaaaatctcacaaatcaccactgaagaccttactcatgtaaccaaataccacctgtacccccaataacttatggaaaaattaaaacaaaagataaaaatcatgaaaataaataaaaataaaataaaatatagaaaattggtgtttcaaaaacaaacaaaaagcaatggctactaagaggtggaagcggtcaaagcaaaagtaggccagtcaagacatgctcaaggcattttgcttgttgactttcgaatggagggccaaagaatgataacatctgcttatgacaggagtgttttgagaaagcaaggcgcagctttagcagaaaaatgcctggaaaagcttcaccagagagtccttctccaccacaacaatactcccactcattcatctcatcaaacaagggcaattttgtaagagtttcaatgggaaattgttatgcatctactttaagtccttatttggctgctgctgacttctttttgtttcctcatcttaaaaagatctgtaaagggcactcatttttctccagttaataatgtaaaaaagactgcagtgacatggttaaatttccaggatgctcagttctttagaggtggactaaatggctgggatcatcacttacaaaactgtcttgaccttgatggagcttacattgaggaataaagtttatattttttatttttatcttttacttccattttttccactaactttttgaaatatcttcatattagtgtaatgagtgtgtgtgtgtgtgtgtggtgtgaaaacaaaattttcacattaaagcatgtcacattctatttttattatttttaacttatgatttttataaataaccattattaccagtgctaggttccaggatactaaaacaaggcaaagttggaaagaatgtttccatacaaaaaccaatatataacataaagatatgaacagatgaatgaactataaagcaacttctgctaaactggtaattgttagaactaaagcttcagagacttgtaatttataccaactcctggatatgggatattccattgttggattgatggcctaaaataagagaaacatcatttttttcagaagaagttttagaacatggctgaaatccgtcataatgcttaaccttgaactctcagatatcagtgctaattcatattttgtagggcaaatataggacaagagaaactgcacaggcagactgctagtgggtggaaaaatgccctttgactgggaatcaggagacttggctttttgttctagatcagtcactgctttatagggtgacctgagcaagtcactttaatgttgtggatcttactttcctcatttgaaaactacttgtttagtcaaaactattaattataaactatgttctgtagtaataggcttccacagaggtgccacagagatcactgcaggagggactctgcgaccttaatccccaactatgacccaagtagttcttttgtccactggtctatatataggggctattcttggggtttcatttgaataaaaggttctaaggtctgagtaaaatggggcactcccaggctaaatgatcctgacttaggatacacaacctgatcaaggttcttcaggttttaaggttctgtgatatctggataaccaaagtaggtgtttgtgacattctgtaacttatctgtctgtgatatgttagccagttctagggctggaatgatgatggtaatagacatgcccagtgatgaatgacctaccatgctacctaggacatcttacaccttgattattgaatttaaaagagcttctgaatcatcagagaaagatcaaatttggcttagttgtcattttactattgtatatttctatctgtgtgtggtatatttagtgaggctttaagtatatttggtgggtctccagtaactagaatgtttcattgacctatatatgccattccccagttatgccaggcagttgaaagtttatcgaatcagactgaagaatttgaagttgaggcaatgcttctcacacctatataaaagatgtcatgaggaagaaccagagaggaggagtgtgtatgaagtattggtcaattttttatacacatatagtaaaggctgatttatttgaggcatagtgttatttcaggcaatctgaattaactatgactaaaaatggctgttctgagctattacatttccaagtgactaaaaaacacgtgcatgaaagcaaaatctagattttgtcagaatacacccaacatctataagaaaataagctggaggcatatagcacattctattttaaaacatagtggcctccctttgagagaaagtggtgctgttagtgtcattttacttgagagagataactttgtggcactagtgatgcttttatgtgcatttatccatttttatcagcctctttattccctattcattcattcatttttgctttttactctatctctgtaggccttaatgcttttgatatttggctgtatttatgtgttcatgcaatccaaagcagacagagcacctcctgattcaaagcaaggctctgcgtttggcactgttggggatatagagatgattagccactcttcttagtatgttattgcattttagaagataatgtcttgaagatagattattgtcttggatgaagcccctgattaagactggagaaagaaagttgattaccatatccaagatggaggctaagggggaagacttgaaggacatggatcctatacctctttttttattgcacctcatctcattgtatcacattgatctgttgacatatgtctcttccctattagagtgccttgagagcaggcttttgactcaatttgaatggctagaacctagcacacttcctacagagttggttatgcacctactcagtgaatgacagacatgagtctgagctataacttgggagggactgttctagaaaagtaaaatgtggtgaatatatgttactatgtagtgttttaaactgtcattgacatctaggaagaagatgttaattgacttggctttggactgtggcaggaaaacatttagatctcgctcaaatgttcatgacagtcttatttaaaaggtagcctacattgttctccttactgcttattacaaaaatgcacatatcccagaaatcaaaaggaatgctatgggattccgaaacttattgccatctgggccatgtgtggctgaactatgaaaagtcattcagtcagcaagatagaaataacatctgcataggcagacaacttagcagactcagaccagctttcctctgaagcccagctgccattgtgactcatggcaagttcccagcttgaaaaagcaaagaactgaaaagcagaggtacctaacccagagtggagaccataaagggcagggaagcacacaagtcagtcttctgacattcctgaacaaatagatttcctttaactcatttatctccatggagtcaggttgactgttgggcagagaagttggagagttggaggggaagagtgacagaaacattttaattacaaagttaggttcgttatagaaatgcaagcctgtctcaacagttggtaatcagtatgatagatctctcagtatgagagatttgaagtaaataggccatatcatcagtagaaacagaaaaaaagctaattctacccaactgtatgtttgtacccattaaccattccctgtctacctccccctgccactacccttctcagcccctggtaaccattattctactctctatctccacgatttcaatttttttagcttccacatatgagtgagaatatgtgatatttggctctctgcacctggataattaaaaattttaaaaattaagaaaataatgccaactcttaaacacgtcgaagtgcatttaccataaaccaatagtaaacatcataataaatagagaaatataaatggcattttcattaaaatcagaaacaagacagggatttccccattgttactactattcaacactgttttagaagtactcgttagtgttgtgtgccatggaaaagaaattagttttataaataggaaaatgacaaaattattattatttgcatacagtaccactatatatctataaaatccaagagattcaactataaaatcatttgaatgaataagaatttaactgggtggcttggtgcaaaatatatattattaaacaattgcttttaattatactgacactaaccagttagaaacaggacaaaatcccattcacaaacaaggtagtaatttaaaaaattacccaggaatagaattaattaggacaatacaattatgacaatacaatctatgtgagattaatcacaacattgtattcaatagaaaaaaaaaaaaaaacaagagctgtagaaggtgagagacataccatgccccctgcatggcaagaattatgttatcttaagcacttaataatattttttaaaacttaagatcatgattctaaagtttctatggaagaacacaggtgctgcaattgttaagggaatcttaggaaaaaagaaaagtgaaggaaaagtgccccgttaggtatgaaatttaatgtaaatgagagtaatattggtccaaatgtggacaagcaaatcagtggaacagaatggagaatacagatccaggtatttgtgggaatctgctgcatgataaaagtattattgaaatcagtagcaaaactgtgactttttcaatatatggtgttagaagaaaataaaaatagaactgcttcttcacaacatgtacaaaggtaaattctagatatattaaaagtaatgtaaaaaagaactactgaagtattagaaaacggtataaaaatatgtatatgtctgtggggtgatgttccttaaacaagacatagatccatgttctttaaagaaaaaaaatctctacagatttaattatataaaattaatctattggaagaaaatatttgcatacatctgatagaagaaagtcttgatgttactaatataaaaatactcctacaaattcataagagaaaagaactacctaatagataaatgaacaaaggatttggataggcaatttaaaggagaaattacaaatttgttgaaacattcatttggaatattattaggttggtgcaaaaataatcgtgcttttgccatttgacagagggagtaaattaacatatatgataaacccactgtatgctaggtactatgaaaagtggaatatatcttctcatttaagcctcaaaactcattttacaggcagttaatgctaatttagccattttacacataaggaaattgaggcttaatgagtttgactaactcttccaaagtcatgcagtccaaaagtggcaaagctagcatattttctggagatgtattgtacagcatggtgactatagttaacattaatgtgctaagagagtatacgagttagtgggtgcagcgcaccagcatggcacatgtatacatatgtaactaacctgcacaatgtgcacatgtaccctaaaacttaaagtataataaaaaaaagaaaaaaaaaaccaaaaaataaatgttctcattctccaaaataataaggatgtgaggtgatatggatatggatgtgttaattagattgatttactcattccacaatgtatacatatatcaaaacatcatgcactatccacagcctgggaaaatgtgctagttggtggcatagttagatgaatttttaggtcattaagaaaatataccccaacattgttgacttagagctgataatgcattcctagttcaaagaggacttcaagtagccagggaattcagtctattgattctggcttgactgctaacacacagggaaatcctcagcaaggctctcagatcccatgaggtagatacataagaggcttgaatgattgaaccaggagaatgctgaatgagggctctgtgtctacattgttccagggttttgaggacagaccagttattttcttaattcttgtattatcaaagcagatactcagcctggcttagtagaccctggagggtgcactgtagtagagggggccatgcaggctcttctctgtctttaaccctttattgttcaacctataaatatcgaatttgaggaacccacaggagccacgctagtcaggtttttcaattttgatgatggagagggtgtatgccaataaatattattccattcattcctttccaagttaaaagttcattgggaaataaaattcaagaggtggagaaatggagacagaatgccagaattattactaataaatccagcagaagaatttggttttagatctatagtgaaaagggttttctgacatttgtactctgtcacatcccccaactctctcaagtccagacatcaggacagcaaacccaagggaaaggttgagcccataggagccactacatttacccagggtgctgcctcttactgattcaaggcagatagtgacagaaaagtgtgaatcctcagtgcctttgaccttttttattgcaaggtgatatagtttggatacttgaccctgtccccaaaatctcatgttgaattataatccccaatgatggaggtggggcgtcgtggaaggtgtttggattatgggggcggatccctcgtggctcagttctgactttgttatagtgagttctcacaagatctagtcatctaaaagtgtgtggcacctccgaccccactctcttgcttgctcctgctcttgccgcatgacgtgtctgttctctctttgctttctgctgtgattgtaagcttcctgaggcccccgtagaagccaagtagatgccagaaccatgcttcctgtaaagcctgcagaaccatgagccaattaagcctgttttctttgtaaattaaccattctcaggtatttctttatagcaaagcaagaatggcctaacacagaaaattggtaccacgagtggggtattgctataaagatgactgagaatgtggaagcaactttggaactgggtaacgagcataggttggaagagtttagagggctcagaagaagacaggtagatgagagaaagtttggaacttcctcgagactggttaaatggttgtgaccaaatgcagatagtgatatggacaataaagtccaggctgctgaggtctcagatggaaatgaggaacttattgggaactggagcaaatgtcacgtgtgttatgcattaacaaagagcttggctgcattctgttcatgccttagggaatctgtggaagtttgaactaaagagtaatgatttagtgcatctggtgaaagaaatttctaagcagcaaagcattcaagagctaccctggcttcttctaatagcctatgctcagatgcaggagcaaaggaatgacttaagttagaacgtatgtttaaaagggaagcagagtgtaaaagtttggaaaccttgcagcctggccctgtggcagagaaagaaaaagctctttagggagaggtattctagcaggccacttgctagaggtatttgcataactaaaagtgaaccaagtgataatatccaaggcaatggggaaaaggcctcaaaggcacttcagagactttcccagcagcctgtcccatcacaggcccagaggcctgggagaatggaatggattcatgggccaggcccagggcttcactgctctgcacaccctcaggacactgcaccccatatcctggtcactccagttccagctgtggctcaaaggggcccaggtacagtttgaggtaccactttggagaatgcaaaccataagccaaggtggttttcatgtggtgttaagcctgtaggtgtgcagaatgcaagagtgaagaatgcttggcagcctccacttagatttcagaggatgtatgaaaaaagcctgggtatccagggagaagcctgctgcaggggcagagcccccacagagaacatctactaggacagtgcacagggaaaatgtggagtcgaaggccccacacagagtccccactggggtgctgcctagtggagctgtgggatgggggccaccgtcctccagacccgagaatgtcaaatccatcagtagcttgcaccctacacctaaagagtagctatgtcggctgtatcctgcaaagccacagagttggagctgctcagggccattggaggcgactcctcacaccagcatgccctagatgagggacgtggagtcaaagagattattttggagctttaagacttaatgacttccttgctggattttgaacttgcataggacacatagcccccttttttttaatgctggaatgagttaagattttgagggactgttcggaaggcatgattgtattttgcaatgtgagaaagacatgaggtttgggaggggccagtggtggaatgatatagtttagataattgtttccacccaaatcttacgttgaattgtaagccctaatgctggagacgggacctggtgggtgtatagatcatgggggcagatgtctcatggactggtgctgtcattgtgatagaattcccttgagatcttgtcatttaaaagtgtgtggcacctcacacctcattctctctcttccttgctcctgcttttgccatgtgatgtgcctgcttccactttggcttctaccatgattgtaagcttcctgagtcttccctagaaactgagaagatgccagcaccatgcttccagtgaaacctgtagaactgtgagccagttaaacctgttttctttgtaaattacccagtcttaggtatttatttatagcaatgcaaaaatggcctaacaaacagtaaaatatacacaacataaaatttaccttttaactattttgaagtatacaattaagtggcattttgtgtattcacaatattgtataaccacaacatctatctagttttaagcatgtttattaccccaaaagaaaacccagtacccacaaaacaattacctccccctgcaactttccttcccctaagatcctggtaagctctaatctattttatctctgtggagaatttgcctattatggaaatttcatatgaatagcatcatgtaatacgttgccttgtgtgtctggctttcaccatttagcaaaatgtttccaagagttcaaccgtgatgtagcatgtgacagaactttcttaatttttaggactgcatagtattccatagtatgcatataccacattttgtttattcatttatctgttgatggacatttaggccgtttccactttttggctattgtgactagtgctgctatgaacttttgttttctagtatttgcttggatacctactctcaattattttgggtagatacctagcagtggaatctctgggtcatatggtaattctatgtttaacttgttgagaaagcaccagactgttttccacacttgtggctttaaaatattgataagcagccaggtgcggtggctcacacctgtaatcccagcactttgggaagccgaggcgggcggattacctgaggttagaagctcgagaccagcctggccaacatgctgaatctccgtctctacaaaaaaatacaaaaattagatgggtgtggtggcagtcgcctgtaatcccagctactcaggagactgaggcaggagaatcacttgaacttgggaggcgggggttgcagtgagccgagattgtaccactgcactccagcctgcatgacagagtgagactccatccccaccccaaaaaatattgattagctttccctaattgaaaagtgtagcccagtggatgtgccccactaattagataacttcctcctccttggggtggggtaagtcacacgtgggtataaagccaggatgttactacacctgaagttccttcacatgtgcacatagggcagggaaaaagagcatgccatcttcaacagatgacatacagctgggagcaataactgacatctagctattaaacacaaacttcttgaagacctataatgtaccaaaaattgtggcaaacattgtggatccagaaacaaggaaaattttcggtcctccataagctcagattctaaaagctgagcactaatttttaatgaaatcgtaatgcactaatcagaatccacgatacatttaaaaatccaattatctgaaatacaaatttaacattatacggggatgtcgctcaatgataagtgacctcactctcacattacgtcagttcataaaatatgtagaggaccatgtccaaaaaattacacataattcagctaagatgagcactgcacaaaattgaataaattacagtggttcatctgtctttaaaataatatttaaattaagaaaccaaactaatcactagctgaacttgattattaaaatcaaattttttttacataaatgcatgttaatagctagacaacatacactgcaataattgcattatatttgtcagtttcgatttacaactgaatttaccatcatcatgtaaaacatgaatctgtccctaaactgagtgcaggcattaccaatgagctgattatatctccacctactccatttaaccatcgtcaggcactacctgaaatattatataccaacacagcactccattcttgggatgattcctggtccaaatgattcatttctcatggatctgcctccacatacccaaaacccatgttccgtatcattggatatcacattagtgtgggccacagagaacacccatctcttgctaagaacaacagcactattctatagacagcatagctctggcttttgaaatggaaagaaacacatgtaaccatgccgtctttattgctctgtgtaacttttatttaagctcttaggtaatttagacatacccattcttctagttaatggctaacagcccagtattgtcaaataccatgatgaaatattctgacaggtctgcagttttacacatgtgattgaatgttcagactactttctctccatgacaggctaccaaataccatacataatttgagtatttttgacagaagaatgcacatcattttctttctagggaataacatgcttttgaggtttattacccgaatttgaacacattcttatagtggattttccatattgttcttccaccaacaatcattaagggttgtgatgttgtgttcaaatgccatcttatacattaaattaaattcaagttggtgtggttaatgttattggaaaatacctattaggcttgcttgaaaaatgttaggaactgtgattgcatttagaacacagaatcagacttatggaagcaactgagttctattaaagtacctgagtttatgtagaagagcaaagctaaaatgtgactaagtgcaatgcttaaaacacactaataccagttaaatggataagtacctgtagtaattaataaaaaaggaaattcatctagaatataattttaggtgtcaataggaggagtccatcctgcagaagagattcagatagaaattctacttctaacctagataaccatgtattagtatcagtgcttttgtatgcacgttataatctcagctaatcctctcaagagtgctatctcattcatttaaatgggttataatagaaaatggatctgctcattctattctacataataggaaattaaaaaaacaacatcctttgttgtttaagcatacatattatattgctctactgaaggttgtctaagcttctattttcttagacaatctttttttttcttcaatttctattttaagttcaggggtacatgtgtagaatgtgcaggtttattacatagatcaatgtgtgccatggtggtttactgtacagatcatcccatcacccagatagtaagcccagcatccattaggtattcttcctgatgctccccacccccacccccacctccgacaggccccagtatgtgttgttcccccgatgtgtccatgtgttcttatcattcaactcccacttacaagtgagaatatgtgatgtttggttttctgttcctgcattggttttctgaggataatggcttgcaacttcatccatatccctgcaaaggacatgatctcgttccttcttacagcttcatagtattccatggtgtatatgtaccacattttctttatccagtctatcattgatgggcatttaggttgattccatgtttttggtattgtgaatggtgcttcaatgaacatacatacgtgtgcatgcatctttataataggataatttatatttctccaggtgtatacctagtaataggattactgtgtcaaatggtatttctgcatctaggtctttgaggaattgccacactgtcttccacaatggttgaactgatttacactcccaccaacagtgtaaaagtgttcctttttctccacaatctcgccagcatctgttgttttttgactttttaataatagtcttaggcaaatcttgatcttctcctacccctcccaggattttggtttttaagtgtcttttgatgttgaagattgaatctatgttctatttctagctgctgtgcatctctgttttcctccatctttaacctcctctccccttacacaggtgatccttcaatgaaacacaattccttattttgtgagtctctcaattcacttttatgactggatattgtttccaaattccttggcaggtttagttactacagtgattagatgaggccatgatgtggccaggcattggaatcagaccagagggcaagttattcaacttctctgtgcttcactttcctcagctgtgaaaacagactaatgatagtacttacctgataggactattgtgaggattaaatgggataaaacacttaaacactttatatagtccctggtaagtgctcaactaatgtaacaaaagacgttggtgaacattagggttcctcatccataagttctctcaggccatactattaaacaaaccactcagaaagtatctcactgatttattttaatttgtttgaaaatggaagtatacaaccttttcaaaacgttttcccatctctagtcttctgacacgtctcatatttttcaccttcccttgcattataaagggtcattcagaaatctgatctgcaggtgttctctttgcctgggatgccatctaaatgtatcaggagacttagttcattcataatatattgatagaatgcctgctatgtgacagttgccgttctagggatatagggtgaaaaaaacaatatccatgacttcatgaagcttcaatcccggtaattagaaatctcttaaatagccaggggttcgtttccaatctctttgcctagctttgtcttccttattccaccccactccattattctgttacaaactaccttagttgtaccttttccaatctttggatcattacctataatgaagaatacataagcaaaacagtagttgaaaatacctgttttccttctcctctggttatagcatgctgttgttcccaagaacaagcctacgaatttctcttttatttttttctggaaaatataaaacacatcctttttaggaaagcctcaccttattctaggctttaatatttctgacactgtgtcaagggcttcagaaaatcttgatgcaaaggaaagggctttgccttcaggctcaactgaacttaaatctaaacttaattgcttcttagcaatgtgtgtgacccctggcaaatcatttacctttctgaggcttagtttcctcatttttaggtaaggataatgaatgccactttgtggggctgtcatgaacattaaaatgaaagaatgtctataaagcactttgtacaagcctagcacaaattaagtgctcaataaacattaactatttttagcaagagccacccagtaaagaaggcttggtttcaaatctctgttccaagcttactagctgattaaccttcagcaagttgctcatcttcactgaatatgggcttccctttctgtaaaatgaaatttaatatctacttatctgaataattgttctaatgattaagtgagaaaaatgtaatgacattgtacagaatatattccttctacttttatgtcttttgctcactaccaaatttttcaaggccttgtatccagccctgggagaataatatagacatgatctcttgcccttttggagaaagacaaattatgtattatatgattagaaatgatgtgaaaattttatgagggaaataagcagtgctgttctagagaataatggttgtttaatttaaatcagaagagaggacttcgttaagagatgacatccaaacagatccaaatgataagaatctagcaattggaagaacatttcagccagagggaacagcatatagaaagatcctgaagtggaaagagcttggcctgttcaatgagctaaaagaagcctgatgtcccgatttttttgagagaatatacctatcctttatttagaaaagtaaggcagagttgttgacattatcaaataaactagaggagtcaagggagtgagggcaggtaggaaggttttaaaaggtggtcatggtaaactttccaaaataatatcaatattttatcagttgggggtcccgacaggaaacaggtggtacatgcaaagtgggtagctagaggataatgtaataaagggatatatacaacgctgtggtcggggtttaaggttaatagttaaagaaagccaacaaaggagaaggaagcatcccaggacaagcaacagcaggggtggattatcaccctgtgtgttgatgaaactaggagtgggggtggttacagagcttggagagggcagcagctgcatggagaaggcctggtaaggtttttggtagaggaacataactgctatcaatctgtagtccagaaccaagggatctggtggtagggacacataccctgcccttctttcactctcttgccagtacctcctattgggcatactcaagtggaagccagagggaaaagggagttggtttgatgtagcctgtagagatcagtcttctggggcacacagaatgtggagaggggtggagtatagatccagagagacaaattcaaactatccatcacaacatctaatatataattgtgctaggctgaataatgccttccccgaagatgtccatagcctaatccctggaacaggtgaatatattaccttaaatggtaaaatggactttgcaaatgtgattaaggattttgagatggggagattattctggaatatttgggcaggccctatgtaattgtaagggttttataaaagggaggcagacaagagaatgagatgtgcccatggatgcagagggcagagtgctgtagagctatgagccaaggaatgcaaacaacctcttcaagctggaaaaggtgagaaaatagattctcccctagagcttccaggagaaacacagactgctaacgccttgattgtagcccagagacctgttttggaattctgacctccagaactgcaagaataaatttgtgttgttttcagatactaaatttatggtaatcttttttttttttacagcaccaataggaaactaataaaatagctttctaattctatactgttttttactactgtcaagcatgctcatgaacattacctctttcaatattcacagcaattctgtgaggaaggaattattttctttagtatatggagagagaaagtgagggtcagagatttgaaaagtcttgcctatagttatcacatgatgcagctagagatgaaactcagcttttttgactccaaatgcagtgtccttttccctcaatacactaaatttttttctgcagagaagcagcagaagaaagcgaggcttcagggagatgtgggacaaataggtggttcagtgtattgtggtagaagagttgtctccattggagctaacagattctattgcttgatctgacctaccttcagattcagagtatcaatgctcactgaaacccgtgtgatatggtttggctgtgtccccactcagatctcatcttgaattataactcccacaattcccacgtgctgtgggagggacccagtgggaggtacttgaataatgggggtgggttttcctcatgatagctaataagtctcatgagatctgatggttttaaaaagagttcccctgcacaagttctctctctttgtctgctgccatccatgtaagatgtgtcttgctcctccttgccttctgctatgattgtgccacctccccagccatgtggaactgtaagtccattaaacttctttcttttgtaaattgcccagtctcgggtatgtctttatcagcagtgtgaaaatggactaatacactatgcttgatgcaaggcagtggttttcaaacccatgtttggagcaagccccagaaacctagggcttttgaggaaaaggatgtggggtgatggggttctttcaaccagagaagctctatgctcatctattttttaactaattgactttgatgtaggccacatttcaatttacaaaaacaattctggggctaaaaagaagtttgaacataatggtggacattctgcagactttcactgtagatgataagaagaagtagaaacgtagaaactccagggtgattttcagtaaactccatagaaaggaggatgaggtagagcagaattcttggagacccccaagcacaagctggctgtgagaagcagcagaatatcatatatatgacagcatctgggctcttgtttgatttttaaagtagattataacatttggaactccatatcctatgaggcttaaacacatttgtgatggcgggatgtttctgttgcattggcaaaggtcaaaatcaatagaattcgcaaatgttcccctatgtcataggtcaggtgcactattattccatagatcactagtgactttctctgtgatctttaagcatttgtttgacataaaaatgacttttaaggtttacttactggtcccttggcaaactaagaacacttcctatctctaatgctttaaataaatcatctgaaattattgcacattgagctgttactttgactggctgctgagaaatgtgcttgtgttttaaaggacttctcttttggaggtgggtgagtgggtgaagaacctctttttttgtctgctcctctagaaatggtctttctgaatgaaatgagcacatcagagagctatgtccctgaaatgctcctcaaccctcctaagcccaccttctctgaattgtacttcagtattaggtgctggacctccaatagagaacactccaaaaattcttcatcacagacttgtcgttgtctttatggtaggggtggtattgggagcattgtccagaatgtcccaaatacactttagaagaacccgtgaaaggaaagaagttctctcagacctcattgccaggaaaagctgtgtttctcttcagcaactagtgtgtttttacgcttatgagtatttggaattttgttattcagtcagtggccagacccactgaataacaaaaccatagctgcatattagatatgcatgaatgcatggccccactctcaggaacttaatttttcaaatggtgaggctaattttgcaaaaatgctcctcctgattctaatatgtagctaacgttgaagatcactattataacaaaatagtccctgtgatttagtcactggaaaactcaaaatcaagcctggggcatttttgaacagttatacagtaccggatgtgcctttctgagtgtggttctgatctgggcttgatcatagtgacatgttctgatttactcttcctcctaatttctttacctattttttaaatcaatttttcattatatatttattagatctgcttcaaatgattttgaagtgaggcaatagatagattggtagatggagagatgatagaaagatagatcattgccaagcgatgtttatactgcgtctagttactgctagggcatttttctaacgattagatacagcaaattgaatgatatgggccaatcctgctgcagaaattatagaaaacattgtcttttgtgttgttattatgaaaacattcccacagttctttcatgttttaataaaaaatgaagaattattaccaatagctttggaaagtaaagaaaaaggaaatttaaaaagtaattcctaactccaattccccaacatcacaaaacctttgattttttcagagcattcatctatccttagaagacttctatttaagaaaataaataggagtagaaaaatcaacaagtgaagtatttaagaaaaataagcccagtcttcaagatgcttggaatccgcatttgctacttgcaagtcacataagaagaacaagccacttattttagtgacttcctgctgggctccagacaccatagcctatgagatctctaaaactgggcccctatttactttttcaactttcgagccattcaccacttcccctcccctccattcccacatacaactctagtcaggataaacatattttagtttctagaacatggtctttcttctgggtcttcatacatgttgttacctctggatcacattatctccccacttcccccattcacccagctaactcactccccttcattctttctatgttttgccttagatgccatttcctactggagcttctttgagttttcagacttgcttccctgctgtaggtacttttcctattaagccacttgttccaatgaatggtgattacttagtgaacatccgtctcttctgttagactataggctgtggacgctggttttgtcactgtatttccagcacctagcacagtgcctgggacagagtaagtactcaaagcatatattttgctgttgttattataaggtttatgtttttcatgtttgaaaggcacttgtaatatgtcaataattctgatagaagtcatttttagagaaggacgccataatcattcagtgagagaacacagaatgctcagacagtatgtggaccctgtagctggacattacttttccctgctgatggttttctcttcagatattatgttagagattataataagacatgtagcaatggagagaaatcagctcatcccaaactgattttcacttttagttaacacttgctctatgcaagaaaaggtcatattagttggtagcttgaatgcttccaagaccattgcctatttcaatgcttcaaagcttcagaagctctgccctgtgctgcagtcatttggtgtagaagtggaaggtgcctgaaataagacagttaggggttagaagcacagaggcgggtgttataaaatgtcacgtatgtttacatggcttttttctcagtacaattttgattattgccttgtaagcaagaccctgtagtatattgaaaatagctctgaatttgtagtaaaaactttttcatctttctacttcctaacagtgttactttggacaggccaatacatcactctgagctttgatttccttatctctaaaatgggggcagtgacataagcttcatactaacctggtgaaaattctcttgtacctaagtcagtgatcgataaaggtctattaaatccaaatgtcaaggaaagacttacctcattggatggaataagtgtgaactttctggctttcctcttttgcaaagtttgtgaatgcatttaatcatttttattagtagtagtattacttatttacccctctgcaaatcagttatgaaaagaaaaatgtcaaatgtaacttacctttccaaagaaaattgatttgttaaagcaatagttgccagaaactccaattttgctctgatttgatatgatccagtacaagctaggagtttcctcacagagctgaggggaaaaggaagagccaaaaaatctctccaaattagcccatgaatgtgagctgtagttttttttttttttttttttttttttttggataatcagatattctgactttggtcttctaattattttaccaggccaggaaaggagagctgacaaataagcctgattcttccttggcaccaaaaaattcaaagaagaaccgaaagtccattgaagttcttgtttcctttgaaatgcttgtgatctgcctcctgagactgcaaggttattaacttgcatcaggaaggtggtagagaactgaataaagaaatatccatccatctcagttgtcgtggttcttctgtcattcagaccccagcagagcaggaagcagtgagctggaaagtgcatacattggtttttccttgcttctactgaaggatcaaaactccttaggccactcagtgacttggttgatgccttccttcttcctacctttgcctttcaatatctaagcaaagttgccctttgtttatgtctctggggttttttctctttccttctcagaatgtcttttcctcatttactcttattcccaaacaactctttgtgtaatctagctgggaacacattgtatgactacttaggtataatacagaggcatagtgctagaagtatagagataaatgggttctcagtgaccatcctaacagttatacttggtggttttcaaactgtgcttcaaaagaaccctataggtatattctgaaggaatcccaaaggttttataaaaaggaagttggtggaagatgcgtggtttggtgtccaaggaaagctaaacagaaagggctatgggcaagccatcatcacttccaccaaagaagttccgctttaatctgtatcttatatttggcattagcaaatgtttagataaagagttctgtggccaaaacaattagtggggaaagcatctgcttagccctgttacttatctgtagaggggtaaggacctaagtaatgttaataatgttaacatttagtgttaatattattttgtatctgctgtggttgcatagatgcatcttctgtttgctcaactggaacgtgaacccatgaagatcacggcctaggtttgctgtctttatgaatagacacctggtctgttcttattgggcataactctgtcttatggattggctgctgttaaagtttttggagctgtctttttttaataatctaaccagagttgtagaaccactgttataaaatacatctgtagacagcacaatttacatattatttcaaggagttctggtgtcactgaagtcaaactatgcactttgagcataagaaacctggcaggagaggcttcttgatttaccatacaaacttctggagcatgtttgtttggttttttttttttttgaccccgatctttagaactgcccaatattggaattggaatgggctacttcatgacagactcaatgcttgattcctttgcatcaacccagaacatattttagattctattgtttccaatttctacatatgtttccttgggcaaatcacttaatttatcagagtctcagttttcttatctgtaaaatgggagtaatgatattgcctactttataatgacctcataaagttgttgggaggagttaattaggtgggcacagagtaggtggtaaaaatgtcagttccctaaaattccttataatttattacagaaaatacaatctgccttgtgtggaaaattgaattagatgctcttgggtcccttataatgctgagattctctgttggttcatcctttctgctttgttttgtcaaataatccagaagctgttgcctttttgctttggatttaccttcaaatgggttttaggtatagaatcttgggaaattattattatttttttgcctcaaaatccagcttaaaaatgttttacaaatatcttcagctgctttgaagggattttacatctttattgtaaagtggctctgagtttccctgaggaagatgagatttttgactaaattgctgacatgttgcactttgtagccaaattgtctagggagatacacatttatagtagatagtgtacgcttagagtttgtgatgtactttggcttcaggcttttaaataagtccgccaaggcctgttccaaaaaccagatctttaaaacgtataccttttaacatgcctctggtggactatgcttccctggattcaagcccttccttttaacctgggctagcatttgactaattgaatgtggcagaagtgacaatgcacaactttgtaggctaaatcataagaagacttgcaacttcagtctgtgttttttggaatgtttattctgggagaagctgggaaccaggtaagaagtctgactgtgtactccaccatgttggagaaacttaaataggaagaggccacatggagggagagagatgtctgaccagcccttagctgctctagtcgtcccagctgaggtgccagaaacttgagtaaaatagccattttagacatgcagccctggtggctgcaattgcagaagagatctatctaagaacctcttagtttggcccagttaacccacagaactgtgaggtaatatagtaaaatgttgttttgaattactagttctgggtggtttttacacagcagtagataactgaaacagatgcctaaattacacatcgtttgcaggcacacataaatacaaatactggtgaattatttgaagctaccaccacagtgtctggtaggattgttagaggtcctggagcttcctagtaattaggccagctttcgttgccatttactcaagtcgttaaggcttagctgctcagatcaagaaaatcatttgttattaggttcaaggccactgagacaaaaatccagcttttatctttcccattggactctttggcatcaaaattttcactttatttcttattcttaagttatatggaggatttttgccatggttctcccaaattacttgccaggctaactctgtctaactttgaaaactaggggttggcaaagtagggcctgcagacagtccacatgtttttgtaagtaaagttttattggcgcatgcttatttgtttacataggtctatttctggatttgcactataattgcagagttgaatagttgtgagaaagatggtatggtgtacaaaactaaaattatttactatctaacctttacagaaaatttgccaaaccctggtcttgactattgaactaactggttaatgatatttgagattctgtgcagtatcatagagtcagtctgagatcttgacttcatgataatgttcttctaatttcatctttgctggggatcaccaagcaggtaaattgagcctcatataacgtatgttaagtacctactatgcaatagttactgtaggagagccagagatcacatcacctccagccctacttttagctcttagtgggctcttcagctggatctagaaactaaattgacaccaggcagattaacaagataaaaacagacacattttattagttttacatgtacaggggatcttcataagagagtgaagtctaaacaagtggccaaagcaagatgcttatacattttctgacaaagagcaataaatctgaaaagaaatggtaggactaagaagatctggatagggcagtaaaatttcctagaggagtcactagaagatatattacgggtgtaaaacaggtggaagatatgagttacttcattaggtatgtttattcatgtccatggcagccatcaattccaagtgtctggtaataaggacggttttctcaccctggtttagagagggtacaccttccagaggaatcttcttggctttcacggcttgctgaatgcaggaagagccaggtttctgaaactacaatttctccagtgttttcaattcgaaataatcactttacttatctggcatattttggagtggcactccttcagtaccatgatatatgctttcttttatgccattcattgctacatataataatcctgtgagattgatatttctgtctccatttaacagtaaggaaatttgagactttgagagaaaaaaatgatttccttaaggtcatacagctactgacatggctaggctaggacatgaacccagtccatgggcccagtattgggttctttattctatactagtgctttaaaaaattttatctcattattttattgtatgtatgtatttatgtaagaatttatgtatttggcagtgggcatcttattttacttaaaaaaagctaccaacgattctatccaatgtgtataaaacagattaaagcagaacttatttgattaaagtgctcctgtgatcatacacctcttctttgcaacacacacacacacgctctctctctctctcacacacacacacacacacactgtctttcacacacactctctctttctctctctctctcacacacacacacacactctctctctctctctctcacacacacacacacacacacacacacacacacacgctctctctccctctctcttctgccttaactgaaacatatggtggaccttttcaggacctataacaaaagatagaatgacatgaggtttggaccatcatcattcagtctttattttcctcatagcacaaacacctgattgctctattgcctcaattccaggaatttccaaggcattccatacaattgaaataagaaatcaaggattactctatttgtttgtgtgaggtgtggctgctttaatcacttccaagctccagattttcccatcaaatccaaggtagtctcaataccattgttttcacaaacttatttttagcttggcacttccatgtggatggagttttatatacaaatactaaaaaatatgtttataaagatatttagtgaaatcagaaatctttttagtgcaatgctgataaaagagctctgtatatactgcagtctcagctttccctgcatgatgtatttaagtggagaagtatgtgttagcttacttactcctagacaagtacaattggaggaacctgtgcttaaataccgttagtgatctctgggtggaggggttctgtgtgactgacactgtctgccttagaactttttgtattgtccattcttttgaaagcatgtagaaatgatttgccaaaaataagtatctgtgtatacttgtgacactttgtgatattgtttcaaaaatttgagacgaaatggctggcttgagagaacaggcatatcttcgtcccagaattccttctctctgagtctagaaatttcctttcatttttttttggtctgcctgaatttttctgtttctttatttgcagtgacattaaagagagagcacaaaaggcctttgaccttttatttagcgtgtttacagatgtatctctacttacagcttatcagtattgaatgaaaacttgactggaaacacacctctctgtgttttgaacaaaagaagaacagatgttaatccatgttacatgttttaaatgtcactgtcagtgtatacatttggatgtaaataaactgaatccatgtggtaacttcaaagtatgaatgagattatatttagggagacaaatggcttgagaattttaaaacttacaaatgagtccttatactcaggaaagaaaataggtgacatgctgtattacttttcactgaaagtttcctatatgataaagtttattaactgcacagataagtttttgaacatttatgttttggggaaaatgtagaatgaaaacttgcatgccattctggaaaaaaggttatgcattaatgccacttccaaattcaaaaagatcagtgtcacattatgtaaacatctttgtatcagttatattgcaagtgacagtacattttataaggtctaaggaagcttacataagaacaaatattttctcaatacaatcaaatgccactttgaataaggggcacagtagaggagatgcaatggatatgtgtaatgtgtgctaaatttgtgattgccttgggcactactaaagccacactgagtaatttcatttgacagccaaaaaagaggagttaaaggaatgtggcagtttcacctcctatgtctattcacaaactcccatggtgacctcattaatcttggggaggagaattactcaaagactggatgcataatgccaaaatgactgcttgtaaaagttagtatccagtccatctgccactggttttctttatgctggcgtttggcagttttataaaggagtgtgccaaggtgtgctgggtcacagtttggggaagagaatgctgaatgaacactggttggagcagcaacaaaggtttcccttgcatactgtgcctgccagccatgggagctcaggctcaagtcctcccacctctttattgctactggtttgtcaccattctgctggcgagaatggtagtgagcagcagggaggaagccacagggtttcccaccagagaaactggactgtcccggcatgatttgcatactttggcacaaacaccagaggatactgaccttgggccttgatgtcactacaccagacaattggttgaactgatatgctttacttgccttgactaacattgtgttttgccaattggccaattgtttagtggccaaggagactcactgactttagatttgaattcagtaaacattttttatgtgatttactttgtgccagacagtattctggtcactctggcactttttatctcatttaataatcataatattttagaaataagttgatatttttattttaaaattattaaaccaaggccctctatttcatgctgtggctctcctgaattcaaggagaaatatgttaacgttaaaaaaaataaaattgtatcacataatgtgacataaagatgagggcatcatcttttaatagatatatattattgttaaaaatgttaattaggtattgaaaattataacaaggacatttcaccagtgaagtggtgtaagggcagggaagttggggcaatgggaattggaatataatgagccacattaagcatacacatgtcaagtctagttctgaatcctgtggcaggccttacaagagagtccatgagtcagagaggtgcaaatagaaccaggaatttgcattgttgtggatgcaaaggaggaggaagtgttcaacattgtcagatgtagaagagaggtctagaatgataaagactgaaaatagccataggactttgcagatgggaggtcaatgctgaccttaccaagagccccttccatgaaattgaaagggcaacaaacagaaatgcagaatgagggatgagtaggaagggaaggaagagagaagattgttagtgaatagtccagtccttccaaaggttgtgctgggaagaagagtggtttctagagggaacacatctgtaaggaagaggtatttcttcaagtttaaggaaatggagcatctctagcataactactggagtctgaaagaaaagggagagaatggtttgagatataggaagggacttgaagaccaatgccacagaaggaacagaaagatgtggggcagggcacagagggaactgattgaccttcaactggatgagagaccccactgtcctcactcttgaatgcttatattgtgaggtggaaagttaaagaaaatcatagctgatggcttcaattgtcttgatgaagcagagaggccagcaaaatattgaaattggaaggaatggggattgatctaaggacttttgagcaagggagtaaagactgaacagggtcattgagcagaatagaaaatggactgaagaaaagtataaaagagtgtagctgaaaatccagcaaaggttggaatttgtaatgatgccaaacttccagatttgcatgtctttctcttgctgtgtaaatcagaaagggtggattgtaaaattagaccagggtttgggatttagggttttggcagaaggacagtggtgaaaagacactgaggggactggaggacaagtggtttttaatcatagccatcatatccaggcagggcaggaaagaaagtgaagataggaggcatttattaggctgggaggagatgcagagacctatggatggcaggactctttgagagtgatgacaggatggggtagaagaagcagtaaactatgccccaggatcatcctgaatgtggaagaattattaggaggcctagagaggtatatagttgagaaacaaacatttcaagagaccagaggtctttagattaatgatccgggaataatgatcataatgttgggtaggaaacaacagggccagatcaccaatactctgatcctgcaatggcaggagtagatgaaagactaagcagtcttcacttgaaatcccttcagggaaagcagtgtcatcagagaagagccaggttccattaaaggtttgagttggagaagcattctgtcaagtttaggaagtatatgaattaatctactatgatcttaaggatccagaacacacaacgagaatgtttatggacaagggcagcaatacaatcttgaggcagagagaagcagcacaatggggtgagaatgagactgtagatgacaaagggacttatattcagggcaaggaccaaggatgacaagtatgggatagaggaatattgagatttgctggcctcatgttggtgcataaggccaatgggaagccctatggagcttccttgcaattctatgagttgtataaaagcgagtcatgggtgagagctcttggagtccagagctcgagtttgtataaggatcctaaatttacatagtactttatgtcagtttttcttaccaagctgggagcttgcttagatacagctttcaagttatttacattgcaacagactttttaaaaaaatggcttacaggggagacttttggtcaaaaatatgtttggggcactatgtgtggatttcattgattcctgctttccatgcacctgctagttgtctgtaggttcactgcccctgtgaacagaagacccagcccttctggaaaaaaaaattgttttaatggacctaagccaaaaatgctttaagcccggagaaacatttagtaattcttcagaaattttatagcactactgactggtgtggagcaggtagaagttgaaattttttcctgattatgaaagtaagatatatgcattgtaaaatatattaaaaatatagaaaaagataaaagaaaaaatcacattaaatctcaccagctgcagatatccactgttaacatttggatgcatattgttcaatattttgtgtctttgaatatgctttttagctaaaatgagatcatagcaacatattttatattttcttgattgtcttatgaacatgatgacgtcatcaataatcttctaccgcatgatattcagtatagtatttcatcgacttactgtatatacttaaccaatcttctcatgctgttcatctgggttattttcacctttgtagaattatgaatcaccctggtatgaactttcttaaagagaaattaatcttgcatacatttatgattacttaagatgcattcttagaaatgtaatgactggatcacagtgttttcttctctctctctctctcttcccttctctctctttgcttctttttctcttcctgctttcttgtctgcttttctttttttgctacaatttacacttgaaaccaattttatcctacaagctaagaatacattttagatttttaaatggctgaaaaattctaaagaagaatgatattctgtgatatgtgaaaattatataaaattatatgaaatttttatttcaggatccattaatacagtttgttgtacagccatgcccatttggttatatactatctatagctgctttcacactactatggaagagttgagtagttgcaacagagactatatgacccacaatgcctaaaatatctagtatttggttctttacaggaaatgattgatgagtcctgatttaaacctgaggagtttacaaagttattatagataatgtaaatcctttaacttgattccagaacaattttcttgtatgccatatactaatattgtgaatcagaaccccagtttccttgtctgtagtatgggtctaataatagtgataatttcaaatggtttttgtgaagggtgaatgaaatacatttcaagcatttgaatagtgcttggctcagaactgaaaagtaacatcactagaggacatgcagctgcttgcaaagtgtcccattggaagagtgtgctattcatttcaaaggaaggaagacagagcttgcttcttttggagaacctcatactgtatatgtttgacccacatctgccttttaaaatgattgcagaggctctttcatgtggctggggtgggaattggtctccctgataaagtagcaactttgggttgctatccttggtgggtacatcttagatgcttctggtggtcgaatgtggttgaatatatttcacttgctctacaaagtcactgtcagcagcacatggattgcaaatacacgtggaacaaacaatttcaccaaaggaaagataaaaactgggttggataaagaagatataaagaaagaaaaaagggacttgacggagtagagggaagccaacggaagaaaaaatattggatgtgattactgctttttaactttaaataaatgtaggaaaattatttttacaatgccctgtgtattgtgtgcctaaaaataatacagaaaacataggattttaagtgcattaatataaatgacttgagtaccccaatgctgctatgtaaccgaaggttggagttattgccccttttatgtaacttaagtcttttctgtgcttctttccatatacatcccttttttcttcctctctcatcttagaagaaaataatccctcttttcctacaaagactagtccattagtcctacttccccttcctcctcttgctcctgtcccatccttacctggcaaatctcccaccttgcttcatcaattatcctttccatctcacttactcctcaaccattccaagtgatactttctctagaaattttatcaaagaattctctctggtatttggagtaacacaaagaaagaatctaatatggataaaagagtctggtcactgacgtctcttaacataatcaattctcaatcatctagtccgatcgaatgtgaagtcgatgtggtggctatttatttaagtattcacttttaaagtatttaccatgcatactttgttcaaaatatttgaaaatccatcttcagcctataaattatttagattatattttcagtttctgaacacacaggctggtaggtctctttctctttcccttccttcctgtctttcataataatttattattggatcttgggattttggaaagagcttgtgttctttattaaagcaattctttggaattttggggagttcctttacaaccagtgtgtggtcagattttctaatgttctgcatgtgcttgaaagaaatgtgtattctctaattactgggtgcagggttctatatggtttaattagattaagcttgttaattatgtagttcaaatctatgattgtattaaattttgcatggttggtctggcagtttttgacaggtgtgtgttaaaactgctgctgcaattgtggatttattatttttccttataagtatgccattttgtgtcacttatttttagactgtagtgctactttattaatatttttacatttaatctttatataataaacctgtttattactggtaaaattgataaaagataaaaccttaaacaagtacttacctcttagaaatgttacaagatttaggggatggcagcccaaaatttacctccaaaagcatatctcttaattttgttaacttgtaaatgtaattaactgttcattgtgggaatttgaattattggcttcttttatttatacatacattttaattatttttggttgctggccttagtggagaacgtcttagatgcttctggcaattgaatgtggttgaatatatttcacttgtactaaaaaggaagtgaaatatattttacaatatatttcatcacccggtcataatcactgccaacatttcatcatacagccttccattcttccttctctacattttttttctggttgaggttattatccaattcaatattttatcttgatttgttttaactttcgttatagcttaaacattttctcatgtcattactaactcttttatacatcctacttctccacccctaacaaccaagagaattacagtgaaccttgggatgcaataaaatacacctaaaatagtgaatagtacagaactaaattgggaagaacagaaactaaagaatgtgacttgaccattaatcacattatttgcaccacagtttagaaacttgaattatcgagtgtctacaatggttgcagttcttggggaaagctttatagcaaaggtggaatttaagctgatcattgatctcttcgtcaatgctaagccaactccatttagcaaaggtactagggcaggtatgaaccaggccccataatacggagtgggtgatggaaagtagattagacagcagtaatgtagtaggaagacccgtcagctttactcttgagaggggcaggtatacaatttaccaagcagcatgggaccaaattctggaggacctagactgtcaaaaaagttgctgctctctgtgcaaaagagatgcttctagctgtgttgctgccacattgataagctggtagtttgagatgaggaaagaggaatttttatgtccccatgggttatgcagtctcaactacaaatttctgtctgtgaagaagggaaggacaaagcagaactgctttaagaaaggaaagcgaaaaacattaggctgattttgctggtgaatttgtaaccctaagttagcatagatcatcattttttgtccttcttataaaagtatgagaaagtataattatcctgatattaaataggaaggaaccagatctcaagggggttgagtaatttcatatgaccaacaccacaagctagatcttagggcagctagtttgacaggttttctattactttgtactgcttcttcagggctcaatgtgatactatttaatgatgataacagtggttgctagccttttttttttcacacctttgaggtctgtaaggtcttaatttttcctagcaaaattctgcaatactaaatatcagaaggaaaaaatttccagagaagtccagcattatagttactgtttattaagccctttttttttctagactggttcattgtgggattttatgcacacacacatagacatgaacactcacacacatatacacatcatatttatctaggtgtggatctcttcattgtttttgcctggaatttgagggactcattttatcaatatcctcagctttctcctcagctcagaaaagttatcctcagttatacttttaataattgtttttctgtcaccttcatcgaaatgcctgtgatggctaagtcagttcagcccttcatatctatagtcttttctctcttcttttccatgttttagtttttgacttttgtactctggagaccttcagaatgtgaggattttgttttattttctgtagtgttagtttggcttttacttaatgtgcctctcttgacctacctttccctccttttttcccatatttcaataaatggaaccttcatccacccaattgctcaagccaggagctctctgtgtctgaattcttacagacaaaaccatgccgtatcttttctaacatacatccaaagtatacgttgaatcatttcatttcacaaagcaaaatagtggctaaggtagggctggaacccaggttttctagaacaccctggtttatatcctggctccaccactttctacctgtgtatccatggggaaattacttgacttctctgagtgctcatttttaaaataagacatgaagatagctacatttcagagatacatttacaacattctatgacttcatttctatgaaatgtacagcttaggcaaatctatagagacagaaaatagatcagtggttgcctagtgataagagggtctaggagggaaatgtggggagcattgactgctaaagggtatggggtttctttttggggtagtgaaaatgttctaaaattgattgtggtgatagtttgacaattctgtgaagatactaaaaaccatttaattgttagctttaaagggtgagttatatggcatatgaactatatttcaattaagctgtttacaaagaaaaaaaaaaagagtaaaggagggaaatttcctgagatggccaacgatggagtcccttctgcctcaaaggcccagatgaaccttttcccatgttctagtttggccatccaggtttgtagcccaatgaaactctcataagtatgtggtcttggacctggacagagtctcctcagctgcatcacagtgaccattttaacaggcttgcctccctttagaaacacagcttggaaacctctatccctttgtggattttggaagctacatttggcagcttcctaaggtaagcacagagcaaaaataatttgccacctggggctttatggcagatggaacttagtcgcctcttaatatcctcagctgaagagttgagacatacctcgggcctcaattttttcaaaggtctgatccatttgtctttaatgcaagctgcactggcctgatagtcctggtaattccaatgctgaattacttgagacattttatagagttaagggcatatgttttaaggaatctgctttaatcgtcctcactgagaaatatcctccaatgtggattactcagtgcaggtttactggagacatttgatacaatctggaagatttaagagttgaagacatgccctgggtctccattttataagaggttccatgcatcagtcttcacaacaaaccattcttgcctttcaccttccactgagccaatccacattaaaaggaagctgaaagaaatgacacaacttgcactttgattttataagaagttggatctatttatccccattggaaccattctagaattactcccaacaacatagatttattctgaactttcaatgcaatctatataacagagttggggacataacttggacctaaattttgtaagaagttggatcttcccatctccacaaaaacaaccctggcctgtctctctcccatgctgaattactccagtttttcaataacttctggaatatataagagttgatgatacacctcaggctgcaattttgtaagaagttgctcctacttatctctattacaaagaatcctgaattaacaccgcccagagtgaaatcacttcatgcagatttactgcaggcattctctgtggtcaggcattttactggagacattctgtatgataagggaacctgaagagtgaatacgtccagttggtctgacagactaacctggtgccatcttttcccacttcaagaattcctttgaaggttcaactagataatatagttatagtacttggcacacagcagtctcttaaccaatgtttgttctcactgcctctgaacccatttctattgtctccattcatacaaccacatgggtatatttatcatgtgtatttacacacactcgtgtatgtattcatatctattacatatataggagtgtacatatacatttgtgtgtgtgtgtgtgtatatatatatatacatacatgtatatgtaatacatatatacacatctattcatcgccattggaaccatcctagaattactcccaacaacatagatttattctggactttcaatgcaatctatataacagagttggggacataacttgggcctaaattttgtaagaagtttgatccccccatctccacacaaaccatcctggcctggatgttttgatatatatgtatgcgtatatgcattacatatatgtgtgtgtgtatatatatatatacacacatgtatatgtgtatgtttgtatatacatatattctggagtaaaatgggtagttatttaagtcatttgaaggaatgctgaagctatttaccacagagatctgttttgagtattcggtgtgaaggaaggatatgaatattttagaaagacaaaaataaaatattactttgactgaaagagatcagtgcatttccatctttctttaaaaacacagaaaataaattaggaaatgagtctatttgtgtggtatgggggaaagcaactgtccctcaagtggcccatttgttcttggatctccatgcaaaaggcaaactggagaccagggaggctggagcaacctagataggacatcagtagggaggccatgtgattggccctgaggcacctcacagactgtcatctcaagtactgttgtggagccaaatgctgaagtgaataaaatatgttctagttatgcttgggagacctcccgagtccagctgccttactttcctcctccctttgctttattttgccaagattatgctagaaggaaaaggcgagaggagaggagagtgctgggacaactccatcactaaattatatatgttacacttttacttgcacttagaaaatcttggattgcctatcagccctgtgtttacttcagattgggagagaactaggaagagcgctagaagatttgatctttcactgactttgggaaaatttctttgatatcctgagcatcaacttcactatttgcaaaaatagcaatagagataatagtactttcccccctcttttcacatattgcttgttatcaacatataaagcgcaaacagatattattttgaactccttcctagtttcacataattcacatttaaatgagactaaaatgtttagctaaactcaaagaagaaaaaaattggcagaagtgaaatattttctacatattaaaatagcagagattaaaaaataatgacatgtattggtaagagtacaaggagatgggcagtttcatattcttctagtgaaggttgaaattttggtatatggtgagagataggcatctagtttcattcttttgcatatggatatccagttttccagcaccattgattgaagagactgtcctttccccaatgtatgtgtctgatactttggtcaaaaatgagttcgctgtagatgtgtggatttgtctttgggttctccattctgttctgctgatttatgtttctgtttttatgccagtaccatgctgttttgattactatagctctgtagtataatttaatgtaaggaaatgtgattcttctagttttgttatttttgcccaggatttatttggatattctgagtctgtagtggttccatatagattttaggattttttttctatttctgtgaataatatcatttgtattttgatagagattgcattgagtctgtagattgctttgggtaggatggacattttaacaatattgattcttctaatccatgtacatggaatatctttacattttttggtgtccacttcaatttcttgcattaatgttttatagttttcattatagagatcttttacttctttggttattcttagggttttttttgtagctattgtaaatgggattactttcttgaaattttttttctgattgtttgctgttggcatatagaaatgctactgatttttgtatgttgactttgtatcctgcaactttactgaatttatgtatcatttctaacaatttttttcatgaagtctttagtaggtttttccaaatgtaagattataccatctgaaaacaaggataatttgactccttccttttcaacttggatgccctttatttctttctctcgtctgattgctctagctaggacttccactactatgttgaataactggtgaaagtggacacccttatcatgtacctgatcgtgaaagaaaagctatcagttttttccccattcattacaatattagctatgtgttggtcatatatggtttttattatgttgagatatgttccttctatgtccagttttttgagggtttttgtcatgaagagatgatgaattttatcaaatcctttttctgcatcaattgaaatgatcatatgatttttgtctttcattctgttgatatgatgtatcacaataattgattttgtatgttcaaccatccttgcatgcctgagataaatcccagttggtcatgatgaatgatctttttaatatattgttgaatttggtttgctaatattttgttgaggatttttgcatcaatattcatcagcaatagtggcctatagttttcattttttgatgtatctttgtctggctttggtatcaggataataccagccttgtaaaatgagtttggaattattctgttattctctattttttagaatagtttgggtaggataggtgttagtttttgaaatctttggtagaattcaacagtgaattctaccaaattcacttttcaatatggcttaaatctctttacctgttatttgtctgtacaagttttggatctcttcatggtttaatcttaataggttgtatgtttctaggaattgattcatttattctagattttccaatttattggaatatagttgctcatagtagtaattaatgtggtaccatttgtaacatctcttttttcatctctgattttcattcagctattttcgcttttttccttggttaatctggctaaaggtttgtcagttttgtctgtcttttcaaaacaccaacttttagttttgtttatcttttgtattgtttccttcatttcagattcatttatttctgctcttgctgtttattatttcgtttattccactagttttgtgtttggtttgtgcttgcttttcaagttctttaagatgcatcattaggttattttaagttttttatttcttttttgatgtaggcacttatagctataaacttccctcttagtactgcttttgctgtatcccataagatttagcatattgtatttcaatttccatttgtttcaatacattttctaaattttttcttaattttttcattaacctactggtcattcaggagcatattgtttaatttctgtgtatttgcacagtttccacagttccttgtgctattgatttctagttgtattctgttgtgttcagagaagatgcttgatttaaaaaatattttttttatttcagtaggtctttggggaacaggtggtgtttggttacacgaataagttctttagttgtgatttctgagattttggtgcacccatcacccgagcagtgtacactgtacccaatgaatagtcttttatcccttgctacccccaccctttcccaagtccccaaagtccaatatgtcatttgtatacctttgcgtcctcatagcttagctcccacatatgagtgagaatacacagtgtttggttttccatttctgagttacttcacttagaataatagtctccaattccatcaaggttgctgtgaatgccaatatttcattcctttttatggctgaatagtatttcattttatatatatatatatatatatatatatatatatatatatatatatatatataaaattttctttatccattcattgattgatgagcatttgggctggtttcatatttttgcaattgcaaatcatgctgctgcaaacatgtgtgtgcaagtatctttttcatataatgacttcctttcctctgggtagatacctagtagtgggattgctggatcaaatggtagatctacttttagttctttaaggaattttcacactgttttccatagtggttgtactagtttacattccctccaacggtgtaattgtgttccctatttgccacattccagccaacatctattactttttgattttttgattatggccattcttgcaggagtgaggtgttattgcattttgattttgatttgcatttctttgatcatcagtgatgttcagcattttccatatgcttgttgaccatttgtatatcttcttttgagaactgtcttttcatgttcttagcccactttttgatgggattgtttgttttttccttgctgatttgagtttttgtacattctgaatagtagttgtttgttggatgtgtaaattgtgaagattttctcccactctgtgggttgtctgttaactctgctgattatttcttttgctgtgcagaagctttttagtttaattaagttccatctgtttatctttgtttttgttgcatttgcttttgcattcttggtcatgaaatctttgcctaagccaatgtctagaagagttttttcaatgttatattctaaaatctttatggcttcagtcttaaatttaagtttttgatccatcttgagttgatttttgtatagggtaggagatgaggatccagtttcatttgtctatatgtggcttgacaataatcccagcatcatttgttgaacagggtgtcctttccccactttatgtttttctttgctttgttgaaaatcagttggctgtaagtatttgggtttatttctgggttctcttttctgttcaattggtctagatgcctatttttataccagtgccatgctgttttggtgacgatggccttatagtatagtttgaagtcaggtaatctgatacctccagatttgttctatttgcttagtcttgctttggctatgtgggctctttttttggtcccatctgaattttaggattgtttattttctagttctgtgaagaatgacggtgatattttaatgggaattgcattaaatttgtagattgcttttggtggtatggtcatttaaacaatattgattctacccatttatgagaatgggatgtgtttctatttgtttgtgtcatctataatttatttcagcagtattttgtagtttttcttgtagaggtctttcacctccttggttaggtatattcctaagtattttattttatttttttcagctattgtgaaaggagttgagttcttgagttgattctcagcttggccactgttgctgtatagcagagctactgatttgtgtacattaattttgtatcctgaaactttgttgaatccatttaccagttctaggagctttttggatgagtctttaggattttctaggtatacgatcatatcatcagcaaacagcaatagtttgccttcctctttttacctctttggatgccctttatttctttctcttgtctgactgctctggcttggtcttccaatactatgttgaatagaagtggtgagaatgagcatctttttattgttccaattctcaggggaaaatgctttcaacttttgcccgttcggtataatgttggctgtgagtttgttttagatggcttttatttgttaaggtatgttgcttctatgccgattttgctgagggttttaatcataaacggatgctgggttttgtcaaatgctttttctgcatctattgaaataatcatgtgatttttgttttaaattctgtttatgtggtgtgtaacatctgttgacttacgtatgttaaactatccctgcatcccaagtatgaaacctacttgatcatggtggattgtctttttgatatgctgttgtattaggtttgctagtattttgttgaggatttttgcatctattttcatcagggatattggtctgtagttttcttcttcttctttttttttttttttttttgtttgtttgtttgttaggtccttccctggtttttggtattagggtgatactggcatcatagaatgatttagggaggatttcctctttctctgtcttgtgtaatagtgtcaataggattggtaccaattcttctttgaatgtctgatagaattcagctgtgagtccatctaatcctggacattattttgctgacaatttttaaattaccatttcaacctcactgcttgctattggtctgttcagagattctgtatcttcctggtttaatctaggagagttgtatatttccaggaatgtatccatctcctctaagttttatagtttatgtgcataaaggggttcacagtagtgttgaataatcttttgtatttccttggtatcagtggtaatatctcccgtttcttttgtaattgagtttatttggatcttctctcttctttacttggttaatctcactaattgtctatcaattttacttatattttccaagaaccagctttttgtttcattatcttttgtattttttttttgtttcaatttcatttagttctgctctgatcttcattatttcttttcttctgcggggtttgggtttggattgttcttgttgctccacttctgtgcggtgtgaccttagattgtctgtttgtgccctttcagactttttggtgaaggcatttaatgctatgaactttcctcttagcaccgcatttgctgtttcccagaggttttgagaggttgtgtcactattatatttcaattcaaagaattttttaatagccatcttgatttcattgttgacccaaccatcattcaggagcagattatttaatttccatgttatttgcatggttttgagggttccttttagatatgatttccaattttattccactgaggtctgagagaatacttgatataaatttggttttcttaaatttactgagatttgttttgtggcctatcatatggtccattttggagaacgtttcatgtccttatgaatggaatgtatattctacagttgttgggtagaatgtcctgcaagtatctgttgagtccatttgttataggctatagtttaagtccatcattcctttgttgactttttgtattgatgacctatctagtgctctcagtggattactgaagtcacccactattattgtgttgccatctatctcatttttaggtctagtagtaattgttttataaatttggaagctccagtgttaggcacatatatatttaggactgatattttcctcttgcactagtccttttatcattatataatgttcctctttatcttttaagattgctgttgctttaaagtttgtttagtctgatataagaataactactcctgctggttttggtgtgcatttacatggagtatctttttccactcctttaccttaagtttatgtgggtccttacgtgttaggtgagtctcctgaagacagcagaaacttggttggtaaattattatccattctgacattctgtgttttttaagtggagtatttaggcccattacattcaatgttagtattgagatatgaggtggtattctattcaacatgctatttgttgcctaaataccttgttttctttcattgtgttattgttatataggtcctgtgagatttatgctttaatgaggttctattttggggttttttgaggatttgtttcaagatttagacctccttttagcatttcttgtagtgctggcttggtagtggcaaattattttaacatttgtttgtctggaaaagagtgtatctatccttcatttatgaagcttagttttgctggatacaaaatttttggctgataattattttgtttaaggaagctaaaaataaggccccagtccctttgagcttgtagggtttctgctgagaaatctgcgttcatctgataagtttttcttcataggttagctgatgcttttgcctgatagctcttaagattctttcctttgtcttgactttagataacctgatgactgtgtgcctaggtgatgatctttttatgatgaatttcccaggtgttctttgagcttcttgtattttgatttctagatctctagcaaggtcagggaagttttccttgattattccttccaatatgttttccaaactgtgagatttctcttcttcctcaggaacaccaattattgttaggtttaccatagtcccaaacttcttggaggctttgttaattttttaaaattcttttttctttgtctttgatggatttggttctgcttgttcgattctattgctgagattttccagtgaatttgcatttctctaagtgtgtccttgattaccagaagttgtgattctgcttttagttattctatttcactgaagaattttcctttcattttctggatcatgtttttgattcctttaagctggacttcacctttctctggtgcctccttgattagcttaataattgaccttctgaattctttttctggcaattcagagatttttatcttggcttgggttcattgctggttagctggtatgatgttttgggggtgttaaagaaccttgttttgtcatattaccagaattgtttttctggttcattctcatttgtgtagactatgtcaggggaagatctgggattcaaaggctgctgttcacattcttttgtcccatggggtggtcccttgatatggtgttctcccccttcccctaggaatggggcttcctgagagctgaactgtagtgattgtttttgcctttctgggtctagccacccagtggagctaccaggctccgggttggtactggggagtgtctgcaaagagtcccgtgatgtgatctgtcttcaggtcttgcagctgtagataacagcacctgctccggtgaaggtagaggtagcagggaagtgaagtggactctgtgatggtccttggttgtttttgtttagtgtgctggttttgtgtttgttggcctccagccaggaggtgacgctttcaagagtgcatcagctgcagtcctataggaaggatgcaaacttgccctagggtcacctggttaaatattcaggtttctcaggtggtgggcagggccatagagctccagagagattatgatctttgtctttggtaccagggtgggtggagaaaaaccaccaggtgggggcagggataggcatatctgagctcagattctctttgggcagggcttcctgtggctgcctttgggaagggggtgtggttcccagtccattggagttatattccctgggtgattatagctgcatctgctcggtcatacagttcaccagagaagtgggggaaagacaggagtcacaggcctcatcccgctgccttgcagcctgcagtcctaaaggccagtctcactcccactatgcccccacaacagcactgagtctatttccagatagccagtgaccagcactgagaacttaccccagatcacaaacctccccattgagaaagcaagcagacacagtttttcggtgtttcacggagcctgcagtggtgatccagttccttcaaagggtctgtggattcctttggctttcctagtattttcctgcagttgttcttggagcaaaagttcacgatgtgagtctctacacactgctttgtcagtccaaggaggagctgcaagcttgtcctgtttcctatctgccaccttaatctctatagaccaccacaatgcttgatattatttcaattttttgaatgttttataactgttttgtgacctaacatatggtttatccttgagaaagatctaagtgatgaggaaaagaatgtgtgttctgtagctgttggatgaaatgttctgtaaatatctattaggcccatttggtctatagttcagattaagtccaatgtttgtttgttgattttctgtctggaatatttgtccagtgctgaatgtagggcattgaagcctcccagctattattgtattggggtctgtctccctttagctctgataatatttgctttatatatctgggtggtccagtgttctatatgtatatatttataattattgtatcctcttgccaaattgacctctttatcattatacagtgactttctttttgtctttttctagtttttgtcttgaaatccattttgtctcatataagcatagctactactgctctttttttggtttccattggcgtggaatatctttttctgtcctttcattttcagtctatgtgtatttctataggttaaatatgtttcttgtaagcaaaagatctttttttctgttttttaaaatccattcagccagtctatgtcttttaattggagagtttagttcatttacattcaatgttattattgataactaaggacttactcctggcatttggttatttgttttctggttgttttgtagtgtttgcttctttctttcctttttgtcttccttttagggaagatgattttctctagtaatatgacttaatttcttgctttttaattttcatggatttgtttcatgttttttgatttggggttaccatgcggcttgtcaatactgtctttaacccattatttttacttgataataaattaacactgtttgcataaacaaagaaacaagcaaaaagaaaagtaacaacaattctacacgtcaatttcatccccccactttttaactttttgatgttttgatttatattttattgtaatgtctatgtcttggaaagttgttatagttattatctttgattgattcatcatttaatttttctatttagtataaaattagtttacacaccacacttacagtgttatgatattttgtgtctctctgtatacttactattagtagtgagttttgtaccttcagttgatttcttattgctcattaacattcttttcttttttactgaagttctctctttagcatttcttgtgggacaggtctaatgttgatgaaaacccacagcttttgtttgtctgggaaagtttttatttctccttcatgtttgaaggatattttcaccagatatactactctggggtaaaggtttgttttcttcagcacttcaaatatgctatgcctctctctcctggcctgtatgtttttcactgaaaagtctgctgccagacgtattggagctccattttatgttgtttcttttctcatgctgcttttagggttctttctttatccttcacctttgggagtctgattattaaatgccttgagatagtcttctttgggttaaatctgctttgtgttctataacttttttgtagttggatattgacatctatctctaaatttgggaagttctctgtttttatccctttgaataaactttctactcctatttctttctctacttcctctttaaggccagtaactcttagctttgccctttagagactattttctacatcttataggtatgcttcattgtcttttattcttttatcttttgtctcctctgaccatgtattttcaaatagctgtcttcaagttcactaattttgtcttctgcttgatccattctgctattagactctgcatttttcactatgtcaactccatttttaaactttagaatttctggtttttttttgtttatttcaatatttttaatttatctgatagcattctgaattccttctctgtgttttcttgaatttctttgagttttctcaaagcagctattttgaattctctttctgaaagaaggtcacatatctctttcttcaggcttggcctctggtgccttattgagttcatttagtgaggtcatgtttttcaggatggtgttgatgcttgtggaaatccacctgtatctgatctgggtgttggaaagttagatatttactagtctttatagtctgggcttgtttgtatgcatcctccttgagaagcctttcctggtattcaaaaggacttaagtattaggatctaagccttgtctgcattaggaggcaccccaagccaagtaacactgtagttcttgccaacttctagaagtacaactgtgatgatcttggattatatccagaataattccttggattattaaacaaaaacttttgttctcttcccttatttcttccaaagaaatggagtctgtctgtctgttctgtaccacctggagctggggggggggggggggcagtgacacaagcaaccctgtggtcaacgccagtgggcttctcctgagttagacctaaagccagcacagccctggatcttgctgaaggcccactgtaaccactacctgtcttccatctatgtttgttcagggccctggggctctacaatcagcaggtgcttaagcctgccaggcttgcgtccttcccttcagggcagtgacctcccctaggccctggtcaggtccagaggtgctgtctgggatctagagcctggagtcaaaacactctagaagtctacctggtgttctgttgtactgcagctgagctggcactcaaactgtgagatgtggtccttcccacgctttcctccccattccacaggcagagaagcctcaccctgttgccaccactacaggcccacagagggtagccaatgtcccctaaagctcaagagctctttagttggtttgtggtgaattctgcctagtctgggactcacccttcatggtagtgggctcctctctggcccagggcacatccagaaatgtcattgaagagccaaggcctggaattgagtacctcaaaagcgctcttggtgttctgtccctttgtggctgagctggtgagacgtgacagcgtgctggcagtcctcagagccctcgcttgctctcggcacctcctctgcctgggctcccactttggcggcatttgaggagcccttcagcccaccactgcactgtgggagccgctttctgggctggccaaggctggagcccactccctcagcttgcagggaggtgtggagggagaggcgcgagcaggaaccagggctgcgtgcggcgcttgccggccagctggagttccgggtgggcgtgggcttggcgggccccgcactcagaacagccggccggccctgctggctccgggcaatgagggacttatcacccgggccagtggctgcggagggtgtactgggtcccccagcagtgccagcccaccggcgctgcgctcgatttctcaccgagccttagctgccttcctgcggggcagggctcgggacctgcagcccgccatgcctgagtctcccacccactccatgggctcctgtgctgcccaagcctccccgacgagcaccaccccctgctccacagcgcccagtcccatctaccacccaagggccaaggaatgcgagtgcacggcgcagtactggcaggcagctccacctgcagccccggtgcaggatccactcggtgaagccacctgggctcctgagtctggtggggacgtggagagtctttatgtctagctcagggattgtaaacacaccaatcagcaccctgtgtttagctcaaggtttgtgagtgcaccaatcgacattctgtatctagctgctctggtggggccttggagaacgtttatgtctagctcagggattgtaaatacaccaatcggcactctgtatctagctcaaggtttgtaaacacaccaatcagcaccctgtgtctagctcagggtttgtgaatgcaccaatcgacactctgtatctagctgctctggtgaggccttggagaacctgtgtgtggaaactctgtatctaactaatctgatggggacttggagaacctttttatctagctcagggattgtaaacacaccaatcagcgccctgttaaaacaggccactcagctctaccaatcagcaggatgtgggtggggccagataagagaataaaagcaggctgcccgagccagcattggcaacacgttcgggtccccttccacactgtagaggctttgttctttcgctctttgcaataaatcttactactgctcactctttgggtccacgctgcttttatgagctgtaacactcacggcgaagatctgcagcttcactcctgagcccagcgagaccacaagcccaccgggaggaacgaacaactccagacgcgctgccttaagagctgtaacactcaccgcgaaggtctgcagcttcactcctgagccagcgagaccacgaacccaccagaaggaagaaactgcgaacacatatgaacatcagaagggacagactccagacgcgccatcttaagagctgtaacactcaccgcgagggtccgcggcttcattcttgaagtcagtgagaccaagaacccaccaattccggacacactggtacctaaagtgcaagacaaagtcccttttgcttgtccctccacttttcccaaacagaaggagtctcttctcatagccagcacagctgggaatttgctgtatattacctgaagtcaataagtcttagagtctcacgcaaggcctatagtatacttcctgggtatcactactggttattcagggcccaagggctctttagtcagcacatggtaagtcctggcaggactgggtttttcacttcaaggcaatggatttccttctggcccagggtgtgtctagaaatgtcattcaggatctagggcctggaaatgagaactcacaactctgattggtgtcctattttactgtgactgagctggtatccgtgatgcaagacagagatgtctttactctcccctctcctctcttcaagtggaaggaagggatttattttggaactgcaagctgtacagcttggggttgggggacaagtggtacaagcatttccttagcttccccagctggagtctcagtagctcacatatccccctgagtctactggctcttagccaagtttagcactaggacttgccttgaatttgcagtccttgtggcccagactgcttttctatttttttgacggcaatattagatttattaaagttccatatttaaaaacgcaatacatctttaagcttttgtgttcatcttttttttaaaattatactttaagttctgggatatatgtgtacaacgtgcatgtttgtttacataggtatacatgtgacatgtgagtttgctacacccatcaacttgtcatttacattaggtatttctcctaatgctatccctccccaagccccctacccccaacaggccctggcatgtgatgttcccctccctgtgtccatgtgttctcattgctcatctcccacttatgagtgagaacatgtggtgtttggtcttctcttcttgtgttgctttgctgagaatgatggtttccagtttcatccatgtccctgcaaaggacatgaactcatcctttttttatggctgcatagtattccttggtgcatttgtgccacattttctttatccagtctatcattgatgggcatttgggttggttccaagactttgctattgtgaacagtgctgcaataaacatatgtgtgcatgtgtctttacagtagaatgatttataatcctttgggtatatactcagtaatggggttgctgggtcaaatgatatttctagttctagatccttgaggaattgccacactgtcttccacaatggttgaactaatttacactcccaccaacagtgtaaaagcattcctatttctccacatcctctccagcatctgttgtttcctgactttttgatgatcaccattctaactggtgtgagatggtatctcattgtggatttgatttgtattttccaatgaccagtgatgatgagaattttttcctaactttgttggctacataaatgtcttcttttgagaagagtctgttcatatccttcactcatttttttttcaaggggttgtttgtttttttcttgtaaatttgtttaagttctttgtagattctggatattagccctttgtcagatggacagattgcaaaaattttctcctattctgtaggttgccttttcagtccgatgatagtttcttttgctatgcaaaagctctttagtttaattagatcccacttgtcaattttggcttttcttgccattgtttttggtgttttagtcatgaagtctttgcacatccctaagtcctgaatggtattgcctaggttttcttctagggtttttatggtttttaggtcttacagttaagtctttaatccatctggtgttaatttttgtataaggtgtaaggaagggaaacagtttcagctttctgcatatggctagccagttttcccagcaccatttattaaacagggaaccctttccccattgcttgtttttatcagatttgtcaaagatcagatggttgtagatttgtgatgttatttctgagggctctgttctgttccattgatctatatctctgttttggtaccagtaccatgctgttttggttgctgtagccttgtagtatagtttgaagtcaggtagtgtgatgcctccagctttgttcttttggcttaggattgtcttggctatgtgggctctttttggttccatatgaaatttaaagttgtttttttccaattctgtgaagaaagtcattggtagcttgatggtgatggcattgaatctgtaaattaccttgggcagtatggccatttttacaatattgattcttcctatccatgagcatggaatgttgttccatttatttgtgccctcttatttccttgagcagtggtttgtagttctccttgaagaggtccttcacatcccttgtaagttggattcctaggtattttattctctttgtagcaattgtgcattggagttcactggtgattttgctctctgtttgtctgttattggtgtataggaatgcttgtgatttttgcacattgattttgtatcctgagactttgctgaagttgcttatcagattaaggatatttggggctgaaatgatgaggttatctaaatatacaatcataccatctgcaaacagaaacaatttgatttcctcttttcctgtttgaataccctttatctctttctcttgccttattgctctgaccagaacttacaatactatgttgaataggagtggtgacagagggcatccttgtcttgtgctggttttcaaaggaaatgcttccagtttttacccattccatatgatattggctgtgggtttgtcataaataggtcttattattttgagatacattccaaaaataactagtttattgagagtttttagcatgaagggctgttgaattttatagaaggccttttatgcatctattgagataatcatgtggtttttgttgttggttctgtttatgtgatagattatgtttattgatttgtgtatgttgaaccagccttgcatcccaggaatgaagcctacttgatcgtggtggataagctttttgatgtgctgctggattcagtttgccggtattttattgagaattttgcatcgatgttcatcgtggatattggcctacaattttctttttttgttgtgtctctgccaggttttgttatcaggatcatgctggcctcataaaatgagttagggaagattccctctttttctattgattggaatagtttcagaaggaatggtaccagctcctctttctacctctggtggaattcggttgtgaatgtgtctggtcctggactttttttggttggtaggctattaattactgcctcaatttcaaaacctattattggtctattcagagatttgacttcttcctgatttagtcttgggagggtgtatgtgtccaggaatttatccatttcttctagtttttctagtttatttgtgtagaggtgtttatattattatctgatggtagtttgtatttctgtgggattggtgatgatatcccctttatcattttttattgcgtctacttgattcttctctcttttcttctttatttgtatagctagtggtccatttattttgttgatcttttccaaaaaccagctcctggattcattgattttttgaagggtttttcgtgtctctatctccttcagttctgctctgatcttaggtatttattatctgctgctagcttttgaatgtgtttgctcttctttctctagttcttttaattgtgatgtgagagtatcaattttagatctttcctgctttttcttgtggacatttagtgctataaatttccctctacacattgctttaaatgtgtcccagagattctgatacattttgtctttgttctcattggtttcaaagaacatctttacttctgtcttcattttgttatttacccagtagtcattcaggagcaggttgttcagtttccatgtagttgtgcagtttttagtctgtttcttaatcctgagttctaatttgattgcactgtggtctgagaaacagtttgttgtgatgtctcttcttttacatttgctgaggaatgctttacttccaactatgtgatcaattttggaataagtgcaatgtggtgctgagaagaatgtatattctgttgatttggggtggagagttctgtagatttctattagatctgcttggtccagaactgagttcaagtcctggatatccttgttaattttctgtctcgttgatctgtctaatgttgacagtggggtgttaaagtctcccattattattgtgtgggagtctaagtctctttgtaggtctctaaggatttgccttatgaatctgggtgttcctgtattgggtgcatatatatttaggatagttagctcttcttattgcattgattcctttaccattaggtaatgcctttctttgtttcttttgacctttgttggcttaaagtctgttttatcagagaccagaattgcaacccctgcttttttttttttctttccatttgcttggtaaatcatcctccatgcctttattttgagcctatgtgtgtctttgcacgtgagatgagtctactgaatacagcacaccaactgatcttgactctttatccagtttgccttctgtgtcttttaattggggcattttaattgggacatttcaagttaatattgttatgtgtgaatttgatcctgtcattatgatgctaactggttatttttcctgttagttgatgcagtttcttcatagcgtcgatggtcctcacaatttggcatgtttttgcagtggctggtactggtcgttcctttccatatttagtgcttccttcaggagctcttgtaaggcaggcctggtggtgacaaaatctctcagcatttgcttgtctgtaaatgattttatttcttcttcacttatgaagcttagtttggctggatactaaattctgggttgaaaattcttttctttaagaatgttgaatattggccccccctcttctggcttgtagggtttctgcagagaggtctgctgttagtccaatgggcttccctttgtgggtaacccgacctttctctctggctgcccttaacattttttccttcatttcaactttggtgaaaatctgatggttatgtgtctttgggttgctcttctcgaggaatatctttgtggtattctctgtgtttcctgaatttgaatgttggcctgccttgctaggttggggaagttctcttggataatatcctgaagagtgttttccaatttggttccattctccttgtcactttcaggtataccaatcaaacatatatttggtcttttcacatagtcccatatttcctggaggctttgtttatttctttttactcttttttctctagtcttgtcttctcgctttatttcattcatttgatcttcaatcactgataccctttcttccacttgatcgattcgaccattgaaacttgtgtatggttctcgaagttctcgtgctgcgtttttcagcttcatcagttcttttatgttcttctctatactggttattctcattagcattttgtctaaccttttttcaagttcttagcttccttgcgttgggttagaagatgcttatttagctcagaggagtttgatattacccaccttctgaagcgtacttctctcagttcatcaaaatcattctccgtccagttttgttcccttgctggcgaagggttgtgatcctttgtaggagaagaggcggtcttgttttgggaattttcagcctttctgcgctggttcctccccatctttgtggtttcatctacctttggtgtttgatgttggtatcctacaagatggggttttggtgtggatgtcctttttgttgatttgatgctattcctttctgtttgttagttttccttctaacagtcaggctcctcagctgcaggtctattgcagtttgctggaggtccactcccaaccctgtttgcctgggtatcaccagcagaggctgcagaacagcaactattgctgcctgatacttcctctggaagttttgtcccagagaggcacccgccagatgccagccaaagctcttctgtattaggtttctgttggcccctactgggaggtgtatcccagtcaggctacatgtgggtcagggacccacttgaggaggcagtctgtctgttatcagagctcgaacgctgtgctgggagaaccactgctctcttcagagctgtcaggcagggatgtttaagtctgctgaagctgcgcccacagcggccccttcccccaggtgctctgtcccagggagatgggggttttatctataagtccctgactggggctgctgccttttgttcagagatgccctgaacatctagaggtagaatctagagaggcagtcggccttgctgagctgtggtgggctccacccagtttgaacttcccagcagctttgtttacactgtgagcataaaactgcctactcaagcctaagcaatggtggacgcccctccccccaccaagcttgagcaccccaggtcgatttcagactgctgcgctagcagcgaggatttcacaccaatggatcttggcttgctgggctccgtgggagtgggacatgccgagccaggcactggagggaatctcctggtctgctggttgcaaagaccgtgggaaaagcgcagtatctgggcaggagtgtaccgttcctcctggaagtctctcacggcttcccttgggtaggaaagggaaatcccccaactgcttgcacttcccgggtgaggtgatgccgtgccctgcatcggcttgccctctgtgggttgcgcccactgtccaaccagtcccagtgagatgagccaggttcctcaattggaaatgcagaaattacctgccttctgtgggtatctcactgggagcagcagaccagagctcttcctatttggccatcttgccagaccctctccagactgcttttcaagtttatttggggtacctgtacactttagcttaccctggtgaggcttgccagaactgatgttccaactgctgggatgggcgattcccctctaactaggggtggtttaaatactccctccaagtgtaaattagttcatccattgtggaaagcagtatggtgatttctcaaaaagctaaaagcagaactaccattcgacccagcaatcccattactgggtgcatatgcagaggaatataaagcattttaccataaagacacatgcacacagatgttcattgcagcactattcacaataccaaagacatggaattaacctacatgcccatcaatgacagattggataaagaaaatgtggtagatatacaccatggactactatgcagccataaaaaatgcgatcatgtcttttgtgggaacatggatggagctggaggctatcatacttagcaaactaaagcaggaacagaaaaccaaacactgtatgttctcatttgtttgtgggaactaaatggtaagaagatatgaatacaaagaacaaacaacagacactagttgggggagggctgttgggaagagagaaaggagcagaaaatataactattggatactgggtttagtacctgggtgatgaaataatacctacaacaaacccctgtgacacgtgtttacttatgtaacaaaccttcacgtgtactcctaaacgtaaaataaaaattaaaaaataaataaaaatcaaaattaaaaaataaataaaataagtactcaatccacaggtgggcatcagctgaaattatcccagttttactttctgctgagtcagggcagcaccgaggtcaatgcaatgtttcacaattgctgtactcttcctctcccaagtgcacagattctctctccatgccatgtgaccattgctaggggatgggggaggggtaatgctggcaatttaagactgtctttcctgccctcttcattgcctctttcagtgatacaatgttaacacgaggtactgtgagtgtttacctgactgaagatgcttttttttttttttttttggttacatagttgttgaattggtgtccttgagttggggtgggacaagcagtggagccttctgtttggccttgtagctacacccctctctgaatgcagttgttaaaaagaatattatgaaagaatatttattggcatagataaatgctctcaaaagtgtagatgcttgtttacatgcttttcaacacgtaacattgtttataagaataatattgggtgaagcaaaccataaaatatcaaatgatagaggattaattagtactataatacatactctgattaaatataaagcatggttaaaaatcatgaatttggggtgttttctaagcctgtatgaatattgatgcaaatgctaaatgaaaacacacactatatgttcagtataatttataatatctgtaacctatatgtataggaaaatataagggattatatcctgaaataataattagtcaacttttatagtaggggaattatttgtttaaaatgtatttatttttaaatttgaaattaagtctaccaagtaaaatgactatcaacaaaattatggactagatgtttgcccacaaaattcatattgaagccctaacccccaacatgatgatattcggaggtaaggcttttaagagacacttaggtatagatgagttcataaggttggggcacctgtgatgtgattagtgccctcataagaagaggaagagagaccagagcttcctctctctgttgtcagaggatacagcaagtaggtggttatctgcaaccaggaagggagccctcaccagaacctgactatgctggtaccttgagcttggactttcaggctccagactatgagaaataaatgtctctgttaagccactcagaatatggtgttttgttatagcagtctgatcagactaaaacaaaatgacaacagcaaaactggaggctttctatttcaaggatccagtagtctctagtactatacaggaggtaaaatatatatctctaatgaccagaaattgttccagtaattttaaaagcatagatcccaagaggaaaggttggatcaattagcatgataataaaattgatggaaagagtagttactacttggtgtctactaggtttttgacactgtaagaggcacttttacaccttaactcatttaatctttatgacaacacagtgtgtcacttaatttttattatgcttcatgggaaggtggggattatctcaatttcacagatatggaaagtacatctctaagagattaaggcacttaagatcatatagctatcatgtgcagaaagcagcgagaatttcgtttgtctggttcctatgtatctgttattttgatgatcactatgccaactgggtgtaatgagggaagagtttttagaagggatggtattcagctatgatagttaaccaatagctagagtttaggtttgagtactctgttgtcttagagatacgttttcattaagcattgatgatgaaagctgctttagttcttacactgttcactttggatgaaataggttggattgcaaaaagggacatttttaactttttattttgaaataattttagacttactgaaaaatggcaacatcagtacagattttctgcatacttagtttcccctcattttaacttcttctattcccatagtataattattgaaactaggagacactcattgatacaatactattaactgcactacagattttatttagatttcaccagttattccactaatgttcctttcctggtcaaggatctcatccagtatctcatgtttcaattagttgccattctccttagtctcttctagtctgtgacagttctgtcttttcttgtctttcatgaccttgacatttttgaggtatactggtaagatatttttcagtatgtttctcaatgtgagtttttctgaagtttcctcatggttaaattcagattaggaatttttggtggggataacacagaagtgtgtctttcccagtgcatgatatcaagaggtacataatttctctatgtctccttactggtgatgttaaccttgatcacttaggaaatgtggtgtcaccaggtcattccattataaggatgatacagttttccctttgtattaattagtattttattaggaaatactttgagattatgtaaataccatgaatacctgtttattcatcatatgttttgctcactaattttagcactcatcaacatttcttaactacaataatcacttttgtggtgtttgcccaatagcaatgttctatctatatcattcattctacatttattaatttgaattctactgtaaaaagatctgcccttcttctccatttatttatttattcaattatttatttttattagtatatactccaaggtatttattttattatatggattgggctctattattatcatcatttaattatccctatatctcatgctatataaaataatgaactccaaaaggaacagctaaataagtgtaaaaatgaaaccacagaaatgctagaagaaaatatgggtgatttcctcttaaggtttgttgtttaaggctttccaactacaacttttcaatttacatgaaattccatatgcaaaaataactaaatacataaaatattgataaattagactacatgaaactaaaacaattgcactataaaacacgataaacaaaattgaaagacaactgataaacaggaagaaaatgtttgcaccatatcacaaaagactaatatcccccaaatataaagaactcctaaatcgacagctaaatgactaaaaacctgatagaaaagggaaaaaaagacatgaacaggaaattcacccacacacttacacacaaacacacacacacacatgtatatatatgtgtatatgtaaagatgtcccataaatataggaaaaatgcctaagctcacttataattagagaaatgcacattaaaacaatagcaagatgctgttttcttcctatgaaactggtgaaaatttaaaaatatgacaacatattcttttggcaaggctgtggggaattactcctccttattgctgatgggaatgcaaaccagtgcaaaaggggactttttcaactatctagcacagatgttatacagatgaaacagaaatgtatttattttctggtgatatttgggagaaggctgcgttacgatgatgtttctggaggtcactggtaatgtaagttatattacataagattatacaactgacatttatagctacttgaaatactttcccaaactttcccttattgattgtctttaaggaaatatagtcatgttcagggagtgtcaaaatgccagccatctccattgttactgaaactatttctgcttccctcctactctccacctgattcagagatctgacttactttctacaagaaaatagagctatagagtcatataactcagagctgaaaagacctttagagatgatctagcccatgcctgaatgatttagaggagtaaatgaggcccagagaggggcaatgacttgtccagggtcacacactgagccaagactggaagaaaagggtcctgaccagaatgctccatatctcttgcaagatatgtgtaaattaccagacacacagtaggcatgcaatatatgagagcaataacaaccatttatttcaaagggtgcaagggttcccaatttcattccatgagaggaatttgtgttttaagtatcaaattgaggaaagcatacactctatttctgtaatcattaataatatttctcccagggttctcaagtagcaggcatccattagcacttaacagctataacatcatgagaaggcatcaacggagtagtgactactaaatttcagtccagctctattatcttttcctcttgatagtttgacttcgagctttagtaactgtgggcctgcactgggcctggagcctccatttcaaaggaggcttgtggttgcacagtgcacaaggatgcataccgagggaggtaatgggagctagaatccagcgtatgatctgctaactaaacctggagcccttgcttgggactgtcttttcccaaggaagggggactttgttctcccaaaggctgtctacatgtgcctacagagttgtgtctaccttgaggggagagcttattaattcacacagaggtgctgtataaggtaatggaggctgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactgtgagtcctattaaacctctttcttttgtaagttgcccagtctcgggtatgtctttatcaacagcatgaaaatggactaatacaggggctctggttagaattaaaaaccaagtctgtctaaatataaagcctgtgtttctccatctttactcagaaagctatgtttttatttattatttttattttttaataatttaatttttatgggtacataggtgtaagggctgtatttttaaatcttaacccaggaagctagaagattttatagaatatctgctccaaatcttaccctttatagactataattttggccccttatgattaagtgccctgcacataatcccacagtacatataccttgctctgaaggtatcattcagtgtatttctggaaaaaaaggaagtctttaatttttcaaatattaggaagtctctaggccttgagacatactgttcaggcaggattcttttaagatgccaaaaacatactttcagcattcctttgtttttataaagcctttaaaaatatctgcctggaaatttatactaagtcttcacttaattcaaggcagtggatattatagcttatttggggactccaaacttgaattttggggttttaatgtgacacaatagtgtgaacacggtttgggtatggatgaatcttggttatttcctggtgctttttcgaagtagttttataactctgggctggccatttaactccacaaagatgtattacctatttttttttttcagttaatagtaaattatgattgtttttccatgtcattatcgtgttatataattatttttatgtctgcatagtatcattgtgtggctcaactatcaaaagtaatcaatctcctattatggttagatgtctgtgctatttcccataactgtgataatttctcttatagctttatctctgcaaggcctctaattctgagtgttatttttcagatgaaatctgcctactctagatatctatgacaataccaagaaatttatttagctcgggaatttctaaatatggaaaaattagtaacaatagttactgtttattgagtatctaccaggcgctggatcccttctaaatgaatattttgggttaggaaatgtttcaagatgggcctcaccagctgttcacttcaactgtagggaaatccagtaggaagtgtggttgtgatcgccatagcctcctggtattctggccagtacaactcagcagtaacataaaatcccaggataccaaatcagtttcaaaatggagttcttcttctagggagggtagttttcattttgatccagtttgtaaagagtcctttctggtagttaaatgcacatgccgtttctctcttagtttcttcttttcattgttcctggttgcagatattaaaaacatatcattagcataagagaagaaacgtatttcccaactcactgtggcatatattttactcatctataagtggtagccgacagccaaggatacattttaagagtataaaaaccttagccctcatccttctaaaatgaatacttagtcattcttaatttctgttctcagcaatcttcaggatatttgtatatatttcctagtgttgagaaaatgaagtataaaaatttattaagagatgagccacaataaggaagatgccagcaagcatgctcagaatggtgcaatggtgtgcatttgtctcttccactctacttaaacctcaaaactctatgctagtttcagctcctgctttctttgattgtattttaaaatgaggcagctaggtagattgactgtcccattcacctaagtagtaaatgatgtttgtgtgttccagagctagaggaagtttgggctttctgtgtgatgcacatgttgcaatcatatatactaatgcctgcatactccctctgcatactaatggcagagaaaagctattttgaatgagaatatttacattcagaacctggagccttttagaaaaatagtaacaaattttgataaattttcaatctgtgggctttcctacatttttatagaacatgatttagagatcccagctgaggagcctatgataatagctcatcattatatagcatagattgcattcagttattcatttgttcattcaacaaatatttatgaaacacatggtatatgccttttcacctgtaataaaaattagaaatcggattttctgacttaagtgccaaatgcatttgctacagaaaataaggtgattagagagagatgttagcatatggctagttggagccagggagcagatgatattcacagcaggagtgagtatagagaaagaagaggaaggtgttaacaaaggagattttggaagaccaagatttaggcaaggagtgtagatgtaaaagagtccaccaaggaaactgtgaaagataatatagtgagttaggtggaaaatgattctgcttgttgttggaaactagggaacaggtgaaaaccagagagagcataactaagctgtacaaatcaaactattatttttatgtgtaacaataaaacaatgggctgtttttattattgtaatgataaaattcattcctatcctccaaggtattgtaggttacaaaggaagtcatatagattatgtttttgtcccctcatcaacattgagaatgaactcacaaatgaatagcgtgttttatatatgcttagtttatcatcaaaatgtacatgtattttatagccaaaagctgcataatagccgttaagaaaacaaatgttaacttcaccatgatccctaagaaatttccaatatgagttcaataattcactgattttccctgatatatctgactaacattatcatcagctaattttccagtgttaacattttttatacatcatttggatcagaactttatctactatctgagtcattaagaagtcattttggtcagtattaagattattcaacaaaatgaacatcagccaaagctttactttagctgaaaattatccaattttgaattttaaaatttaattaaatgaatttaagccatgaattccctctgtggaactgcacatctggagctacttgcaggatttgcaccttccattttgctgcttatgctggttgcagcagttctggcagagtattcagaataacccagaggcttattagtagagtaggaacagagtctaagagtgaatactataaggaaagggaaaggatggggcagagcaaacagtgacccagggagatcggaatacttaaaataattagatttctagaaaaactgaatgcttactctcacatctgccaacactgctgctacctttatggatgtgacacaacatttgtgctatacttcagagaaatcttagagacattttctgtctcttgccagtatctccagttcttcagtatgtagaggaactgaagtgtggctgggccatttaactccatacatgccttcagaatgattcatacatttacaaagctatgtcagtcttctttcttctgaaggtttttcaggttttgtttattttaaatatttgttgcacaagcaacattataacagtattaaatatttggtatgaagagatggtgaggtaatagatgattattaagaatgttctatttctgttaaatttctgtttccttcctatgactattttgatataatttttataatatcatgtgacaagataatctaataacacatttctatttttaaaatggattcaatgggaaaatcaggttgctttatagaaatttattctagagcaaatttatttagttggtatgtcagcctactctttaaaaaatgtttccagctggatgcagtgctgtgcccctgaactcccagctacctgtgaggctgaggcaaaaggattgcttgagcccaggagttcaaattcagcctaggcaacatagtaagaccccgtctttaaaacaatttttaaaatgttgccattttgtgggaaaatgtaccctccttcctcccatgttggggtaatacatgctgctgctgaagcccagtagagggcaagtgcatagtgtagtggaagaaattcaggctggggaagtgtgaggtaatggcacatagtttcaattcctggctctgctattcactcattgttcgatcttagacctggcttagtcctcagtgttctcatgagcaaaatgaaagaaattgtgatagatgagttcaaagtgctgctttagtcgtaattaccatgatcagacatggagatggagctgaactccattgctcttatagggcaaaaaattaaaaacaaacaatcctaccattggtacatttccaggcacatagacataggagctagtctatttgggtttgagttttatctctatcatttacaaactatgtgaccttagttggctttgttaacttccctatgccccagttcttcatctgtcaaatgagtgtaataataatgccaagttgtctggttgtaaaaataaaatgaagtaatgcatgtaaaaccgtcagattcaacagtcgattataaacagtgtgctgtttgctgtttttttcttcaagtagccaagttatatgatatttatatagaccacatatgccagcagtcttttcacctttcaaggcatcttgtagaaaaaaagtcacgtttaattttattaccagatggcttttatttatcaaaaatgatagtctctcctaataaaattattccaatgctaggcattctgctgagaaaataatatttttatttactatttacttattttctaacaacaatagtttgagtaataacccatttctttaagactaagtgataagacacttaggcaaattaggaaccacattcagtaatcactcatatttgttaggtaaccattgtcttggggtttgagaatagtccagtgtgaccttgtgcaaaacctggaagcactttcaggctcttccagcctgttggactactgatatatctcatcttctcaattgtactcacagaggttggtagggtatttagattaaggatcacttttatttttaatctctgtaataaacaagaatgattgaagaggtgttgtcacaggagactccatcctgtttaacaggaatattaggtaggcaggggcatggtggaaagccatagatagagacagctgacttgaatcctcttcccatctctgccactattcactgtcctctcctctctgtgtgtttctgtaaaactctgtgattctatgaaccttgttaacttagctggttaaaaacaaacagaaaccaaaaccaaaatccaggacatcagttcctttctgtaaatctgcgaaacatttagttgcttgtcacaacatattcagtgtgatctagacacagcctaaacttttccttccacataggcctaatggaggatgttgatgttttgtttccttacttcacagaggtgtcatgaggacaagcatgaaaaaagtagggatgcatcatttgagttcttcaggaggaagctactacctaagtaagagacattagtatgattaagtgtgatgtcattaatattcccccaaactgcctttatcctatttgtactgtaggtaatttttgtgactggggaacatccccagttgtattttcattttaatgagaaatgatgacagtgttgcctcattgctcttaaaaaatacaaaaattaaaacacacacacacacacacacacacacagaactgacataggacctcagtacatttttacctttaccttgctgctgctgcttttctcctccttctcctcctcctccttctcttcttcttgttctcctcctccttctcttcttcttcttctcctccttcttcttctccttcaccttctcctccttctccttcttcttcttctcctcctcctcctcctcctcttcctcatcctcctcctcctcctcctcctcctccttcttcttcttcttcttcttcttcttcttcttcttcttcttcttcttcttcttcttcttcttcttcctcttcttcttcctcttcttctccttctccttctccttcttctccttctccttcttctccttctcctctttctcctccttattcttcttctttcttcttcttcctttgtttgacagagtctcactctgccgcccaggctggaggctggagtgcagtggtgcaatctcggttcactacaacctccgcctcccgggttcaagcgattcttctgcctcaaactcctgagtactttgtactacaggcatgtgccaccatgcccggctaatttttgtatttttagtaaagatgaggttttgccatgttggccagactgatctcaaactcctgggctcaagtgatctgcccgccttggcctgccaaagtcctgtgattacaggtgtgagccactgtgcccaccctaccttgcttcttcttaaaaaacaaagcaaaacaaaaccataaacaaaatgctgaggtttcttctagcactggtctttattgctcactagtcaaagctcctcattttttgcaattttggtaagaatacttaccatgagacctttctttttaaacacattttaagtgcattctactgtattgataactataggcaaaatgtcgtataactataggcaaaatgttaaacagatctctagaacttaatcatctttcataactgaaactttataccagtcgaatgctgaacactatcccattgtacgtctacaccaagttttctgtattcattcatttatcaatgggcattttggttgtttccatatcttggctgttgtgaataatactataatgaacatgtgaatccaaatatcttttcaagatcctgattttaattcttttgtgtaaatactcaaaaatggtattgctagatcatatggtagttctatttttaattttctaaggaacctcaatactgatttccatagcagctgccccattttacgttcctaccaacagtgtatataggttccaatttctcagcattctcactaacacctggtagtttttgttttgttttgatagtagccatcctaacaggtatgggatgatctctcactgtggtcttgatttacatttccccagaaataaactcatatatatatatatatataagatcaacttatctttgataagggtgccaagaatacacaatggggaaagaatagcctcttctatgaatggtgctggaaatactggatagccacatgcaaaagaataaaattagaccccgtctcccaccacttgcaaaaatcaactacaaaaagagtcttaaatgtaaaatatgaaactgtaaaactcccagaagataacatggggaaaatgcctcttgacattgatcttggcaatgatttcttagatattacactaaaagtacaggctacaaaagcagaaataaacaagtgggattgcatcgaagtaaaaagcatctgtacagcaaaggaaataatagagtgaaaaggcaacgtacagaatgagagaaaatatttgcaaactatatatctgatacgaggttaatatccaaaatatgtagagaactcctacaactgaatagcaaaaaacaaatattgccatttaaaaattggtaaattgcttaaatagacatttctccaaagaaaaagacatacgaatggccaacaggcatatgaaaagatgttcaccatcactaatcaacagggaaaggcaaatcaaatcccattttagagatggagaaattgagggtcaaagaagaatgttatttgcccaaagactctaaactatctggtggcagagcctggatgagaaccttggccttctgattccttgggcgtacttttcccactccagtttgtgctgatgactgctctgccactaaatcatgtgtattaaagtttctcttctaccagtctgtgagggcatggattctatcatatttagctgaaatgattatttcttcagcctttcttgtgcaacttcctctatgaatccctgagtctgcatgcagaaatgcgttactgaaatgcagaagccgttttcccccactagtaataatctgttcctcattcaaatacacaccttctgagctggggttttgtcctcttttgttttctttaacatagatgtgtcctgactatgtggagggactggaaaaggaaaataacgtttcacaggagaagggctgagaatattgttaaagcacagacaatggtggagcttgaaatcagagaaaaaaaatacagtataatggctccctgtcccttgtagcattccatctttcagctctcaccatattccaagcacaactacgtcccttaacaaaatcatatccctgaatcctgatgatacccaacaactcagataaatttcccagacctgttcccaacctctctctggtcacacctgcattcctgaccttaacgaccttctcccaaccttgattatatccttcaaccataaaaagccacttgagctgaggccattctaccacattaatcatgtcctccgctgttagttatacttctatcctcatgctcgctaaagtggccacacagcaatagtatttaacacaccctttctgactcttcttccaagccttgtcaaactgcttggctctgatcagatgtccagtgtgatccttgattctgaacaccaactggtgactgattctgggagccagattaaggcaggcggtaagagcaaaggaattggatgaaccaagagatatgtgggagagagagagaaataagatgtgagaaaaagggtaaggggactgagtatgagaagggcttcatggcatggccaccaagtctagaattaaatgtcttttgcttgtgggtgggtattgagaatgagtttaataaggtaggctggttcccaatttttacctctctgtgaactgtggtccaaatgggctgggctgttggactgtatcacctgagcctgatggagcaggctgattgagcattttctggaacgctgtgtgggtgaatgatgatgtacagaatatgtcctatccatcctcatttcttcccattcactcctagcatgttggtatatacctgacatatcatggttgctcaaaataggatcatttcttcagaataattcttgcattccttagtatggcatatagagccctgattctcaactgcctcatttctcatcaggataaccctcctcccttgtgttcgcatgtgtgtgtgtgtgtgtgtgtgtgtgtgtgtgtgtgtgtaagcacacaattttgttccagctgtgtttatccaacggggccaagttctttcacatcctgttgccattgtacctgttgtttctctacctagagtacccttttcctctattttttgctcagtcttccagtcttatcacaagcactactttgtccaaaaagcttttcttattggccctagaatctcctcagatgtcccttttctgtgttctcatagcattccactcttaaggcatcattgccataagaatgaaataaacaaaacttgacagttttgtttctgatttcatcccatattgaaccatgagcttgtagagggcagggactgcatcttatttgtatttttctactcctagtgcttaacccaaggccttgtacatattaggatttcaatgtatgtttcctaatatgtgaatggaaaccttcctcctatttatcttctctgttctatttgacttttttgttcactttcatttttttgtctgtaaactgaatacatacattaagaagtcaccaaaatgaatgggcatctacaagcaaaccctattcattcttatcatccagaaaacaacctgtatttctcctaaacacaaatttcttctatgctttccttgccattaatgcaaaaaaaaaaaaaaaaaaaaaaccacacttctggaagcatccatagtgatgacgatcattactattctctgtattctctgaagattattagaatttatcaagcagctgtttcatgggaagagtgttagcaattgtattgcattttgtagctaattgcaggaacaaagtgtcaactaatgcaaaatttggtttttaaaagaaaacattctctccctaatcaagtcctcatggtaaagacaacatgaaattattattgatcatcactcatgagccaggagagagatgaagtagtatattctttttgatttctacttaagaatttgaaaggtaggatgctacatgtttcaaggagatttgcagaatccagtaatacaaattctgaagactgaaaatcaggtaaggtttggctcggggattaaaaggaatgggtaaaaagtgcttctgaacattagagaagcccagactgatagagatggacagacttttcagaatatctattttggtgatcctcaatttctctttttgcttatatcccctctaaaaggaaaaaaaacattttgaaaaactacataactgttcatacatctttatattgagatatatgtatatacattttaatcatgagtttaaatggttatgaaggaaataactttcagcatattgcatattgattatacattttaagtacatttttatcacagccttggcattactcaattaactcattcagtttatgggaaatgtctgccatgtaacctcaatagtgaaaccagtcctcattgtcaaaccagcctgccaactcagactggctttctgtttgaaagagtctgatttcattatattcccctgtgacaagcatctcgctactgaattctaacataaagataggtagctaaggtacagagccttgccatggtttgtcacttggatgagataaaggcactgcctcatcaatatttcttacccaaacactctgctttgctctccagggactctttttcaggagtctctgtgtccttgaatcccttctttgttgtttggtaccccagaggatcttgccctctggtacaatgctccatactaaaattcaggatgagaagtatgtctgtctctcttttgtcaaatgggaaaaaggtcattgtggaaattgaaatggaaaaaaaaaggaatatacaaatggtaggaagatataccaggctactcactctttggaaagtcagataaccaaatttgcctgcacattgtttacatgtaccctaaaacttaaagtataataataatataaaaaaaaaaagaaaatctctgatcttatctactcctcccttattttgttgttgggccaactgatacctcgaaaaaagaatggactaatcccaggtaccaatgcttgttaaccagtggcaaagccagtactggaatataggtattttcatttcccaactaatgtgcttcctgcctcatggtgtctccttaatctgtcctatattcaaacgattgtaatttctttatccagtcacagtggggtttttctcatagaagaggtctgacctttacatttctttacagggaggtgtgtgtacatagagaatgccaagatggtagttgtttgtttgtatgttctcttacattacttgcagttgaagcaggtaaggtgactacttaacaagtcttcattcaaaaacctgtaatttgagaagcttgctccatattagtggaaaatgcacttttcatcatggggcctaaatctcttgatgcttatcattttttttggaatagtttactatttacttaattttgctatttttgtagatttagttgtaaggtctcaaagtacataactctgttttttactccattatctcaaaatcctgtaaaacattcagtaatttggtcaaactgcctcagttcagatattgatctgccacctgctagcagtatgactttggaggcagtgttaacctcttgttacttcagtttccccctctgtaaaatgagttgtgatgattgaatatattatataaatctaatgctttgaagtacctggtacaaacataataagtcttcagtaaatgttaactattgttatcatcattgttgattgaaaccatcaagtaatctaacattaagaacaccaggggccgggcgcggtggctcgcgcctgtaatcccagcactttgggaggccgcggcgggcggatcacgaggtcaggagatcgagaccatcttggctaacacggtgaaaccccgtctctactaaaaatacaaaaaattagccaggcgtggtggagggcgcctgtgatcccagctactcgggaggctgaggcaggagaatggcgtgaacccgggaggtggagcttgcagtgagccgagatcgcgccactgcactccagcctgggcgacagagcgagactccatctcaaaaaaaaaaaaaaccagggcagctagcccatagagattaaacaggttggaaagtagattaaatttacacagaggcaagttatgaggcagagagaacagacctgcagaaggaagtggcctggcagtgttatggacggtccatcaagtcatgtctgaaataatggtttagaacaatgctgtccactggagctttctacaatgatagaaatgttctacatccacactttctgctatgatagctgctatttgatatgatagccagttgtcacatatggctcttgagcacttgaaatccggctaatctgaataaaaaatggagtttttcatcgtatttgatattaattaatgtacagttaaatttatatgacgacatatagttagtggctaacattttggccagcacagatccaagacttcagctttgcttttgtcaattaccttaaatctttgaatagtaaaccagcttaaataattcatgagaacagtgacggtaagactgtctcttccagctctgtccatctctttgttactccttcatctctttttctctagctctgctcccatttctcacacttcatctgtggtatcctccttcattactccatgtttctttaaagccaggctcctcagccaaatatattttgatacctgtgcatgtataggtatgttcttaccaattaaggtcagatattcatgagcaagtatatgaagacacttatggtgcaaaggccaatttcttaggaatggaatgtgattgtgaggaagttgcaagctgtggcaaaaagaaaccttttcccacattattttcatgtgaggaattactgtccatcaagttagtattgattccactcacctattaagtagtagatcataggcaagatcatttaagattttgtagactgatggcaaaagctcccactatttaccagagctatataaagatgacatttcaatgccttcctcatgttataacacactatattttgaaagcttaaatagtcctttaagggaaagagaaacacttaatatacgtcaagaaaacgaattgcatttaatgtgaagaagtaccggccagaccacatgaagtgagcatcactcatgttgctatccaggcactgctttgggccagtgttcatcatgtgaacaaagtttctggaccttccaaaactacccttctctacattcctaatattcagattcaaagagttcattgttagtattttgattatcttaaatgtgcactgagtcatagttaatatcttaaatgacttgaacatttgctattctaacagaggctagtttatagagcactgtaaaacctctttttatttatggaatgcatccatattaaaattataacttcagcagctttctgtggagaaaatggtgactctgaccttttattccatctgaccactgagaaaaggactataatttcaacaatcaaatctcaaatgtgttattgtgcctattttctttttgtaaaatgtcattccatctatcatgctaacagctcaccttaatccattttcaatgggcttttttgcagaaaatttgcacaaatattttaaaatttctctatttcaatagcttttggggtacaaatggtttttggttacatgggtgaattttatagtggtgaagtctgaaactttagtgcccccatcacctgagtagtgtacattgtacccaatatatcattttttatctcttgtcccccttttaccatcccccttctgagtctttatagctcattatattgctctgtatgcctttgtatgctcataacttagttttaacttataagcaagaacatatggtatttggttttccattcctgagttacttcacttagaataatggcctccagctccatccaagttgctgccaaagacattattctgttccttttttatggctgagtagtattccatggtgtatatatactacattttctttatccactcattggttgatggacacgtaggtttgttgtatgtctttgcaattcacaatttttaaaaaatattctttaaaatagagctgttgaaagctctcacatgtttccagcgtaaacgtatttattaacaatgatttatttgaaaggtcagaggaatgtgagccttgtttccggtggtcacaaggggccaggagcattcccgagtccagcgcataacaaaagtaatgcagtgtcagaagaccagactgaaaacagcagttgtcaatgaatggacactaatgcaattcagatttttaatttgtttttctattaagagaaagtgagaagtgtccaatgaacagtggctcaaaatctaatacgcttggtcttaggcaactccctcaagctccatttcctatataggccaaactgccaccttcccagtatattcacattgctgccagcttaggcttcctaaaacacaacatagtgaccttgaactctgataatctcaaaccttccatattcatcaaagtccttcacaatttgctcttaccctcattctcaacattgcttttattttgttcccctgcagccccagtgaactgctctcagtcctgatgtcattccccacacttttttgccatcttttgctcacaccattcttcctccaaggccctttctttcctctggatctgtgacaaaagaactacccattcttctaattgaagttcaaatcctatctactccaaggaaccttcttagagcccccagtaatactgaaggcctttcttcttcttttttttttttattatactttaagttctagggtacatgtgcacaacgtgcaggtttgttacatatgtatacatgttccaaatgtccatcaatgatagactggattaaggcctttcttctttacagttctctggttctctaacactctggtgtagtagaagagctgggaatcagaaatcctgagtttggattccagttctgccattttctatgtacatgatcttggacaagatagtcaacctcactttctgagcctgtgccatcaactggaaaatggagataataatgcctttcctgcacatgtcacaggcttgctgtgaaactcaaaggagataatgcatgtgaaagctttctatatacagtgaagtgccatgcacatggggagtattattgctttcattattgtttttccattgaaaaatcagccaaggctgcttgaagcaatttgcttgaatggcacagaaggatgaagtttgtcagtcagtccctgagcacaaccatcaaagtgtcccagaaacttcagtatttcagcctccaaactttactctccagactgcctctggcaccacaaaagaaattgaaatcctcagtctcactatgtgttctgatttagggtttaaaaattagggtgcctgtaattacagcacttgattgcactagatatgagtttcatgaaaacaggtaccgcatatgattcatctctgtgtcttctccattgcttagcaccatgctgatgccaatccatagaatatgctaattctcacagtctcctttactgagctgtgatgaatgtaagtatctacggatgtaatatatgtaactgaaatcctagttgttagattacaaaacacgtattgtgcccatttgatatgctgttagactttttctctttcctttcttttcctatggagttgaattctcctaactttctttaaatattcaagaatagaagacttagaaccagaaagaggagataatgattcagtgaaaaggctgttgaaaggtaacaatcaggtcacatagtagctacttggctgaactgtagagatgagtcttctgcagggtggcagtcttgcctgagcccttgtttccagggtcaggggatccttgtaggctgtattataaaatgaataaaatcacaccagccagagagctccactatatttcctgcttatatccttttaatcaactcctcatgtaccaagcacccaatagtgaagagtcacaggtaacccagttctgttaacattatagtttccttagtttcctttattttccccaaatttgctctgttccttattatccaattctgcattcacctgactcctggcctctgaccccttgtcttattttgttttctgctgctataacagaatgctgcagactgggtaatttataaacaatagcaatatatttattagagttttctgtgctgggaagtccaagggcatggttatgtcatttggtaagggcctttttggtgtatcacaacatggcagaggacattacatgttgagaggtcaagagtgcttcaactcagatctctcttcttcttataaagctaccagtcatatcatgggggctccaccctgatgaccttatctaatcctaattgcctcccaactatatactgcctacaagagactcaagttcgcctgtaagaacatgcgtagactgaaagtaaaggaaggagaaaagatattttttgcaaatagaaaacaaaatagaacatgagtagctaaactcatatgatacaagataaactttaagtcaaaaactgtgaaaagagaccaggaaggcaattatataatgataaaggggaatacagaaagaagatacaataattgcaaatatacatgcacccaacatcagagcatcaaactgtatcaagcaaaaattaatagacctaaaagggaagatagactgcaatataatagtaagggacttaaacacctcactttcagcgatggatagatcatctagacagaaaatcaacaaacaaacattagagttaaaccacattccagattaaatggacctaacagacatttacagaacattctatttaacagcaccagaatatacattcttaacagcacagggaacattctccaggataggtcatatattaggctgccaagcaagttttaaaaatattttaaaaaaccaaaatcatattaactatattttctgaccacaatggaatgaaattagaaatcaataacaggagaagctctggaaattgtacaaatacatagaaattaaacaacatattcctgaacaaccaatgagtcaatgaagaaatttaaatatttcttgagacaaatgaaaatggaaacacaacatacaaaagcctatggaatacagcaaaggcagctccaagagagaattttatagcaataaatgcttgcattaaaaagtagaaatatttgaagtaaacagcctaacattacacctcaaggagctagagaaacaaaagcaaactaaacccaaaatgagtagaagaaaagaaatactaaatatcaaagcaaaactaacaaaaaggtcctaaataaattataaagctcaacaaaattaagagctttttgaaaaactaaacaaaactgacaaggcttctacctagaaaaaaaaaataatgaagtaaattattcaggatctataagaaactcaactcaatagcaaaaataaaacttgatttaaaaagtggacaaaagatctaaatagactttctcaaaagaagacatacaagtggctagcaggcatttaaaaaaatgctcgatatcgctaatcatcacgtaaatgcaaatcaaaactacaatgaaatatcatctcacgcccattaaaatggctattatgaaaaagacaaaaaataaaaaatgatggtgagggcccggcacggtggctcacacctgtaatcccagcactttgggaggctgaggcaggtggattgcgaggtcaggagatcgagaccatcctggctaacatggtgaaaccccgtgtgtactaaaaatacgaaaaaattagccgggcatggtggccggcgcctgtagtcccagctactcggaaggctgaggcaggagaatggcgtgaacccgggaggcagagcttgtagtgagccgaggtcgcgccactgcactccagcctgggcgacaaagcaagactctgattcaaaaaaaaaaaaaaaaaattctggtgaagatgtgtagaaagggaaatccttataaactattggtcgtaatgtaaattagtataagtcaacagtatggaaacttctcaaaaaaaaaaaaatagaactaccatatgatccaacaatcccatgactaggtatatatccaaaggaattgaaataagcacgttgaagagatatctgcactcccatgttcattgcagcactattcacaatagacaagatatggaatccacttaaatgtccatcaatggatgaatagagaaaaatgtgatatacacacacacacacacacacacaatagaatactagtgagccataaaaagataaaattctgtcatttatgacatggatgaacctagaggacattatgttaagtgaaataagccaggcgcagaagggcaaatatgatgtgatctcacttacatgtggaatctaaaaaaattgatctcatagaagtagagagtacaacagtggttaccaagacttgggtaaccactactggggagaggttgatcgatgggtatgaagttacagttagaagtaataaaatgtttgtgttctattgcgcagcagagtgctcagtgaacaataatgtattgtatacttcaaaatagcggattttgagttcataccacaaagaaatcacctgtttgaggtgatgaacatactattgaccctgatttgacttttacacaatatatatgtatgtatcaaagcatcacactgtacccaatacacatgtacaattattatatgacaaataaaaagaaaatataccttaaaaataaaacaaaagtaaaaagaaatcccacacaatgaaaaaagtatatttgtttaccatatgtctgacaagggacttatgaaaaactattacaactcaattaaaaaagacaaccaaatttttaaattggagaatctgtagacagttttacataaatatgtgcaattattatttgtccgttaaaaacaaaataaaactgaaaaacaaaaaccctagcaattattagcacttactatgtacatgatactgagttaactgctttacatgtaacattatatttaattctaacagtattcctttgaggtagatactgttcccatttaacagaggaaactgagatctagaaaggatagttaacttgccaaaagccatacagctaataggtagaggagccaggaattcaatctatttttgactccaggcccctggcaataccctgtcctatttctcaccagggaacccttggtgttgtgggccactttggtcagtgctccccagatttgcatatattctttttcataacttagaaacactcaacttctgaagtttaggaaatacagttcatcatgaacccacttaatctttgttaactgcggagaccaggtttttgaattttactcttaactcaagttgccaatgagtttgctgaaagattaaaagactaagtgctaccgttgtgtggttatttgaattaagcatcgaagtgtaacatttatctataaattctcaactctagtgcctaaaatcattttatttcttgtcatattcgaaaataggatttggttgctgaaaaaagtatggagaataagtgggaatttaggagaatctgcaaggcttgttggaaactcaagcagacgaagaccagtttggaagtgatgtattaactcctaaatgcattttttgttagtcactagcaaatatcgtgggtccccctggtgctttgtgagaagataaatttctcctgtaggtgaattaggtataattggaaacaattggactagaagcatcctgacgcgctctgggtcaaaagcttttcagcaaggctgtttttaggagcgtctgaattgatactgtttctgtagcctaccaatctccaaacagagtgacatattgtttttcttctttctccccctcctatgtcattgtggagaacaatatggcagtgcagacatagcatagagtctgagaacaaagtgcatatcagtcccagctatgtcccttagtagctgcgtgactcactgtaaaataggtcttgatgcccgccctcctcttcctccgcttaattatttttaaaaatacttattgagtgccaaccatgtgccagacattgtgttaggcactgtagctgcaatggcgaataaaacagacatcattcatgcactcctgaaactaaaaatttaatagattatatctgccttctgatcagtaagcctaccatgaggaataaataggcgtggtggatgtaaagtgcccaaaacatatttactgtgttcacaaagtgtgaatttcctttccttttcttcattttggcattataacgttagctgtagatggcatgtacatgcagcatagcatccggggtgtgtacatgcacacacacagacacgcacactcaattctctatagcttcacttattttagtctaagattgttgccattttcatgcacagctattatggtaggtgagtcagccaatcaaaaacagatttgattgatttgctttgagctacttgcctgccaacaaacgacaatggctgtatggatatagtcattgagtcaggtggctttatggatttccattggtgttagacttttaaatttagtttcttgctgcctgttatacacgggaggcaatgacaagctctcaactctctaatttgctgtagtggtgtgctaattaaaacacattcctaatacattccgttttggattcagagccagtgttcttataaaactataacactagtaagaaaaatgcaccatactatcttatgagaaatttcataaatgtgacaccccacaaccttattttatttttcagacattatacaagctatattgcaattttatgtcctattcgattcttctccacaaactgctttgccctgtgtattccaaatttttgtaagtgataccaccagataaatccaaaacctagaaaccagcctagatgtttcattctctgtcacccatctctctagatatgtcctatcccaaagttcccttgagtttgctccataaatgtatccccatccccactgccactacctcagttcatgctccagttatctcaaggttacagcaataacttaacagaattccttacctccaatcaatccctctcctccatctttcctactacctatactacagaataagtcttctgacacacagttgactgtgtcacttttctgtttttcgagtttttcagtcactctccattgtctgtgcagaataaagcccaaactcctgtgcgtgacatacaaaggtcagcctaatttgcccctctccctccagtttcaactctcatcaactgtatttattttctagtaatccaaaatatgtatagctccagaataaggcatttactcattcagtggatatttatgtgccaggtacttgtttagatactgggtatattgctgtgagcaatacagacaaaaggccctttcttcatagactttacattctgtgagagaaacaaactaaatggatacattatttctacaacttttttgtctttacatatgccatttcctctgcctgaagtaattttctcactccccatttctctaaaaattgcctagtcctctttcagaaaatcagcttgcaagtatgacatctaagagagatttcagcctgctttcatcttttctctgtatcttttcagagtttcactatagcttctgctttgctgttgtttctcattatttgcatgtcagaaccctccctcgtggcattctctatttaacaggactatatcttttctactctgtcttcacagtacttggcactgttgtagcacttagtcaggaaacagaaaagatgtttgagtccatgaaagcctggaaggcagggaagaagaaaggaggaagacagaaaaaaggaaataaaaaggagagagggatggggagaagaagggagaaagtgagggagggagaaaagtcaatttagtttcatttctccttggtttggaaaaggtataactagttttgtattatgacccagtaggattgcatagtcaagaaagtgccactaaattttgcaacttatatttccttaaaagtatgggagaaatgaatatttccctttgcggtttggtttattaatcattatcctacaagttaatattaaactaacaaattaaatgaaatctccatcacacacaggtgaattaatctttgccttcatatcttcttgctatgtaataattgtcagaacttgcaagaggtatatttttatgttattttaatcatgttcctgaggggcatcaaggtgaaatagaaagagcagagttaggagatatgaagtcgagtttgggttctgcaacctagtagctggccgaattaggggaagcattttcactgtggggagctttagttttgtcgtctggaaaaggaaggaaccagaatgactgctcactgtactgtttccagtttgcctcttctcattttagtttcctgcttgcaggaaactttacaaacatactaattgagtgatgatcagttatagactgccttagtttccatttcatctcctccacaaggtacagccttgtattctcctgtggctataaataaatcccatcatagccttatattctgtttactgtattttgtcttgacctttaccaagggatagattctgaaggcattatgcagttggatcaaatggcttgtattcaaaattgtggcttgagtctctccacccagatgtcatggatgttgatttccctggtgtcttaatccaccctccccgcaggactttccatcttctttaggcctctttccctttatccactgcctttctttgctgtagcctccttgtccagttttactttacttccctaaggtttctgtaacattggaagacctgccacctgtgacttctgtgtcacaaaacattgttttttcttaatggctctcctttttagaagatgagaaatttacgtttaaattgtgtgcattgagcttagtgtgcaatgattttttgtaagccaagaaaatcaggaagaaccgcaaagggtaagggatggagtcttcaacaaatggtattcgttaattttctgcccattaagggacataatctaattaaattcttatcctacaacatagacaaagtgaattcctgctgtattaaagagttaaatataaaagaaaatgaaatagtaaatatcagaataatgtggaatatttaacaattttggggggcagggagcaattttggggggttgtattagtctgttctcaggctgctataaggacatacccaagactggataatttataaagaaaagaggtttaattgactcacagttccacgtgcctggggagacctcaggaaacttaaaatcatggtggaaggcacctcttcacagggcaacaggagagagaatgatgactgctgagcaaagggggaagccccttataaaaatgtcagatctcatgagaacttggctatcacaagagtagtatgggggaaaccaccccccatgattcagttatctccactttgtccctcccttgacagaagaagattattacaattcaaggtgagatttgggtgggagcacagagccaaaccatatcatttcacccctggccactcccagatctcatgtcctcacatttcaaaacacaatcatgcccttccaacagtcccccagagtcgtaatccattctagcattaaccaaaactccaagtccaaagtcttatctgagacaaggcaagtcctttctgcctatgagcctgtaaaatcaaaagcaagttacttacttccagttacaatgggcatacaggcattgggtaaatacaccccttccaaatgggagaaattggccaaaacaaagggcctacaggctccacacaagttcgaaatccagtggggcagtcaaatcttaaagctctgaaatgatctccttagtctctcatctcacatccaggttatgctgatacaagaggtgggctcctacatccttgggcagctctgtccctgtggctttgcagggtacagccccctgccctggctgctttcacagctggcattgagtgtctgtggcttttccacgtgcacagtacaagctgtctgtggatctaccattctggggtctgaaggacagtagccctcttctcacagctcccctaggcaataccccagtgggaactctgtgggggtggggggaggctccgaccccacatttcccttctgcactgccctagaagagattctccatgagtgggtctgcttctcccagtccactcactcaaatgttaatctcctttagcaacaccctcatggacacacccaggaacaatactttgcatcctttaatccaatgaagttgacactcagtattaacgatcacaggggcatttaaagccaaagcagaaatcacaaagaaaatgactgatagatttgatatatcaaaatgtaaaacaaaaataaaaaccaaagctttcattcatcaaaacatcaaaaataaaaacattttctttaccactccctttcatgggctatagatatcaaagggacttctggattttattcagggccagcatcatgggtgtttggcctgtgtagtcgcacaggccaccacacatggaaggatcctgtgattggttcaatgctctgttgtatccatcttgacattcataattttggaacaagggacatttcatttttttattttgtactgggccccacaaattgtgtagccagtcctgagtctcttgaatcattctggaacctccctgctcatagtgaaatttttaatgacaggcccatttgaatgatgcttggtgaaagaatgcaagaaaccacttgctcaataacattggacttaaatgagaatatagacgggcacctggatgttcattaccttgtcagtgtaccagataccctgatatccattcacttattccttcattaatttagcaaacatttttcaagtccatcctttgtgtcaagcactgtgctaagcattggggatacagtggtgcacaagatggattcagtcagtgctctaaaggaggcaaggttgtaggtgaatagatggcaataccacatgatagaaagtgtaggagcccagagcaggggcccctaacacagcctgagagatgagtaagggagttgacatctaaacgaactgaaggggtaaaggaagtggaggtgagaggcatatcctggggaggccatttaggccaaggaaacagcatgtcctccttttgttctttcatcattctttcatcagcagggcaaggatcttaacctgccctgggaattcatcaggttaagggtcaggtgtgtatggaacagctggctggcctcttctcgggaagtttatgcccattccaagctacctattgtacttgtctcctggaataggtggtgatgtagtttggatgtttgttccctccaaatctcatgttgaaatgtgatcctcagtgttggaggcgaggcctggtgggacatgtttgggccatgggagtggatctctcatgaatggctttgtggtaccccccagccccataaattagtgagttctcactctattagctacctgcaagagctggttgttgaaaggagcctggcacccctcccgtctctctggctccctctcttaccatgtgatacaccagcttcccttcaccttccaccatgagtggaaacttcctgcagtccttgccagaatcagatgctggcactacgcttcttgtacagctgcagaactgtgagccaaataaacctattttctttacaaattacccagctttgggtattcctttatagcagcacaagtcgactaagacagctggaattacatactgtttgatgtctgaaatgtcctatggaagaagaaaggataaatatccactgtgccccttatctctaagacacctgatcaccccctctggatattttaaaaatcctagatttcaaatagacttttactctaccaaaatttctgtgatccctggaagacctagccactatttttagcttgcaggacatagaaaaatagtggggggtcagatttgtaccataagccattgtttgctgatttctgatttagaattaagttgcctcaggccacagatcctttatttgcattggctttccctctgcttggaaaactctccctcaacctgtttctgttgtaggcctcttctctcagtgaatccttctttctctacagacttgcctaaactgatttttctgctgctgtatgtctctgtagtatccttgggactttcttatcaactcctacattgtttgcttaatgtttaagtctctttatacactgaagacttaatggaagaaaaatttacagttgcctattatttgaacagttcaagtcagtctcctagcccactgcctggctgagtgtagctgctcaacaagtatttgttaagtgtacatatgagtgcagtattactgtccccatttttcagatgatgaaactgaggcatagctagctgattgggaccacactaaaagctattagatagtagaatagaaataattttccagttaactacactgcttttttaaacattcaaataggatgcttagaaataggacaaagaagacaaattaaataggactttcagtaagcaaaacactaaccatgaagattatattttgctactcagtaggctgaggcggaagtacttcttgagcccaggaattcaagactagcctgggcaacatagtgagactgtctaaaaccgaaaaagattgtgtttggtttatgttctccttgctctcatggcatatgcaatataataggggaggtcagataactgcatagcaaataagtctgacagcccaagttagtaggtggcaagtaccaagaaggtttatgtggggcatgtgttgctgtggcaaggtggggtcaaagagaaagtcagaggcaagtcctaagccaagccaggggagtcacataggccacatcccttcaggattcacttctgtggacattggctagtcaatgcaaagcaaacagtaacctctagagcaggtgtgaagggacactcatgaactttttcccaggtgatatgttcctcaaactgctgcaactgcagaatgctgagagctgtccacctgtgggaatggtcagagggtcttgccaggagtggcgttctaacagatgctcaagaagttagataagggtttttctgactcatgagaaaagactctaggaacctgaaagagtttaattttcctaccagtgggtgatttgggacagtctcctaatccatcagcaagtgtttcttgaggtccttactatgtaccaagaaagtcaaatggggattctatttctgatggctgcacttttttttttcttttttgttttttattatactttaagttcttgggtacatgtgcacaacgtgcaggtttgttacgtatgtatacatgtgccatgttggtgtgctgcacccattaactcatcatttacactaggtatttctcctaatgctatccctccccgtcccacaaccccatcacaggccccggtgtgtgatgttccccaccctgtgtccaagtgttctcattgttcaattcccacctatgagtgaaaacatggcggtgtttggttttctgtccttgagatagtttgctcagaatgatggtttccagcttcatccatgtccctacaaatgacatgaactcatccgtttttatggctgcatagtattccttggtgtatatgtgccacattttcttaatccagtctatcattgttggacatttggcttggttccaagtctttgctattgtgaatagtgctgcagtaaacatatgtgtgcatgtgtctttatgatagcatgatttataatcctttggatatatacccagtaatgggatggctgggtcaaatggtgtttctagttctagatccttgaggaatcgccacactgattcccacaatggttgaaccagtttacagttccaccaacagtgtaaaagtgttcctatttctccacatcctctccagcacctgttgtttcctgactttttaatgatcaccattctaactggtgtaagctggtatctcactgtagttttgatttgcatttctctgaggaccagtgatgatgagcattttttcatgtgtctgttggctgcataaatgtcttcttttgagaagagtctgttcatatccttcgcccactttttgatggggttgtttgttttattcttgtaaatttgtttaagttctttgtagattctgcatattaaccctttttcaaatgggtagattgcaaacattttctcccattctgttggttgcctattcactctgatggtagtttcttttgctgtgcagaagctctttagtttaattagatcccatttgtcaattttggcttgtgttgccattgcttttggtgttttagacatgaagtccttgcccatgcctatgtcctgaatggtaatgcctaggttttcttctagggtttttatggtttttaggtctgacatttaagtctttaatccatcttgaattaatttttgtataaggtgtaaggaagggatccagtttcagctttctacctgtggctagccagttttcccagaaccatttattaaatagggaatcatttccccatttcttgtttttgtcaggtttttcaaggatcagatgtttgtagacgtgtggtattatttctgagggctctgttctgttccattggtctatatctctgttttggtaccagtaccatgctgttttgcttactgtagccttgtagtatatggcagggcatagctgaacaaaaggcggcagaaacttctgcagactttaacgtccctgtctgacagctttgaagagagcagtggttctccaagcacagagtttgagatcagagaagagacagactgcctcctcaagtgggtccttgacccccgagtagcctaactgagagacacctcccagtaggtgcccctcagagacaaagctaccagaggaaggatcgtgttctgcagtatttgctgttctgcagcctccgctggtgatacctaggcaaacagggtctggagtggacctccagcaaactccaacagacctacagctgagggtcctgactgttagaaggaaaactaacaaacagaaaggaatagcattaacatcaacaaaaagtacatccacaccaaaaccccatctgtaggtcaccatcatcaaagaccaaaggtagataaaaccacagagatggggagaaaccagagcagaaaagctgaaaattctaaaaaccgagcacctcttctcatccaaaggattgcagctcctcaccagcaatggaacagagctgcacggagaatgaccttgacgagttgacagaagtaggcttcagaagatcggtaataacaaacttctccgagctaaaggaggatgttcgaactcatcgccaggaagctaaaaaccttgaaaaaaggttagacaaatggctaactagaataaacagcatagagaagaccttaaatgacctgatggagttgaaaactatggcacgagaactatttgatgcatgcacaagcttcagtagctgattcgattaagtggaagaaagggtatcagtgattgaagatcaaatgaatgaaatgaagtgagaagagaagtttagagaaaaaagagtaaaacgaaacaaacaaagcctccaagaaatatgggactatcgaaaataccaaatctacgtttgattggtgtacctgaaagtgacggggagaatggaacgaagttggaaaacactcttcaggatattatccaagagaacttccccaacctagcaaggcaggccaacattcaaattcaggaaatacaaagatactcttcaagaagagcaaccccaagacacataactgtcagcttcaccaaggttgaaatgaaggaaaaaatgttaagggcagccagagagaaaggttgggttacccacaaagggaagcccatcagactaacagcgggtctctcagcagaaactctcaagacagaagagagtgggggccaatattcaacattcttaaagaaaagaattttcaacccagaatttcatatccagccaaactaagtttcataagtgatggagaaataaaatcctttacagacaagcaaatgctgagagattttgtcaccaccaggcctgccttacaagagctcctgaaggaagcactaaacatggaaaggaacaaccagtaccagccactgcaaaaacatgccgaattgtaaagaccattgaagctaggaagaaactgcatcaactaacgagcaaaataagcagctaacatcaaaatgacaggatcaaattcacacataacaatattaaccttaaatgtaaatgggctaaatgccccaattaaaagacacagactggcaaattggataaagaatcaagactcatcagtgtgctgtattcaggagacccatttcatgtgcagagacacacataggctcaaaataaaaggatggaggaagatctaccaagcaaatggaaaacaaaaaaaagcaggggttgcaattctagtctctgataaaacagactttaaaccaacaaagatcaaaagagacaaagaaggccattacataatagtaaagggatcaattcaacaagaagagctaactatcctaaatatatatgcacccaatataggagcacccagattcataaagcaagtccttagagacttacaaagagacttagactcccacacaataataatgggagactttaacaccccactgtcaacattagacacatcacagagacagaagattaacaagaatatccaggacgtgaactcagctctgcaccaaccagacctaatagacagctatagaactctccaccccaaatcaacagaatatacattgttctcagcaccacatcacatttattccaaaattgaccacatagttagaagtaaagcactcctcagcaaatgtaaaagaacacaaataataacaaactgtctctcagatcctagtgcaatcaaattagaactcagaattaagaaactcactcaaaaccgcacaactacgtggaatctgaacaacctgctcctgaatgactcctgggtacataacgaaatgaaggcagaaataaagatgtgcttcgaaccagtgagaacaaggacacaacatgccagaatctctgggacacatttaaaacagtgtgtagagggaaatttagagcactaaatgcccacaagagaaagcaggaaagatctaaaatcgacaccctaacatcacaattaaaagagctagagaagcaagagcaaacacatttaaaagctagcagaaggcaagaaattactaagatcagagcagaactgaaggagatagagacacaaaaatcctttcaaaaaatcagtgaatccaggagctgggtttttgaaaagatcaacaaaacggatagatcactagcaagactaataaagaggaaaagagagaagaatcaaatagtcgcaataaaaaatgataaaggggatatcaccaccgatcccacagaaatacaaactaccatcagagaatactataaacacctctacacaaataaactagaaaatctagaagaaatggataaattcctggacacatacaccctcccaagactaaaccaggaagaagttgaatccttgaatagaccaataacaggctctgaaattgaggcactaattaatagcctaccaactaaaaaaagtccaggaccagacggattcacagctgaattctaccagaggtacatggaggagctgataccattccttctgaaactattccaatcaatagaaaaagaaggaatcctccctaactctttttatgaggccagcataatcctgataccaaagcctggcagagacacaacaaagagaatttaaaccaatatccctgatgaacatcgatgcaaaaatcctcaataaaatcctggcaaactgaatccagcagcacatcaaaaagctcatccaccacaatcaagttggcttcatccctgggatgcaaggctggttcaacatacccaaatcaataaacgtagtccatcatataaacagaaccaaagacaaaaaccacatgattatctcaatcgatgcagaaaaggcctttgacaaaattcaacagcccttcctgctaaaaactctcaataaactaggtatcaatgggacgtatctcaaaataataagagctatttatgacaaacccacagccaatatcatactgaatgggcaaaaactggaagcattccctttgaaaactggcacaaggcagggaggccttctctcaccactcctattcaacatagtgttggaagttctggccagggcaatcaggcaggagaaagaaataaagcatattcagttaggaaaagaggaagtcaaattgtccctgtttgcagatgacatgattggatatttagaaaaccccatcgtctcagcacaaaatctccttaagctgataagcaacttcagcaaagtctcagaatacaaaatcaatgtgcaaacatcacaagcattcttatacacacacaagcattcttataacagacagagagccaaatcatgagtgaactcctattcacaattgcttcaaagagaataaaatacctaggaatcctatttacaagggatgtgaaggacctcttcaaggagaactacaaacccctgctcaatgaaataaaagaagacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactaaagttcgtatggaaccaaaaaagagcctgcattgccaagacaatcctaagccaaaagaacaaagctggaggcatcacgctacctggcttctgatgtctgaacttttaactcccatctgctttcttcatcttgatttgcacatatgtctgatttggagatgaaaagtaaatatattcctgtgtctcttcattcttcatccatcttttcacaaaatgcacccagcagctgtgccaagcttctctgaataccatgaaatcatttatatgttttgatactgtgtcatggatatattaattgtttcttctcactacaacatggtctaattagcttggacaatacttccagtctcctgtttgaagagactgtgtgtggcttttgatgatttctctaattctgatttgataggttagatgtgggctgatctttctctcgctcttttttccttttcctttcttctcttctttccccgtaggcatatactaatgtcctaacgtgtactgaatcttgattacagtgtaattgatttagagcatatggggacttttgaaatcccttttaggagggatcattgactcttgataatctgacgaaagctatgaacacttcttccagaaatgtgtacttttacatatataatttatcatccagttacaggagtctcaagggtttagccaagtcttggatgcatgtccatagtatgtgaagaccacagaatttcagtgcttggacaaccctacagatcatcgaattcactggtttttgaaaactattttaaccagagaatccctggttgaaaagggtgggtaaaaagaagggagagactgagtcatgcacacccctacgtcgctcagagtggttcctgaggaggttctgaggaacacagtttgaaagctcatgatctaggtctaattcctgtatttctttatatgagaaaattgatccaaaaagagcagagttgactaactcaaggccatgcatccagtcagtgcacagctgagactggaacccatgcccttgatccctaggacagagtctcagccaaccctcacttctcttctaattgtaaacctcctacattcataccacagtaacttctcaaagatcctggacaaatgtaatttaaacccacaattataaataatcacccccatttgagcaacaggcaaaggaaatacagctgatttgtgttttgtcactccgtcaaggccttccttctttctgtcttatttctgctggttctcgtgtctttgtgaactgtttccattttacaacatgtattttattcaaatatacatcatagtcaaaagcatcctctttttcctcgacaaagtgccatcctgttggcctcccacagacacactctctgcccctaattcttaaagaagcagtatctggtgctcgccctggtatggtgcttgtttggcttcaggccactggcaaaacgacctaagctattattgggcttgtctccatcccagtcttccaaccttctttgtaattgtcaagaaacccaactgagcctcagctgaagtatctacctgttattgacctgactatgggcgagccaagcctagtctttcctggtctctctttcttgtgtattggtgcaggatgaggacattgcttcagagtaccaaagtggagaggaagaaacaaaccaacaaactcaagaaagtagaaaggcagtgcacagacccctttcttagggttagaggcaaggtggtctttagacttcctgagttgaagactgatgtttctttgggtggaatttctctgtgctacctcagaaacaaagatagttcatctgacaaaccagagacctacttagagataacttcagcctatccagggaactaaaaactaattaaaaattgccaggccagagtttcaaaccaggagagtggtgtggtgttgtggttaagagcacacactttgtatcctgtcggacatgaatttgaatcatggctctgccacttactacctgtgtaaccttggtcgagttaacttattcttgttgggcctccatgctttcatcaatcaaattggagaaaataatacccacattaggagagtcttttgaggactaaaagagagactaccaaacgtttgctattttgcctatcttcatcaggaccccacagaagactctgtattctgaatgttgtattcaccaccaattatctgtatccctgttgaacggagggaacacaggaaacatggcagggaatgggttaaggagcattggtttagccgataactgttgtgtgaaacatgatttagttccctcccgtctctatggactaattttccccactaggcaatgaagagtttgtgcttgagcacgtgttctttatgctgactcaggacctgagtgtgtcaaaattatcttaaaagttattttttaagtgtagatgtgcagttgcaattcccagacagtctgattgaggagatctaggggatagtcacaggatctatactatatgtccagtcgcccaggtgattctgatcagcagtcaagtgtgggaaccactgatgcagggagttgtaaagattctccctttcctccctgctttcagtcttggaacttcttatagtttgaaagtgtctttccattaatgaggcctatgacttcctacatcattcaaacatggtgattttcacacagagaaaataagaaaacgttgctagtggtcctcaaagacggtatttttccccacagaaaattcattttgttttgctttagtggcttgatatcagatccacaaggcatgtaatacagaatagggtgaacgttgagggatctgcttttaattagtttccccagctgatctctcagatcattttaaaaaatgcattctctctattttatgattgaattctaagtaatgaagtttagcaatatatgtaataaagtagaattatctcacaatagatcacaataatagatactgagtaacttctcagtgtcagttgctacctatatttccataatccttatgacaatatttgaaacaggcattaatattttccctaattttaaaacaaagaagataaaacttaaagagataaagtgacttacctaaggccacacaactggtaagggatttttttagtgttgaacagggatgaaaatggtatttaaaaaatgcaacttgaatcactttctgtcttaaaaattttcagtgacttattcattatgcttaaaaaattatctaaacaactttgtgtgggcagtaatacttgtccgttttggtcagtgctgtatcctcagcaataagaacagcgtttgtcatacaacagagactcagtaaataaatattcatggaataaattaagtgatgaagcctggattcaacccaagtctgtttgattttaaagcttgctcttcagtaatttgtatgctctctcctctctctctctctctctctctctctcgttaaatttacatactatgaaatgcaccaatatttggtgtaaaattttatgaactttgacaaatgtttataactgtataacacacatcacatccctaacaagataaagatatttccttcatcctagaaagtttctctttgtttctttaagtcaactgcctcaccctttccagagacaaaggcttttctatgtttatttattttttttttaccacatgttggttagttttgtcttttttagaatttcatataagtggaattatatactatgaactcctttgtatctagctgtttttcattcagatggtgatttaagatctgtccatagtgttatgtgtatcagtggtttctttttattgctaagtagtgttgcaatgtatgaatatatcataatttgcttatcattctactgttgatgggcatgtgaattgttttcagtttttggctattatatataaagttgccgtggttgtttgttttcaggtatttttgcagacagatgttttctttttttattattattatactttaagttttagggtacatgtgcacaacgtgcaggattgttacatatgtatacatgtgccagtggtatgctgcacccatcaactcgtcatttaacattaggtatatctcctaatgctatccctcccccctccacccaccccaccacaggccccggggtgtgatgttccctgccctgtgtccaagtgttctcattgttcaattcccacctatgggtcagaacaggcggtgtttggttttctgtccttgcgatagtttgctcagaatgatgatttccagcttcatccatgtccctgcacaggacatgaactcatccctttttatggctgcatagtattccatggtgtctatgtgccacattttcttaatccagtctatcattgttggacatttgggttggttccaagtctttgctattgtgaatagtgccgcaataaacatacgtgtgcatgtgtctttatagcagcatgatttataatcctttgggtatataccccgtaatgggattgctgagtcaaatggtatttctagttctagatccctgaggaatcaccacaatgacttccacaatggttgaactagttgacagtcccaccaatagtgtaaaagtgttcctatttctccacgtcctctccagcacctgttgtttcctgactttttaatgatcaccattctaactggtgtgaggtggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgtttatgttcaatgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttgtgttgccattgcttttggtgttttagacatgaagtccttgcccatgcctatgtcctgaatggtattgcctaggttttcttctagagtttttatagtttcaggtctaacatttaagtctttaatccatcttgaattaatttttgtataaggtgtaaggaagggatccagtttcagctttctatatatgctagccagttttcccagcaccatttattaaatagggaatcatttccccatttcttgtttttgtcaggtttgtcaaagatcagatggttgtagatatgtggcattatttctgagggctctgttctgctccgttggtgtatatctctgttttggtaccagtaccatgctgttttggttgctgtagccctgtagtatagtttgaagtcaggtagcatgatgcctctagctttgttcttttggcttaggattgacttggcaatgcgggctcttttttggttccatatggactttaaagtagttttttccaattctgtgaagaaagtcattggtagcttgatgggggttgcattgaatctataaattaccttgggcagtatggccattttcacaatattgattcttcctacctatgagcatggaatgttcttccatttgtttgtatcctcttttatttcattgagcagtggtttgtcatttctcttgtttatttacctagatgtggatttcctgggtgataatggaaaaagtatgtttaccatttcaaggaactacaaagcatatttctaaacaggctatacctaacagggtactagcaatatatgagagttgtgtatgcaccacatctttgccagccttgatatatgtagttttttaaattttagccattctagcgggtatgttgctgtattattgtggttttaatgtgtatttcctgatatttccatggtaagtattgtttcatgtcctattggccactcatatatcttgctttgtgaagcatctgttcaagtcttttacctattttttaaattgggttgtttgtattcttattgtatcataggagttatgaatataagttctttgtctggtatattttttttgaatattttttcctgactgtggcttacttaatctttttctgttcttttgatgtacagaatatttcaattttgatgatgcctaatttatcaatgttttattgtttatactatatcctgtctaagaaatatttgccaactccaaggtcatgaagatattcttctttgttttcttcgagagcctacattttaacgactacagcatgcatctggctttgccttacttgttatagaggatgcattagtccatgagataattgttatcagagtaagctgatgggaggcggagtactatagaattcaacaagacagctttgaagttcaacagatctttgttcaatttctgactccagtcccagcagcgtgaccttaggcaagtcacttgatctttctgtgtatcaattctctcatttgtgtaaaggagataataacaccaacttatgtcacaggatcattattaaataagcaagtatatgatcacttcttaacacagggcatagcacatagtaagccctcaacgagtggtgtctgttgtacttacaatacttttcattcatattataccagtttcaccaagagtttttagtgccagaagcaaatataggaagggttaccttttcttcccctactagacttcaaacagaaccattgaaatagagatgacccattaagaaggggtaggctatagttacaaacagttctttctgtatgtctaaaatcgcatctttattattttgagtaatactaataactgaatctccaagcacagacatgacagatatgattataaaactccctggcataaaggacaattttatcattgaaaactgaaattatatgaaggaatacatgtaatgcttttccagaaacacaatgtgctcattaaatgtgggtaaatgcagatgttgaagaggtttttaagtcagtgtacagtgaaaagagcagggactttgacataaaacaaacatagaacttgaatacaaggacatatgacttgattgctgtgaggctcactcctatcatctatcgaaagaggtttacataaatattggagaatatgagtgcttcaaagaatatgaacgcactagctaacatcataggcactcaaaatggtacttattggttaacctcatatttgtaatgacatatatgtaatagtaaactaaagtgagatatccaatttcaaatgagttacatccttaaaaaggtgaaagatagttttgtgggtttattttttgatagatttctcttctgtgttcaggaatggtactcacagaatatatctgtttgatatgtgaggtcattttgcagctcactcattgattcaatgcatttctgaatcatagaggaggatccctggctatttgtcatgtctgaatgatggaaacacatatttgaatgattctagtaatagagaagaatgtggaacttgctccatacatttccatttttaacatccttctgttgtaggggatggggagggagaggattgtgtatgtaagttgttttctgctaatgctaccactgctgttttcagagtcaatacatggacagaagcacaaaaaactgagtattccttttgccttatgcatcaaagtctctaaccaagtgtttagaactacatctactggtgttctcccaatgcaaattattctaggccctttgtgctctggtctcaacctgattatatacccttacctcttttcttgccacagcaaaccatttactatttttcaaataattccaatgttttactgtttctgcctctttattcatgctgttccatttattctgttatcttgagaagcctttcctcccatatctgtctgctaaacatatatccatctttactgagttgaagtgattccccctaaattcacatccgcttggaacaccagcatgtgatcttatttggaaatagggtctttgcagatgtaattagttaacatgagaacatactgtattagaatgggctgtaatccaatgactggattatataagacttataagaagtcacgtgaaataacagagacacgggcacacaggtgagaaggccatgtagtgatggaggcagagattgaagtgatgcagcaacaagccaagaacaccaaggattgttggcaaccaccagaagctaagaagaggcaaggaaggattcttctctagagccttcagaggaagaatggccaaaacaacagcttgattttaaatgtctagcctactgtactgtaagagaacaaatttctgttgttttatgttacccagtttctggtaatttgttatggcagccttaggaatgttttttacatccttcttcaaggtcaagctcaaatataatgtcttttccagatttcttcaactagatgtaatttctcttcttcacctctgtagcaatgctgtagcagaaaaaaagatcacaaactttggtgccagagaatttttggctgtaatcctggcccagctactgactggatttcttcacctgtacaatggaaataataatacctacctaatagagttgttgtgtcaataaatatgactgttccttacctctctaattcacccattctgcctcagattgcaataattttgtaataagacaatatagttctgtttttttccagttcagaggctggagggagcatagataggtaagcaatcagctttgtacacaataaaacaaaatgtgctatctaacaagggtagagacaagtattgttcacattgacagtctcaggaattcagttgtctacactaggagttccaactataagctaggaaactgatttataaaattgaaatggagaagcctccttttagtccctgaattccagaattgtaatatccaaggtagattttgtcttaatgcctaaaaatggagcaaaaattctggaaatgttagagccctctactgatttcacagctcctgtatatgacactggaacatgcttatacttggctgcacattttgataaagccaaaagttcaccacatggcattctggtctctcttcctctagggcatcttcccaaaggcctcagctctagaggaaatctgttttttcactcttgcagcctacactgcctggccaaaagtagggatttagcatgtgctctttatccttcctgagttttctttgtctgaatccccaggctctatgcccaccaatctttttaaaaaaggtcaacaagtaacatcatccccttatgttcatcatcttcttttccaggcatatcatcagaatcatctgagaccctttttatcaaagcatactggagggtttataggtgttgacctctaccctggataacgtggggaaggtagtaagcacaacacacctgccccttctgtgtgggtaagcccttgtattagtttgcatgggctgacataacaaaaatacaacagactggatggctgaaacaacagaaatatattacctcacagttcttgatgctagaaatctgagatcaagttgttggcagagttggcttctttttgaggcccctttccttggcttgtagatggccggcttgacttcttcctttgtcttcacatggtctttcctctgtgcacatatttatctgtttccaaatttcttcttttaaggacaggagtgagaatggattagggccccacccacatatggcctcattttactgaaattactgtaatttaaaggcctatctccaaatacagtcaccctccgaggtactggggtttagaacttgaacataagaactttgggtagtgacagttcagccccgtagttttgtgattaggatcaaattattttgcaatcacttggtgatggatttgtttgttatttggtcttgggctctgatagctgagacgttagcctcgtagtatacacagagaaattaactcaagcacaattcacaggtcttcctcatgacaggagaggcaaaagaatcatggaagtcaccacttggtaaacacctaccatgtgacaggcatggtaataggattttttattttttcttcacaatcagttagcaaaaataaatatttacacccccattttcatatgagaaaattaagattcagaggggctaaagtgatttgctcaaaggcataaaactagtaagtattggagttaagaattgaatataaatctgtctgactataaattcatgccctttcctcatgcatcctttatctggaattgaaaaaaaagtttttttttgctcattttaagctgtgacattaaaatgaaaaaacaattatatgaaagagtttctagatgttcacagtcatcgtttattcatatgtccatttatcatatactcatactggactagcattgcttcactttgtttttgagcttgccatggaaacttaaacaactgaagaatcaggaaatgatgacagcaaagtgattaattatacattgaaaaaacaatttgggggatgatggtgcagagagcccttttagccacactggcgtaatgaagtagtttagatttgtcctgtggcctctgcaatcgacctcttgtttgttttgttacaacaaattgctttacagtactgaaatggtctatttatgttcattgtttcttttgcagttttgttcccaaactttggaagttgttggagactgacagaagagccaggaacatcccagttttctgaacattttctatgattgtgacacattttaggatgctctttctacctagtgaatggtgcagtttgtaaggatagattatttgctgagaaagtgggtattgggtcctgtgacagaggaaatatatttcagagtattggagggccatttaaaaatgatgatggtgttgataatagcaatgcttcctgctgttgcatcatttagagtttacatggatcttctatatctcacttgattttcacaaaaacatattgaagtgatcagtcagggattgttatatccactttccatatgcaataattgagattcaaagaggttaaatggaggcaggacaaactcccacatctttgatcaccaacaactcccttgctaaattattctttgtaagtccagtacactgagttcattcactttaaattggtgcacattttgtcctcctggaaaaacattatgtcgaattgggaccattaataattgcttactagtttcaaatgtccagtgggatgtcaattgagatccagcggctcttttctccccagcctctttaagagaacacacagtgaattcaatgcgcagtgctttcctcctgctgcttgtacttcctaacaaagagcccccatttattggaaatcaatcatgtgctagatactggctatgtgttatttctaattgtcacaattgataactctgcaagagaggtattatcatacctaccttacaaatagggaaactgaggcttggagctgttaggtaactttcttaacatcacagagatggtgagtggcagagccagaacttcagcttatccagtctggcttcagaccattgctttaaaccaccataactctttaaattcagtacattgactttttaactgagttatttggaagttacagcttggaggaatccattccttaggaaataggttgacaaaaaaaatcataaagttaaaaaaatgcaaaaaactaaaaaaactaaattgttaatttatctatatcatctaatttggtaatagttttctacagttgattggaaagcttgtggtataagacaagcttctctgagggtaacctacagtcactgtaagtgcacagaggatgccttctttgctcatttctaatacaaaactatttctgttctcctatgtctctaatccactgaatcgtttttccatgtacctattctttttagttcatgcatagtcacttaattgaacacatactcaccaagataattaacaattattggctacttccctgacaaagggttaattcgttctgttggcaacccctgttaatactaaaaagccctggggcagtagatcctttcttctaggaatgacccccccactgttcattggagcaggcaggagtgccgaactaaccagtcctgctatctgtttcatctgtcgagtagacatttgactacctttttttgttgctgcctgtgactcaccctcattactcaagattgtggaggacagcaactgtgcttgaggagtagaggagcagtcctaagataaatcatcttaatgatttcccatgcgtttaggacttagaactttgcaccacaaggggataaatgcatgtcgcacgtagtcttcatagcaatgaagaataccattttggtttataaagatgtaggaaacaaaaattcaagccctccattatactacatgtctatcatgggatcctgcagattctaattatagtatctaccttttactaggctgctccttgtagttgcactttgacctcctcctagtgtagactgcttttatatgctcgacacctcacctcactccttctaccaccaagaagaacagagtccttagagcaatggtgaccaacagcttttgtggaaggtcaaactggtaaaaagaaaactgtatgagacaaatagtggacactcaatacataagtttagagagaaggaaggaaggatgggtagcttattattcaaattttatatcatcttttttctaaatagaaaaataccagtgagagaattgccacttctgtttagcaactaaaaaaaatttaatatctagtcatatttgagaaatggcaatacagaacctgctttttaatctttcagcctgaaattagcctgcctggttgtaagatgcatcctatgatctattggctgctcaagagtgctttagaggattttcgaacttgaggggcccttagaaatgatctagtctagtgattccaaaagttttcattatctaaggcatctttaattaattttcccctgcatactgtgttttgaaatatcaggcctactaaacaaattacctttatcacataataattccttctctcattttttttttctttttttttgctcagagccattaatgatctctcagtagagaatctggtcagcatgaaataaccagtgtaaccacaataagatgatataattccttcccaaagtgaaggcagtagatggttgagttggtctagggtcagcttgatcttagcaatctttacaaaccatctcccttaggcttattgaaatgttaaaaatagctcatggattcccatgatgaccttcttataatctttgtggacagccatttatcttatccttctgtagggaagaatggaggggaatcagatttaaaaagcaaagtgattggcccaaggtcacacagcaccttaatggcaaggaggaccagaatttgtgtttcctgagtctcaatcttctttctctacacacccaattttcatgtgccttaggtctaagagcttaatattgtataggcattccataaatctttgctcgatgagttggtagaacaggggcactaatacttaagtataggagatacaaaaaaaatccatgatgaattcattaaacaaccagtaaaatagtacaaatatccagttcccagttctgaattcgtacccagcctcctttgctttccttttcatgaatgatttcagacatctccctatagcgtatttcagctgctgttgctcttgaaaaggtttactcaggaagtcaaatagtgtccacttatcctgttataccctgtctccgagaggtgaaaatagcatggaattattctcagcagtgaaattcaccctcctcttttgctttcatcccctttacagtggtgatccttgctaaaatgatgagaatttgaatacctctactccaggatagttcattctcagtccttctagatgaagatccacttagctattcaatttttcttcctttctattactgttcaaatgtcctataattatccatgtggggcacattttagtgaatgacatttagtgaatgacatttttgacagacaggatacctacttccaagtaggtcagatattagagcttcagcagtgcatgctttatgtgattttcataggaattcatatttgggagctcctagctagctcatattctctcagtgaaatgttgaaatatgggctcaattgcagggctttagttgccgtgtactgtcctacatgcagggtgcacttcacatcaaccagaatgagttctgcatagcctgcaagactaaatgttgagttactacacattggacactggatctcacaaggggcctctgcaaaccctcatcacagaccatgggcagtgggagtgagccagtgatattctcaggcacagccctggggcccacccactgtgatgcccaggagaggaacagattgcccagtccctgatcaacagtccccttccatatttcccatggtacaaaaaagtatatatatatgcacagtatttcattctgatgaagagtttatagtcaatgtgagacaacaggtgggtttttggggggattttagtggagttgatataaattacatgagcaaagtagaatcttggatagtctaatgctttcagaaactatttgtcaggcccaaataaaatttttcggtcttgtaaatggcctagagcaatctctaagatgagaagttatgtgttaaatggcaaaacaaacaaacaaacaaaaaaaacaacaagatacttgaagaacacagtatacaaggagtcggcataatgagaatttccccagttgtatttttcttgtaatattgacgttgtttttccccctgttgtgaactaaagagatagaaaatacctttgtgtctagttgaaaatggattcttaattaactgtccagagatttgttgttagaggtaaaattctgggaagggttctttgtatggacaggaagaattagctctgtagcaagcataaaaagggcccatttcttcctaatggcttttccaaggaagtggggaaggagagaaaaaccgaaaaggacattctcttattgctcaaatgaccagatttcttggacccagaactgtagctcatacacagctaacctagggtcaaggtttgtaggctgcctctaaggcatccctttctttgccaaattgttatgcagatgtgatgtgttaaaaacacactccagccctggttgtttggagggcatctttcctaatggaggtgatacaatgtgcttattgagtcagcaggcactttgttccagagtagacagtaatgcaggagtaggaacataagatatggaggctaagttctgtcatttattatgtatatgacctggggcaaatggttcaccctcagcctctgtttgcttacctaagacatggggagaataataataccaacttccaaggcttgttgtatggatcaaatgagataatccatggaaaacccatctccccatgcgagacatatccttacatagtggctcaataaaagatagatgagcacgacagcattttgtaggacaaggaaaggctgggactatagactctgtttatttgaaaataatgccaatgagaggtctttttctcttgggccagtaagtctcactcagggaagaattctgacacaagtacatagactgcacatttaagctctatctggtgctcttccagattatggccttggttttgaggaactccaggaataaggggacttgatcatagacacactagtggagagggagcatcaggtgcctgtagatcagcagaaatgctacttttttttcagaggaatgagatgccatacatacaacctaatctggcttcaaatttcagaagcagggactttccacttaaatatcatcccatgaggtttgaggactttctttctgtgtaagactgaggattttgaaaggaatagccttgaatctgcaaattgcttagaacagtgtggccattttaataatattgattcttcctatccatgagcatggaatgttttccatttgtttgtgtcatctctgatttcttttagcagtgttttgtaattctggtagaaatctttcacctccctggctagctgcattcctgggtattttgttctttttgtggcaattgtgaatgagattgcattggctctcagcttggacatcgttggtgtataggaatgctactgatttttgtgcattgattttgcatcctgaaagtttgctaaagttgtttatcagatcaaggtgcttttaggcagaaactgtggggttttataggtatagaatcatattgtctgcaaacaggaatagtctgacttcctctcttcctatttggatgtcttttatttctttctcttccctgattgctctggccggaacttctagtactatgttgaataggagtggtgagagagtgcatcctttcttgtctggttttcaagaggaatgcttccagcttttgcccattcagtgggatgtgggctgtgggtttgtcatagatggttctcattatttggaggtatgttccttcaatgcctagtttattgagggtttttaacatgaagagatgttaaattttattgaaggccttctctgcatgcgttgagataaaacaatgacattattcacaattacaactcctttaaaattcataggaaatcaaaaaagtgcccaaatagtcatggcaatcctgagcaaaaaggacaaagctggaggcatgacgttacccgactttatactacaaggctacagtaagcaaaccaacatgatactggtacaaaaacagacacatagaccaatggaacagaatagagggcccagaaataataccacaaagctataatcatctgatcttcaacaaagccaacaaaaacaagcaataaggaaaggactccctgttcaataaatggtgctgggataactggctagccacagggagaagattgaaacttgaccccttccttacaccatatacaaaaatcatctcaagatggattaaagacttaaatgtaaaacctaaaactataaaaaccctggaggaaaacctaggaaataccattcaggacatagacacaggcaaagatttcatgacgaacaccccaaaagcaattgcaacaaaaacaaaaactgacaaatgagacatcattaaactaaagagcttctgcacagcaaaagaaactatcaacaaagtaaacagacaatcaacagagtgggagaaattatttgcaaactatgcatctgacaaaggtttaatatccagaatctataagtaacttaaacaaatttacaagaaaaacaaaatgaccccattagaaactaggcagaggacatgaacagttttgaaaaggacacttttcaaaagaagacataaatgtggccaataaggatataaaaaaaagctcaccatcactaatcattagagaaatgcaaatcaaaaccacaataacgtagcatctcacactagtaagaatggccattattaaaaagtaaaaaaataacagatcctggtgaggttgcagagaaaagggaatgcttatacaattctggtaggagtgtaaattagttcagctgttgtggaaagcagtatggcgatgtctcaaagaacttaaaacagaattaccatttgacccagcaattccattgttgggtatatacccaaaagaatataatttgttttaccataaagacacacgcatgtgtatgtttattgcatcagtattcacaagagcaaagacatggaatcaacctaaatgcccatcagtggtagactggataaagaaaatgtggtagatatacaccacagaatactatgtagtcataaaaaagaatgaggtcatgttctttgcagcaacatggatgaagctagagaccattatccttagcagactaatgcaggaacagaaaaataataacgtatgttctcacttataagtgggagctaaacaatgagagcacatggacacagacaggggaataacagtcaccggagcctacctgagggtgggggttgggaggagggagaggataaaaaaatacctatcaggtacttgcttattacctggatgactaaataatttgtacaccaaaccctcccgacacacagtttacctgtataatgatcctgcagatgtacactcctaaacctaaaataaaagttaaaataaataaactctaacatatgaaaattaaatttaaaaagctgaggatttgcaattcatggaatatgaagcaatatttgtgttgtcttagttttagcttatgaatacagggagaaatcatttgacttagggcttgttctgggtcagttgatctttggccttgtttccataaataaacccttactagcagctttggcaatgccagcaggaggccagactatgcctggtttcactatgtcctggcactatctcaaccaagagtgaaaatcttgggacaaatcaagtttcagattttgttgttgttgttttaggaaatggctttaaataccaatttctattctccaagtactttaaaagcaaagtaaaattaacattacatttaaagccaaccacctcaacatggcaaatgcctctcaacgcctaatggactctttccttgggctaaatggacaagttccttagcagagcttgtctaacccttgccttgcattgcaccccagtcccgcacaagaagctgagtagaaaaaactgcattgtgctctgcatgagaaacgtacctaagcatctaggtttagggcctagtttgtaattagacagtttcttggaagtacatcaagctcagcctcaaatcagaacatctcttggggagcaatctgtatttagatgtttcatttaaaaattcatcattgaataacaaaatattttgttgcaactcctacttgatgcattccaaattctctctgtcttttaattacaattatgttattaataatggatggaatgggtgggggcatgggtgagactatgccaggggctaagtagcaaacagagggtagcataagcagttaagtcatagttctttggggcggcagaatcccgtgaatcccaggccaagagctcgccactctggcttccttttatatatgcctgttatctacatcctacaactgctctgatttggccaggagaaatgttttttcaagtagtaggcaaggaatgaagttctaaaggtatttggcaggcagactaagtttcccccaaaagctggaagaaggacttactctttgtgtctatactgacagcctctacttttcccattatcttttcatgctatttcagccatccctccattgagactgctcttgtcaagatcaccagtgaactcctgtgtcacccaatcagtcttctcttttcacatccgtttggtctcctagcaccatccatctgttgactgctgttgggtgtggtgtagtccagggcaggaggagaagagggagaaaatgttatcacaaattctattctgaactacactatgtttagtaatatgcctatgttgtcaccctcatcctcatttatgttctccttgttcttcttcctcaatggccactccttctcagtctctttaattggcttcttcccacttaccattctctaaatggtagtttccttaagatttgcctctgggctttcttgccttcatctacatcctgctccagtgagattatctactccccatgctttaatctttatgcagttgacgtctatatttctatctccaatcctaatccttttagccacatgtattgtgctaaatcttctctctaaagcagaatactaaagggcagtcaactgattaatagccttctctttttctttttggccttcgattttttgtttctaaattgttcacctagagttactctttccacaaatattaaaagataatctatactgtgtcagacacagtgctagctgcagtatagactggggattaggaagttacaggtactgggatataggattccatgtgatactagaaaaatgtgtatacattcatgcagtcatacgtacatagctacatacaaatattcattcagcaaatgctaatggagaatgccaatgtactgggtgctatgccacacactagaaataccatgaggacaagggcatagctcctgcttacatgcagctagtggtttagttaaagtcagaaggcaatcaaaaggcagcaggaagtgtcatatagagataatttgggtgcagaaatgagtacagatgagggttcatatctagcctgtgtgtatttctgtgtgtgttattataagttgtattgaaaatattgatatttgctacatccttgccatctcgccccatgatatacacaaaggaacactctctgggtctttcgttctcaacatactgtgtaactctagccctagtgagctgaatttgacttgtaagaccagaagggctcattttgtctaaactcagtctctctgggtttctactaagctctataaaggagggggtagagatggactggagagaaaagaggaaacttcttctcaagaagaaagggggtccgggcctgcttttgtcatactagctatctaagagcaccacttgagagagatggcctggcactgcagggagatattctcacaaacagatataaaagaaaaaagccaaagtcacactcatcctcatttttgtgccacatatgcccagacctttaatcccttttctcaatgaagtataatctttaccctataacattctgaccgctcccctcactgtggccttgcggtccccagtgtggagggatgagggagaatggggaaacattaatgctttccctggagaccacaatatgtaagttttcacagaaattttcccacagaaggtgtgcttccgtagaaaggaatgcataataggtgctcaattagtatttattgaatgagttaatgaattatagagtgagcaggagttagccagaacttattctggtcagccattatgatggatgtttggggtacacaggtgaatgacatcaggtccctgctgtcaaggaactcagctcccagtctgatgcaagaaactgatatgctaacaagtaattaccatttggtgttatacttattataacaatagctaatgcttagtgagcccttactatgtctaggtaatgcttcatgtgcattatctcattttatccttacaattactctacttgatatattttgttattttctactctccagatagtcacaatgaagttaaataattttctcggagtcatccaaagtgcttttgatgttggcttgggtctgggctgaagcttgggggagttttgacagccatcagtaagattactaagggagagctctttttgtggagaaagaagcatccgagggatagaggtttaggaagaagcagtagaacattgtaggctctttggtctgtgggagcacaaccagtgtagactgtggggccttcgccccaagagatgattgagccttatcaagaattttgagataattcccctttgctcaagtacaactttgggaccttggaatcacccaatatgccttgtctttgtctctgatactaaggatgcctaagtgaccctgaagaagcaatggagagatgaagtttttacaagaacttcctgatcccacagcccagccaggctgtacatttaaccactggcatttggaagcagcagggcttgtaagtgtgcctcatgcacatcaaaataaaacacataccacatagattccattttcacatttttacgacattcttgaaaagacccaactataatgatggagaacaaagcagtggttgtcagaatatagaagagggtttgtgtgacttaaaaagtatagcatgagggactttgtgggagtgattgattgcaatggaggttccacagatctacacatgtgttaaaactcatagaactatacaccaagaaaagtcaagtttactgtatgtcaattttaaaagtccaaatataaaagaaataaagcacacatcatctcgtgtgctctatttttcacctctcaggctgtacaaaatgtgagcattcaaagcctttaatgatttggcagagttggaagaagggtaataagtggggagattacttgaacttggcacctgattcttttcaagtcatgagaagctaatttatcctcccttgtaccatctctgttgttaagctactgagtgcccttatttgagaaatgccctgtgggcaaaataggatggtgcatgatcacagtccgctctccaggaaactagtgtgaagctgtgtgaaagagcattttttttttcattttttccccaaactgtggcccgcaatcctcaaacgctcagcgtcccagctttctcacagtatttgacatgactgtagttcttgtttgtacttgcagcacagagcaagcagaccttgacttccagaggccctgacccattgaaggggccgcccaacaaagtttcctgcaaagagtaaagactctgaaacttcgattctgatgctataggacaggaggaccactcatctttaccaaatcagggaggtgtccatctcccctttcactcttttcctcctcctgaaatctttggggtgccctcctgagggcagggggagaagagggagaaaattttatcacaaattctattctcactagattatgtttagtaatatgcatagtattttttttttttccaaactcctctccttactggatgtgggacctttggccagacatttaaaacttttagattcttttcacatcctggatatatggctaatgactactgccttgcttaactcccagaaggactgagtcaaatgtcaaaatgctgggtacatttgtatgaggatgaggatcaattgaataggatttatgatggactggcttgggcccctacgatttattcccattagagcatatgttttgatttccaacctactaagcaaccaaatcacagatgcagttttgcaacctacagcacatttcatctcgtttattttcaaagctgtaagcagagagccatcctccatgagcagcacacatttgaaataaaatacaagttcccatcaagatattctgacatgttagacaagatgccaaattgttactgtgcttcagacttattaggcaggattgaaaagcagtttttagcatgatggcaggtcatttctgcttgcccatgaaatggccaaaccaagcactttttagatgtgatcatatggggaagaatgttcctcctccttatcttgatcagctttttaaggagaaggcatcctcatcttcctcttggttatgggtccgcttcctccactgaactcctatggcattttgctaggaccacttttacagctgttgccacattttgcctcatggtataattgttcctctacttgccacatatctgagtagtgtaggagcccctccacagcagccaagtcttgctcagagaactttgcagagttctttgtggattgctggaatctgggatttagctcttgaaagttaaagcaaaagaggttacaccgaaattctaagtaacctatttttttcatttagaaaagtaaaattgtatctgttgattatagaagattttgaaatattggttagtaagacatagaaaattaaaatcatctgtagttttcaacttaggatactgggttcataacttaatccagtttaatgtatacagttactatggctggttctgcaaatcgaaagatgactatgacatggtcaatgccctcagtaacctcacagactggtagggaagacagatacgtgaacttagtcctgcaggcaatggggagccagtacaagttttgagctggacattgacatgatgaaaatatttctggaatttttatctaaaggcagcatggtgtggagaaagctgggcctgaagcataaagaccaattcgcataaagaccaattcggaagccaatgctaaaaggccacacattttactgtttggccttaaggtaaacacaatgttattcaaccagagtgacctccttctcaagttagttacccttgggacttccaaaagtgaaacttagagattagctttgccctcatcacatttactgagcaacaaggcactttgacagcctctcactgtttgtgtttagagtgggggacacaactttttctctctccatctgattggctgagctcccagtctacactacagaacctgagtcttaggagacagatatttaaccccaagtcatgccactgggtgtccatgttaagaaatatcttagggaatcttccacaagtctgttgctgttctcctccaaatatttttggttttcttaaaaaattagtatgcccttggtcagaaaggtatagaaccaaagatgtttgcttctgcaaacctaaggatgactatgacatggtcaatgccctcagtaacctcacagactggtagggaagacaaatacatgaacttagtcctgcaggcagtggggagccagtacaagttttgagctggacattgacatgatgaaaatatttctgaaatttttatctaaaggcagcatggtgtaaagaaagccggtgacctctcttttacagacagaacagctagtctcctggttatacttgccctaggtctcacatattaagtggcagaggtgggcctaaaatttagcgttagacaactaacactggtcctccatgaaacacaaattgcttctaggctggaggagatataggtgtctctataagccagggcctgtagagcaggggcactagccataaagaccagacaacagcccaggatggctactgatcctagcagacacagttctataatgtaaaaacaaccaagaagcaaaccaacttaaaagttaacagacacacacacacacacacacacacacacacacacacacactacactcctgacatgtttttcccctttctattttcagttggggttatctttcagtttagttctgggaaggggtttctttttttgtcgttgtggttgagacggagtccctctccggtctctgtcgcccaagctggagcgcaatggtgcgatctcagctcactgcaacctctgcacacccccaccccccgccctcccgcgccgggttcaagcgactctgccacctcagcctccagagtagctgggattacaggcgtgtgccaccaggcccggctaatttttgtatttttagtagacacgggttttcaccatgttgggcaggctggtcttaagctcctgacctcatgatccacccgcctcggcctcccaaagtgttgggattacaggcgtgagccattgcactcggctggggtttcgttttaatggctcagtaaactgtgatctggtacaaaaggatgggattaatgggctcttttgctgcaaatggtactaagctcttccagctttatactctgcaccttttatcttcgtggcgatatttaagcttttaaggacgttgctgggagtgacgactccattggatccaatctcaggaacagtaaatggccttcaactctttttaaaaaagatgcattgcaggagtgaactgctgcaaactgctgcaaactccatggaggagtgacctttaaaatggggggtggggggatagtttgctgctggcttttcattccctgtagccacctaagctgttggggaatggacatgggaaacacactagctaaagggcccatttgttacaaactgagttttggtcattttttcttatttatatacttatttgtttttatctgagcacataaatctatatttgaatgctgcaaatcaccctttgttacactcttcttagtagacacatatgtatttagggtacagctgagtacagtacatttgaggttttgcaaatgataaattctgccatctccatattcttggataaaactagaaatacacaggcttttgtatacgaacagcagaagctgatgactctattcacatatagctatgttggatatgttggaggcctggagcaatttggccacagagagttgtttttaggattggaagaacactcagcccccaaactagataatgtgacatgttctatttttaatgagtttattttcttgtttcagcttggaggtgttagttcatcgttttgattcttgacaaaaggattctgcttagactctcagctccctggtgggttggagtttcacaaaaacatctgcgctaaagcaaaggggattcatactatcctagacagtgttcacttgaaggtttcccagaagcatctgtagctggaagagtccctgtcagtctctactccctagctgtagatgggcccacagccctgctgcctagggaaaagttgacagttattaaaaaaaaaaaacagcccttttctgtcatattcacttcagtaaaggaccaagtctgctattgcaaatgggctgtatccagtgcacaggtattctggtatctcctacagcacatagtcactattgctaaacattttgggtagttagagtcagtagtcccaaagattggccataagggccaaataagattggaattctgattatggtagaaaatcctttttaatgtattataattcataagaaatagacttcagaagagaattgatttcagagctgtattcctgctcatttcttccatcctttctgttcatttttcatttcctacagacaatcaattagtaaatgtaggatacgtgtgtacctcagtgacccaagttgctagggatacatcaagtgcttcagcccatagcagccaagggaggtttggggtgtctctacagctcttgacttttcaacttcaattataaatccatttggtcaagttgtggtttgaactgtgtgtgtcccctgtgatgcacttttggtaaacagctgcagtacagaagcagctgggcttatttgttaccatctctactaagccgccatataactgcatggggacggtgatacagcaagtgaaaacgggtagagttttacagcatagggtcttagattcatgatgagaaatgacactgaacaaatgactatttttgactttaaatagaagagattaaaagactttcagatctgttctcctaggtttttgttcatacatcttcatttttgcgatttctccggatttggagtctgttttgaaggggaaagttggcccatccagaaagcaccggatcatattttccattctgtatgcattttgctatctgccttgtttatgtgaacattaaaataaataaaaccttacaatctaaactttgcttttactaaataaatgaacacagcagttattaattgaattcagtcagctttcaaatagaatcattactttattacagtataaacacagtggaaagaaatcagacaccctagcacagtgcatgttttgctaggaatttaacaaatatgttggcctcaatgtgaacaagttatatatttttttcagacttgaggcttgttaactctttcaggccacttgctgctaggcaaccaataccctgctggcttgagtccatggttttaaaaattatcagtttcctgccagactgacttgaggacttttgaaaaagtaaattttgaatgcatgctgcgctttttaggcaaatctttattaaatgtcttctctggcaaagatagtactagaaatatactgagaagtgggagaaagggtggccccttccttccaagattttataatcttttgatatcaagcacacacacacacacacacacacacacacacacacacacacacacacagctaaggcagttcacaacaatggaccagggtgaatgctgtggactgcagttgctctagagtaatacagggaaaggatgtcttatctgtggactcatgcagccaacaaaggagctgtggaaaaaatagaggagtttgaactggactaagtagaaatgggggtatattttaggcacaagggacagggattcaggatgctgtcaaagtgaggcaaatagttgttgagggcctcttatttgctaagtgctagggacagagtgaggaatgagccaggcatcatctggcctttaatggagctttttagtatgaacacaattattttcattcttttttactggctaacttatgtgcaaatttctgtaagtaagttgagaacccatttgaactgctcaaataaaaaaaggagattatattggaagagtccatgattacagcctgcccctagatcttgtggtaggattcaacaactgaaagtttgagaacccaagattacttgtttcatcatcttgggtcatataaacttttgttgctgcttcaaagaccacttcaagcttatctcttctccacactaaacacacacacacagagagacacacacacacacacacacacacacacacagagttttcctcttctgctttcacacacttgtagtcacatcagcttccactttaaaactacttcctagtttgaggatccaacagagattgacttgaattcctgtgtcctgatgccaaagtcacccagctttggtcagttgtccattcttatccaatcagtgatgcctatttgggcaagttgtatgactttgagaagagaacaagagaaataaatgattgtcatttcaagtacagtcagtcattgttgagagaaagagcaaatcccaagcaggggcttaatatctgacctgaacacatgtgtttggtaaacagtagtgagacttgtatcactgaaaaccaggctttccatggaggggcatggtgagaatgaaaactggaaagatatggtgggtctatattttaggacgtcattttaagtgtggaaaagggaagtcttcatgtctcattgatattgaggcacattctgactggctaagttgcagagaaactgtagacaaaattcttgtcatcagtgaggaggtgtgggactggagtgagcattttctaagattgtttcccagcctatagttatttggtttgaggctcctgcagattcctttctgagaggaactttgtttattactcttttgctgtagggattatgctgccctctggggattgggagattcctgggatgtgagggcacccctgggtggggtctttttctttctgagagcaccgcgataacatcttcctgcaagaggagtgtgtccctcaaaggccgaaatggaaaagattcaaaaatctctaactctcacctctctagatataatgcaatacacatatagaatatacatgccctttttcttggagaaaatttccaaaaataagatatatatttttgtgtaatgcctattgcttactttaaaatatttaaattatttaattttaaaatttataaattatgtatttattaaaatttaatatataaattaaaatatttgctcagtctggaggattcaggaaagcacacaaatttggcatattacaaagtacatgtaaccctaaacatccaaagaagatcaaattggtattttattgtattctttttcaatgttttatgcatgtatgttatacaaaataaaatgattacaatactatacatacagttttgtatccattttgtcttagtgaacatttctccatgtcattaaatattcctggtagctatatagttttactgtaatatattttaatatttactaatttaggggaatttaattgtcctaaataattattccgataaatagctttatatgtaaatatttgatcacatctttatttctttagtccagctttcaaggcttgaaattattagggaaaatgatgtgaaattttaaggtcttgttatatagttccaatttatatagacccccagtctatggtagcggctgactacctcatccttgctggtactaagtaatagcatggcttgtagtttatatcagcttggtaggtggaacgcttctccatggtaaagaccatggcattttctcctttaatggtgttcagcacatatcaggcacactatgcaagtttgttaaataaatcatagtcaaaggagaaggtggtaagatctattacgaagacatgtttttttgttctaagtctgtggggaattcaagaagaaattagtttaagcttgtgtaggaggatgcagtagagaggtgggattgagaagcgaagggccagtgaacaatgatactgttaaatgcattgaaacttcaaataagcaaatggggccaaggagagaaacttgttaaaaatgaagtgtggtctatttcatggagcacagcataggtgactgcagagtagatcatggattgtttcaatgtaaaaaccagtgggttgaaccctagagcccagttggatgggtctatggatgggtctatggagcacagttggatgggcctccgactaagtgtgaactgtgcagggagattaggttgtaacaataaaagttacagttctacattcatttattcattctttcattcatccatttaacacattgtttttgaatttggcctgtttctgtagtgacgatggagctatgaagatagtactagagctttcatttgggtggtttgttcaaatgcgttaggtcggttggtgcaaggtttgtactctggccctaaataaatcatcttggctttctaagaggtgactgaataagactcacttactctgctctggccatataggcttagttgttgtatttttgtttttgtttttctttcttgagactgagtcttgctttgtcgcccaggctggagtgcagtggcgtgatctcagctcactacaacctctgcctcccggattcaagcaattctttctgcctcagcctcccaagtagctgggattacaggagcccgccacaccacaccctactaatttttgtattttcagtagaagtggggttttgccacgttggccaggttggtcttgaactcctgatctcaagggatgtgcccacctcggcctcccaaagtgctgggattacaggtgtgagccaccgtgcccagccccttgttttaaaaatatactaggcatgctcctacattagagcctttgcactggttgtttgttcaacatggaatgggcttttcttagatgtctattggaccaaatccttcatctcattcaagtctttgcttatcgctcacaatgtcaatgaggcccacattgatcatcctatttaataccacaacctacctcccactctggcactccttgttctccttattctgctcacatttttcttttttcatcaaattataccatacttttaattatgctacataatttacttatatgttatgctgattgcatactgtctgttttctcccacttcatgaaagcaagaatctttgtttgggtcatgctgtgtcactgaaccctaaaggagtgtcttaaacacagtagtgcattattatatttttgtggaatgaataactcatcatgtgcttggcaggcaacattaaagaggatcttcagatttttcagaagagcaagggagaactcccctcacctgctgagctgttggctgtggactccagatcaaagtctgaggaaccactcacctccatttcttggcagtggagagtgagatcaacaagagagataggagaaaatcatggggagactttgagtttagagggtcctgggcagctctctcacaataacagtaaggtagggaagcatctcagagctctttatgcaaaggccctcatccaaaaatcgagaccagatttccatgaccattgctgttgctgttcttactacatctgagctcttccatgccctcttttccctttgatcagtggtgtcagaaagcagatgcatactaacatttaccaattgtaggacatgtcccacaacgaagctcattctgccttcaacaccagagcaagagggaattatgggaagaatattcaccagggtagacttttggggaagtgatgctgaagcctcagtattaaaaacttggagcagtgggggatgtggatgggctttctgaaaaagttttgaatttattagtgaacctgttactcatcccttttggggtgtgggtaatggagtggagggagagccacagctgctttgtgctgagtcatacgcttgtgtttgtactttgccttgcatagaggaatccaaggttgcttcacaatgacttggttaaaattagcactgtcagagagctccgtaaagagtcttgtgaaaagtcttccaaaataaatcaaccttcctgttggggttgagtcatccccttctttcttcaactggaaatgattttaatgggaaggtaagccagtaagatctttttggttgccgattttgaaggtatcattgtgataacacagggtggtaaggcagaaagtgtcagacagtggtagggggtcaaatgttggctgtggcgtaacttgctgtgtgaccttgcatgagtatcataacttttcagagtttcaagtgtcccaaaagtaaaaagtggggctaccaacatctgctttgccgagagacaatagatgtgtaattaagtggagcaatgtatatgaagcatacttcttggcacataaagtccctcaacaaatgggaacagaaatgatattgatcactgctttccacatattcttcaaactaacatgtctcaaagcaagcttatcactctctgccctgctgttttcattgagacctgctgctacttgaattcattgtagctctcaggaaaccatcattcacccaggcatattgatatattgatggctgatcacttctcaattaccactaccaggactttaattctgcccttcaccacttcatacatagaatattttaccaggtttttttttttttttttaactttccccctacctcaaacacctgggagttcacctactagggtggtcccttggttaggatgtcccttacggtttccttcctattctgcttactgtgtggcagttgagtgagcatagcatactactgtatgtcattcagggttatggactcagttactcaattctgcaccccaaccccttgacacagggaagcacagtataggtgctctataaagactggctagaattgaagtatatgggaagctgtgaccaagacgtcctaaaggcatattaaatagtggttgtcaccatctaaaattaccttatttatttcattatttgcatatctatatgtccttgctgccttcattattgtccattttactcctgtatcatgtcacaagaggtagatgtccagacagctcatcattcctcaagtcatacctctaagagagcaggaactgtatctttcctattcatggttatgtctccagaccagagcctggtgcttctagtggccatcttttccaactgtgggaaaaacctgtctgacaatagagccaacacagagaaaagcaaagctgagagatggagaaaaaaggcagagtgctgctgatattgttcaaaccataagatcctggcatgcctgaagtgaacatacccccttggacatcccatatgtgagccaataaattcccatcattgctaaagctaatttgagtggggtttctgccatttgcaataaaaagcaaactgactaatacatcctctcctcagtacctcataaagcttcatgaaaatcaaaaggaactttccatttgcaacaagttattcattctagtatcaaagtttcaacatggttatcctttcctgccttactcaattcaggaatgcaccaataatgatgccactagagagagatttccttggtaatgggctgaagagcacctgatgtggtggtaagggttgctcctttaaataaaggaataagcatttgagctaacacatggatgatgagaagcagccatacatatgcttatctagaggaaaagcattctaagtagaggaaacagcaagcacagaggcccagagacaggaaagaagaagctgattgttggtttaagaactccacagaaggttcatgtggctggatctttgtgaaagaggaggagacatataggaatggagaagaagccaagggccatgtgcacttttcaggagaatgcatgaattcaagattgtctgacttgggacaggagtcaaatgggcggcaacaagggcagcaaagaaggcctgcattcattcagtgaaaatgcagggtggcttgcctggcactgtttcacgcagtgtagctgtacaagatggtgtctgcagggttgtaccagcaaatcaattgctgtactaccaacctagaaaagtcagtgaatcatccttatattttgatcatatagttaaatatattccgtttgatcctttagtaagttagtggagctgaaaataaatggattaggttggagaaataagttaacctctcacattcatcagagcttaatttagtgattgcctccttattgccctagatgggccagtagtatgacccatctcactgtgagtaccttactctgagaattttgctcagtttccaaaaggcagcaccatagatatgaacacacaatgttaataagctggtattatgaagcacatcatactgcaaaaattctgatggtttcatagaatgtgaatatagtagatagaaatgtatttttatttcaaagtcctgggacattatgcttgcaaaataccttgaaatcgtgtttattctctagcattcatagcatccctaaatcattaatatgcacatgttccaaataaggaaactgtctgtcatataggaatattttgtaatgcaatttaattcatctcatttcaacaaatatatatggactgtttgatgtggatttatggtgttgaaagtagactgctttttgtaaggagaatgaatggatgcaggctagagatgaagcggggcatcttacaaagaaatgtttctagtaccatgggttaagtgaaattctaccatgaactacgaaagtgacagtggaaatgaggaataggcaaatacagatatttaaaagcaaaaccatcagggcttggtgacagattagaggtgaagaaatagagaaggacaggaatcaagtatatgtctatgaagtcaactggaaatattgtggtgttcttgatagaagtgggaattcttgaggaactctagtttgggaagatgatgtctagtggacaattggaaggcaggcctagagctgagcagcaaattaagtcctgaagatggacatttttagatcacccccctaaagatgatgactaaagctatggaaatggataagctcatccagtaggtcaatgtagagagagactccccacagattgaggcgtgcagagccctatgcaggccaccttgacataactcaccatacctttccccatgagtgtgattggcacccttggggccattttgatttcggatataagccttgtgctatagaataggaaaatttatgaagacattcaaattctgccattgaaagccagtgtggtatctggataatggacatgttattttgagaaaaaacattgcttacactcaggatattagttagaaatccccaatttagtttcattttttttgtgtgagaaaatatggcagtggaaacattttcagaaatgggaagtcatttcttagagagatttatttggagcatagccagtagcaaaatcagctattgacaccttaagctacagacttaagatgaaaaacaatgatagagaggtcgttttttttgttgttgttgttttgttgtttttttttttttttttgagttccataaggagaacatgattagcctattcttctgattgttttatgtttgcgagttctgtctcctcagttaattttcatcttttctgaagcatgggttctacctcataatttttggatctccctgcagtgcctagcacagtgcagaactagtgtatcacacactcagatatctcttgtggaaaaaaatacatcacaacaagtagaattacaaggttagattcaaaggtccttgaaatgcagtcaagtctgttctcacgcctctgtgcaggatagcaatcaagctgccccataatattgactgtcttcttgtaaatcacaagatatgtttcttaggctgaggcaaaaaggacaagtagagaaaccatagtttcatgggctctttacagctggaagtcagaaataccacgaaagttggaagtaatagtgacaggaaagggtacatgtaggactcacactaaggaacttggtagcatttcttataatacctattcaatcaacattgtcagtaacacggtcagggctacattggagtaagaattaatactattaaaagaaataataaatatgcaaataacctgaaaaatatccgtagtatttaccacctgaattcacacagtgaaatgaagcctttacacactttggagttcacattgcacaacttctgcatggtggtagtgatgagtgcatgaatgttctaacccaattcgttttctatgacctcttaattccctctaggaacttttgtgaaaaaaatgtcatgctcagtagagattgcttttgatgtaagtaatacttagtggtttggtaggtaaatattagctaatttttgagtgctaactatgtacctggcaccagactgagacttttacatagattattttatttaatgctgataatggccctctgaagtaggttttatcatttgtatttttatagataagaaagtaaaggcttagagaggccatgtaatttgtctgagggtatacatgaagtaagtggcagagctagtggtcagctaaacctaaaatccatgctcttaagagaactaggctaaactgcttacataatatattaactacattaaaattgataccagttcttttgtgcatagttggccgagttcatagagacttgccaagaactgttgaaacctttatctacagagataaggtagacagtagagaagaccaggagcacttggaccatatttcccagcagttactctcacctcgctcgtccagtcctttctctatcattacaacattgaacactagtaatacaactctgtggcagagttgatagcacatcagttatccccatttaccttctgtgtgatagcatttcatggtattatatgaaattatctaaaggatgatatgatttgatgttgctaaagtgaagaaaaccaccaaaggtagacttgttctcatttaagaaaaagcctccataggttaacttgaataatcttcagcttgtcttgtgggaccatgtcaaattaatttcagctgatgctgtataggaaggaacaacctttatcatcatcattatcataaattcataccagtcattattccattcatagtatatgccaggtgagttatgttcattattttaatcaatcttacgaaaaaaactctctaaaaacagggatttttatgctgacttcataaaagaggaaatagatactctgagagattgacagtcccatgatcatatagctaattagtgacagtcatatgatttaaatgagttatgcttgacttcaaacctgttttttctattactattattatttaactatgatcacaaaataatttaaacatacagtgttggtgcagaaatattacctactctcacttgcctgctgacaagataaacaaatgtcatttggcctactttgcctcaaatctactctcccctcttcttaatttttaaaaaatttttattttgaaataactataaattcacagaagattgcaaacaaatacacagaaaagtcctatacaacattccccagcctcctccagtattagcatataacataattatagtacaatatcaaaaccattggtaaaatctttagagctttcccagatttcaccagttaaacatgagcccctttgtgtttttctgtgtgttgttttatgtaattttatcatatgtgttgtctcatgtaaccaccgtgacagttaacatactccactatacagaagactgttctgtgctactcctttacagccatattcatctcctctctcttctccctaatccctggcaactaagttgtcctacatatctacaattattatttcacaagtactagataaaagaaattatatagtatgtaaccttttgaaattgacctttttaactcagcaacaatttccttcagatgtatccaagttgttgcatgcagttgtgtcggtttacccattgaaagacgtttgaataatttacaatttacaaaatttatttatttttctaggataaatgcccaagagtgcagttgttgagtcgtatgataagttcatatttagttttgaaaggcactgccaaactatttttctgagtttttgtaccatcttcctcttattaatttacactttcgagattatatgtgataaagtcattagagctttctcttccttgaaatttccatttatataatttgcccgtctttttctaatgagatttttggcctctttcttgctgatttgttagagttcttttttaaattattagcactaatcctcgttaaatataccacaaatgttgtcctgtctgtgacctgttagtttgtacgtggtgtattttttcatgcatacattttaaattttaatgtagcaatgtttatcagtcatttcctttatggtttgtggtttttgtgatcttacataataaattcctttgcatttttttccataggtaagcccctagggaccaaacagcctctttgctcttaattgatacacagtattaatacttctgctgatctaatttggaagcacctcataagttagaattacactggaaggcataagggaaattctacagacagatactctgatggcaacaaatgatgatttttcaggccatctcaattaattctactttcttccagttggtcatctacttttggtcatccttcagtgctcaaatattaactcctctgcgaagcctttcattacattcctcaagacttgttttgagctcctgctttatgtttaatcatcatcttgtgctaccctccttattgtacttctcacactgcagtgtagctgtatgtttactcacctgtgtcccccaaccaactgtagattgcatgagagaagagactgtgacttgtttaatagttgtatccctcagtgcagtgtctgatggatagtaagtgatcagtgaccctttatcaaatgtggggatgaaagagatgcattcaaaataagcagacctaagacctcacagagcaaagcagccttagtgtgcttagttcaaaggcaaattcccttatagtccatgggtccattcctcatgagagaagcaggactggccagagctctgtagtctgacctgcttagaacagtgaataagggtctgggggccacaggatgcagtgtgggggatttgtgctcaaggcagtgaagaccttggtaataaaaggggttgtttaatcatgacagagtgaaggaaaaccaaagtccaattcccagagtatgtacgaataacaaggctcagtgtcaaaagccaagagctgcattaaaataatactgaagcacaagaaaacaggaaatcctatttttttttttgtcttctgtttaaagaagcagagaattgtgtcaattgttttggaaaggttttagtccaaaatggttaaactatctgttggtatgattcgtctccccatcataggcacagacacatgttctttccaagggagatggatcagactctataaaattcctagtacctccttatgtcagatgaagtaataatggacattcctttcagattcatcataactcaggaagattgttctgatggtaagtgagggaaaatagaacctcctttcgagtcaattcctgctgcttctggactttgccattatgaagcaaaaagtctgtttttaattagagacctgaaagcctaattttatgccatggtaacctgtgggatctgaaatacacacccccagatgttgcctgtagcaaaatatgttcatagcaaaggcaacttaaaagtaaaaaaaggaaaaataaagcataactccaaggaagcagaagatataaagaacacactttgataatctttagtgaacttgaagcaattgtccaaaagtgagctatcatttagaatttattgtaaatgataggaaaataaaataccttgagtgggacttgctgctcaaaaagtaaagtgaagtgtgggtgtcttagttagctggggctactgtaacaaaataccacagactgagtggattaaagaataggcatttatctcccacatttctggaggctgaaagtccaaggtcagggtgccagaattgttgagttctggtgagggctgccttcttggttgcagatcgctaccttcttgctgtaccttcacatggtgaatagaggatagtctggtatctcttcctcttcttgtgagaacagtaattataggggcttttcctcacaaacccatttaaccttaattacctctcaaaggactcagctcctagtatcatcacattgcaggttagggcttcaacatatgaatttgggagggatacagacattcagtccataacagtgcaggaggcaaaaactaaacgtgcattttcctaagtgttaggccacttagtaattcaatataatgctgctctctttttctttatttctcattttttttgcataattaatagtattatatgaacccacttacatagttatagtcagggtcagctttaaaacaaaactttcacgtcttctactatcttgctgttccctctctttccctcttttcccttcactcgtgctccctccatccatttggttttgtttgggtaatttagggataatctgatttagtaaaaacagctttggtccagaagccgggacaccttgactgtgccactaactcactatgtgaacttgggcacatttctttttctttgtagaaatcagtgttctaatctgtaccaagagtaggttggataacttggtctctaaagtttcatttgcttctgctcatattggtctcactgaaatatgatcagtactcagttgaatattgatgtgatacctgaatagcatgtagaatgtgatcagtctcttaggcgaagcagctttttttagagaatttaatttgttataaagcagttaacttgctctgccagtttcatattaatatttcactgaatgatatctttgtcaacatcagaaatagataatgagtttataatcaatatgatgtcttgaaagctggcctttttctgattcattgctgtccctgtctgatggtggtctatcaaaatgcagaccctttctttgcatcataatcagacatacctgtaagctttcccacattaaatgaagactgtttcttctttgatctagtttaaacagatcagggattgcaaatgagctcatttcacttgtcaactccaatcaattgtggaaatataacaggagtccgtatttagaagtattgtgaaaagtgttttgggcactgtgcactaagaattgtcagagtgtcccatatgtcaggagtttgctatcctagacttggagagtgagattttcaagtcatctcctgctgtcttgcaatcgactcactgcgaattatggaacagatgttgctctgtgatcaacaggtctcccaaagctctggaggcacctttatgcaacaccagcaggaccaattgaaaaagaaattacccaaacattacagagctgcttgctgttcatatcttgcagcttctaatgacccaaaacaaagatgtatttatataatttatttgctatggaatgggtaagaattaaatgtgatcagtgaaggtactaggaccagaagaacttagagaagccaacagagttcaccatttaaatttacctaccatttgttcaataaatactataagccaggcatttttaaagacactttagttcacatctaatccttcaaaaattctgtgatggaaatggagaggtttaagtagttttccaaagttcatatctcaagaaatgagcatttttacatctctgaagagggggtataaaaattggtgacaatgatgaagagaagaccatggacccgtcagcctgaactcttgaagatttgggattactcatctgtagatcccatctgacaacagatgttgataagacacaaatacctgttgaagctttagtggatcaataaataacaccccttcattccccatttgagtcttgaaaaaatgagggaaagtgtgaggtagataaaggtgaaaatatcacctcaatttttggtaaagctgcttgtagaacatagattaggtcggtggccaagcaaacaagaatgcatgctccttcaagcaagcagttagcaagaatgagaaaggaactcaatcgaatatgtccaatttcttcttccaagtttattggatctgataatgaggataagtgtcttaagtcagcttcttcctaaagtaggccctgagacaggatctgagttccagtggtttctttgggaggtgatttccagagcaccagtaatggagtagggaaatgaaacagggaagaaaggaatttatttaagccaatataaagtatattaatgagcaactggagctcagtcatcctgggaaccctaggaattgtgcagaacatgcctctgagttgaaaaaactggagtagccattcactaactgctatcagtcatggctaagggctcctcctaggaatgtcaactccctggaaattactaactctctagcttactctatgcccaggctgatcaagcttctggggccagagaatgcactctggcaggcagaaattgcaaataattgccataaagaattgtccatgtgcacaggagcaggcagtgccaagtggttaccagtggagtatagatggtgatacatttgtcatgggacctgaaacaacccagtggattttctaagataaactaaaactaactaaactaaacttggagcagttttcctactacttccttttctctgcaaggaattctcagcagggcctttccaacataagcatgggaggtctttttgtacaaataaaaaagattatttttccttatttcttatatttttctgtttgtaaggcaaaaaaaaaaaaaaaaaagtccaacacaagcttcgaaactagtgaggtcttggctgtacaaaacctttggaaaccattggtggttttggaagctgccaatgtgctgtcaggcagattgaatctaaagaaaaacgcagagatgaatgtttcccatgccatgaataccccaaccctgctgtctggggaatctgagaaggaaggcagcatgaagggctagactttcactttttgcaaatggtttcagaaagagcaggctgagaccacaaagttggagtaacatacagtgtgggatagctgcaaaataatggtaggagaaggattcatgaaaatgggatggggccagaaggattgtaatggtatttgtgtgaaaggcaatggcagctcggggggcacaagtaggaggaaccatcccatctagtatcctgttgcctggatctcaatactttattggccatgagctacttgctgtccaggggagtggtaagaggtgaggataaggtgctctctcagtaggagccttgagcgtaggatctctgagaagactgatgattgatttgtaattagtgaatggattttgtcaaagtcttatgaaaattttccatgatgttttgcattttctttatttttaaggcccggaaggggaggaattatctcagtggtggccttgccctcattaatgaggcattagctcacctggttcaagcacagtacaaagaatactaacagaataacagtgagagccttccctgagggttggtctggatgtaatcctggggtggagacatgttgtttctattaagttatttcatcctggagtcttatctttgcaccagaaacccaaaacaaaaaattcttctaatcataaggattggaaaaaacagtcaagtcatattattatgttctaagattgatgttaaaatactccttgttcgccctgatagttttctttccttccttccttccttccttccttccttccttccttccttccttccttccttccttccttccttcctccatccctccttccctccctccctctctctctctttttcttctcttctcttctcttttcttttctttccccttcctgacttgtttattgctgtgattctgagtaatctaattcaccaagttttcacaagtctaacagtaacccaactacaattgggacttctaaatagtagatgtggccgggtgcggtggctcacgcctgtaatccagcactttgggaggccgaggcaggcagatcacaaggtcaggagtttgaggccggcctggccagtatggtgaaaccccgtctctactaaaaatacaaaaattagccaggtgtagtggcacacgcctgtagtcccagctactcgggaggctgaggcagaagaattgcttgaactcgggaggcggaggttgcagtgagccaagatcaacagagtgagactccatctcaaaaaaaaaaaaaaaaaaaaaaaaaagtagatgctttttctttccaggtgcaagagaagaaaatcataacaaggtccttcccttaaaagtaaaatgatgctgtctggttacaaatgggtttgagatgtagtgaaattttgtttacagtttattgctgtggaatgatatcttgggtttaaatgagctgtctttgctaggggtttgttttcttttcataccaggacaacacaagagtgaaaacctggctttgaggaaatgtcagggccaaacactgcgtgcaaatagaggaagggtcaggatgctctcttccagagacttgttcaggactctttaaaggggttcattttccctggatgcagactgaaaactatccacatcattccccaacccccactgccattttgaatggcaacttcatggcaaagcagaacagaatctgggagtgagagttcgaatcctacatctttgcagttacataaatccatgatgttaatcatagctgcccaacagaatctcttgggagcctactaaaatgcaaataactgggtagttttgccaagctattgattcagtgggttttgggtagggcttggaatctgtgttctttaatctgctcgttaggccacccaattttgatcaacttccatcaatcttttactctaagttgattaaatagtgatatatttatagaagtttctaactctaattcagtagcatttttctttatttcctttgtatggacaactggcttgttaatatgccttcagagcccaagtctctgaagtcagtgttctcttctcagcactgcctctgatttgaaggatgacctttaacatctcaatggttgagtctttccctgtttcctatgtggacctaaccactcttttttagcatgctgaatgccgacagaaaacgattgtgaaaagttcaaaatgtaaattgccatggaaacattatagcactggtaaaacatgtattctcagtagataaaggggaagacagattggggtgaatgaagctatccattcatcaaccttggattaatcaatctctgcttgtcatcttaaacagaaggattttaaaggaattatggatttcaggtcagaatttgtctggtttagtattttttatttcaactccaaacatttttataaaatgtgccatgctacttctgggatatataaaaataccagtctccaagatagtaggaaagctgtttgctcagagaccaagggtgttactcccttttacttcaaaccaggaagctggaaggagctattctgttacgatatgtattggacatttccatatgcatttaagtcaaggaattattcctgagtatcttctgagacagggtgttattctgggtgtttcggaacatatagatgtgaggaatatgcagtctccactttgacaagtttacagatggttgcaaagttttgggtaaaggtaaattattagctgcctgtgatacaagataaaatatttgccatggagattcagagcagtgaaggcccttgcatgttgggagaacgagcaaatacttccaagtgggaaattagatttgagatagactgtttttttttaacttttattttaatttcaggggtacatgtgcaggtttgttatataggtaaacttgtgttgtgggagtttgttgtacgtattatttcatcactcaggtattaagcctagtatccattaattatttttcctaatcttctccctgcctccccccaccactctctggtaggccccagtgtgtgttgcccccctctgtgtgtccatgtgtcctcatcgtttagctcccacttataagtgagaacatgtggtatttagttttctgttcctgcattagtttgctagggatgatggcctccagctccatccatgtccctgcaaaggacatgatgagatagactttgaaaaacacacaggatttgaccagacacaggcattctcactacagaaaaaagctggaacaatggcctggaggtgcgctcaggcaaagtatgtatgaaattgtcttcaaaatctactgcaagactttcagatttccctggaaatgagataattgctcctttattgacataagttggggttcattttactatttagtcacctgaggatatgttagttatcccagcatcccagcacctcctttgcttgaaaaaaatccttagtgctggggcctttgagctgtgggagtgaatgaataggcatgggaccaaattgtaggacactggtaagtatcctgcactgggatactgacatagaggccaataggtttaggaaagccaaacaacctgcttacctcacagtataaatgaaaaagcctgggctttggaaatcagatcagcctggatttcaatcctggttcttgctattaatgttttcctaggcacattatttaatcattaaatataatgtctgtcatgtagctgatacagttggtatattataaattttcaataaattaattacctgggtcctgtgtgtagagaccatgtttcaaggagggatggtagatgctcacctgggtttccatagagccaaagtatatttctcttgctgttttatagcatactctgtctccttcaaatctcagctttttgcttggctctagccaagattggaatgttcccttaaatatttctgatctagcagaaagaccagcctttcagaacttgcagtggcttcctttgttgacattagattcatttgggacttctttaagttgatgctgccatcttcctatgctttggcctctactttgaactttctaatcttgctggttttgccctatctgcttgggaatttgaccacaacagtaccaaggtaccaatgtcacctctaggctaaactaatgtcttcttgtaacttggtcttttcatatggcacatcttgccaatcttatgggttgctctttgtgatcaaaaatgaccaacctgatcatgacggagggtattgggcaccagtctggggccagtgtgagtatttcttgagcttgaggtggactccttaaccttgaagactcctaacatgatgtccttatgtcctttagccaaatgcaggaagacctgtggtacatagcttgatcttgtctctttatactctaaacaagctggtgggctagattaacttcttcaggccatcctgactctctggcttttctttgaactgtctctggggcttttgagcagcctctggactccatgatggaatgggaagtttgtgatataagagctatgatacactaacttaatttttttttgctcctgtgtttcccagactcattagattatggcacactcctgctcatgtgcatgccaattcacatatatacccaccaaatgcctgctaacatattcagataatgtttttctctcactttggaaaaatgtcctagtttaatcctcataaacatgctgtgaaatggatttattatctcccttttatggatgcagaaatggagtttaaagaacttacaggatttgtccaacatcacctaactgtaagttgcagagttgtacacactaattagtaatcccgctgctctttgaccacactcactgtgcctgcatgcattagccctgctattggcccttgtgataaaaatgtcatgctagcacaaagttgggaaacaatacccttccatagggtggccatgccaatcagaagccaatgttacctctcttaatcttaaagcatgaatgggctctacttcaggtctaattgaactgagaccataaaaccaaattgagaaggctccatgggtgtgtcatttagtctcacatccaggagctttccattgggtctgctgccacatttacctctctctgggttttgggacattctcacatggaaggagccgagatcgtggcataattaccacctgctccatttgggtactctgtcggcttctacatctaccctcaagtctcccactccgggtgagagcaatggtagaggcttttgtagtgctgatcattatctccatccccgggaaacaggaaaacagcacaatagcaaaatccttttggctataagatttcctgtccctaagtcacagaggaaaaccacataaagacaactagaagctcagtaacccccagcaaacctagctatgcacatttagcatgtctaagcagccttaggttcaaattctggtacattgctgtgtttctctgagcctcagtttcagcattcataaaatggggataataatacttgtttccatttcatagtgtgattcaaggagataattgatgtactatgttctgtgtatgtctgatggacactctaaggcagaatttgaaataaagacattgcttcagctgaaggcagatgttaggaatagtttgttgttaatcccaccctttggcaacaaagacatttcaacatccagtatcaggctgactgtgactcacaaatgaattcagaataatagcaatacctgtgagctctcagactggcagtcagaaccctgctgaaaggattagcgcccgcagcacatggcaactctggtaatggtgacttgaagaagtagtaatgtctcagctctttaaattgtgtgtttttttaactaatataatttttaaaaacttcattagcagcacagaatgttagaactgaaggatcttccttatccctgcctctccttttacagatgggaaaactaaggaccctcaaaagggactgtacctggcttcaaagtgacagaagtaatagatgacaaaaatgagattctaacttgatctcttgtataatgtcaatattctgattttacatgctcattagataaaattgaaaaaaaaaaaaaagaaaatgatggccaggcacggtggctcacgcctgtaatcccagcactttgggagccaaggtgggcggatcatgaggtcaggagatcgagaccatcctggctaacacggtgaaaccccgtttctactaaaaatacaaaaaaaaaaaaatttagccgggcgcagtggcgggtgcctgttgtcccagttactcgggaggctgaggcaggagaatggcatgaaccttggaggcagagcttgcagtgagccgagatagcgccactgcagtccaacctgggtgaaagaacgagtctccgtctcaaaaaaaaaaaaaaaaagaaaatgattaagaagaaaaagatcaccaataatcctactctacagacatatacatcattaacattttggtgtatttgatgcaccaaatagcaaatacctctctttctgtcttctctgtgtgttcattttctttcacctgttcagaaacattaaaactcaggtcttctgacttcacgctcagtgctttctcttagcatatcaggctgcctttctaatcagcattcttatttgatatttagtaaccaagagttaggttttaaattctcaaaaccaagtaaagctgccagtgaaaccccatgtgtatatggctcattaagaaaacaggtgtaataatgaaatcatgaataaatagatcaccaaaatggcctagatcagagagccaagcatgatgctagacagaggtgtctcaaaaagcacagccacatccctgccctcaaggagcatgctcagtggcatgacctctatctgaaacaagggctgtctgcctgtgctcatcccagctcagaaatgaagcagaaaatgaaaaggccacatgggatgcttcctacagtcctgttaatgtcaggagtgcaatgcctaggccctaggcattttgactcagcttcagttctctctcccaaggctgaattactagaactccagctgcagcctgaactttaactccctgttctcttcccaacccacaatcttgttatcagtctgattctgatctgttagggagaggggagggggagctagcagagatgtgactaagggcaattgagataggtcagaatggccttgcagtatattctgtcttagtgaaggttttgctaaaccattgctgcactggggagagagtaggagaacccctgcctccttgtccgcattcccttagttaagctgagctaagatgatccctccaagcttttcctaacagggaatctacattctctgtgtcttgctggctggccacaattccttggggaggcaggagctaactctaccgtcctagccaacttgaataataggaaataaatgggatggagagccaggcagcctctttgttacacagcacgttagtgaagcagctatctatttttagaagagggggaaaaagtagtagcttactcttttgggatcagcaggtggaataatgatctgccaaattttaacattcaagattttttagctgggctacaaatgagacagacttttgtgcctgcctcagtgcaatgctgtcagtgtaatcgcacatccctgggcaactaaaacatgaacgctggggaaaggagatataggactccatgtcacagaactgaaggctgagggtgcatgctataccaatagcctgattgatttaattagaaaaaaaataggtggcctagtcaccaggagtattgaaacctcagatctctgctcaaatgttacactcagtgaggttttccttggcattctattaaaagtaacgcttgccgatgacgcttcttttagcctgcattattgttctttcctgtacgtatcgctacctgacattgctttttatctgtttattaatttttctattttctgtctcagccactggaatgtagggctcaaaaagacagaggcttgcctttgttcactgctatgtccccacggcctagaactatgcccagcacatgataggtgctcaggaaatatatgttgaatgaattaatgaatgaacatgtgaatgaataaacttagtatccaatagacaatgagtatgccaataaaaatgacaagagcaattaataattattgcatgctgcacattaactcacttaatcctcacagtaactctgcatggtacatactgtccttattttcattttacatttaaggaaaattagacttgggggttaagtgacttgcctccgtggcctttgggtcacagcatgaataaataatacagccagggtttgatcatcagcctggggacaatgattccagacatatcagactgagcattcacttaatagtattttgcattggttttttggaatttccttccatgattcttacctggccctgtaaaactctttcgataaaatgaccatatgagatggatgtttcatttccatctgcttaacctatagcatccatggacttgtcattataaactccaaccagaagagcaggatatgcctcattgttctgtgacaaaaagaacccattgaacattttttggcttagctgtggttcattggtgaagctagatcagatagagaatggtggtttcttccttaaaggtttaagaataaggattaatggctattctgacatgctctaatgtggactttctcccactggatccacgacctaaacaaccacgtttcccaacttaaagtgttttgcaaagccagagcatgtcagggcttcctggtcatgtttttagtcactttcattcacaaaagtgaaatttgtttgtactcccttctccccaaataaaatgcaacaaaaatacatcagaccacaaaatcacacctagtaaaagctgcccactgagctctctagggcagtgcatattcatttatacgtgcatccaaaagttgtcaaggtccccttagagtcttattgccttctggggtctcccatgcactgtcaaccacgtggcttagggagtatatggagtctcatttttatcctgagcatagtttatccacatggcaatatctggtatattccattgtcagagtagtcacattatcttgtgcttataaaaattaaagtctctattatgtgtttgtattataattacctaattaaatagttttattattccttttagaggagacctacatttgagtgagaggctctgttttcatgcaaaattcaaggggtcactgctctgttttcaaagaacaggcaagctctaggaccgtctactccatgggttctgtgctcagtaaggtccctgtcccaagaatcccagattttaggggaattctacgccactcaacccaatctggacatagagtccatctcagtgtacagaccactgccagatttcttaagtcattcttctttctttccgtcaggtttggtcataattgtacttacgtttactgtgagttaactgagatttcaaaatccttttcaatatttcatattgatttgcaggtaacgactaaatctctaatagaaagagtcctgacacttagattcctgtcacattagagaaaaatctattttttaccaagtttcactttcaacatattctactagttcaagtcataaattgtcaaggaagaaaaaaggcccatgtgatttgttctcttggagcgcgcatgtcccttttcccaactaactcagaggttctcatcctggctgcatatgaaactcatttgagagggcttctaaaaattaccagtgtccagcctccaggttctaccacaggccaagcaacttagaatgtctcagggtaaggcctaggaggatttaaatgtgcacccaagagtgagaaccactgaattacagaatttctaatgctgtccaccaccagagtttatttgtgcagccagtgcaagttgagcaccacttatctagaatggaagtgtcttaagggaaggccctatattttatctgttttcccagtgcctagcaaagggcttggaccctggtaggtgctcagcctcatatgtggaagataacagctattcgaagcaattcaatttgtgtcaaacaccttatgtcattgccagaaacatcaacacagttccaactacatttcatttaaaagatactgcccccctcgcccaccccacacaaccacgatacacacacaaattctaaatgtcatcctgggagttgcaaagtgcttctttgaaatcttatttgtgctgcttctgtgtatccatacttaaagtatcttgacacgagccactgtctttttgtgcttgaaattgtctttaacatattttactttgacattagtatttactaggtttttgttcatatatctcttttctaaagctctgggagaaagagaggcagaacaatcatatctgccaaatggaaagaagactttaaaatatatatatagctagaaactttcacctagagaatcaatctctatccatttatacatagtcaatcataactgccactgtggccttcctttgtttccccttcctacctaccatgcatatacacctgctcacagaagcattgttgggccagtatttgagacttgaggtgcccagaattgtatcattctgctattgagcagcatagaatactctattttgggggagaaagaatatgtgaaataaacagagcaaatatgcaaggtaatttagtttaaaataaatgctacagtagtcataagaggcaagaattttctcaagttttaatagagggagcagataccttgactctactataatagaactaagatgggcatagaggcctgggaaggcatcttggataagtggaaagcaagatcatgggtgtggagctagaaatgaggtggatatttgggaaaagtttgtctcaaatataatggtagttgtgtccgtttaatctacttgttggggtttggagacttcttatttggaaggagcagtgatcatgatgcagcctaaggtccacttgaaccactcctttctgttttgagaaacaaagataccaaccaccagtgaaaataagatgctttgaatactcaagagaaactcattctcagcctgacctgcaatgtggtagagatgcttggggagagtgctgggttatgccctgttaaacagttgtagacatctcgacgccataagaaatcattttcctggaccagattgattgctttcagctgatagagtatagttttattggttcctactcattttgccattttatatttttatagacttgtcagttttcttgtcttcctttctacaataacatttatccagtagtatatcaaccttaaaatttgattgttggcatattcagtaatgggaatttagaaatccactttttattgatgtcctagaagtttgtatgcaaggaagaatcattaagcttgtcctttgatgatggacaaaatctagtaattagtatttttttttcatttttaattgtcaactggcttttaaactttagatctttttttctccttgttcttttcactatgctctaaaacaatagctaatctcagcttctatgaaattgatctttatttaaaactaagaatgtttagtcaaatgtggtaatgggttccttaaaggcacttatacatgattttgtggttttacttaggcatttaggtgatgctgcatataatttgtattaaagagaggccattagcaaacatatatagacttccttcatagatttcaaaaaaccattacccaaataaatgtatttttggtatttaaatattcctaccaagagttttctttgcagagttttaatcaatatgattttgtattcctcctcttttatcctttctacttgttgttatcacagtgatagaaaaaaaatgaggaagtaaaactccaatttagattttgttcctacccccaaaatagctaaaaagttgatggagagaatgttaaaattattagttaaaatgagactgtgagagtatctgtggaaaggaaaacgttaaggggtgatcaaactgttagaaaaggagggatggtttccttcagagaacaagaagatcatatgagaacaagattgaattactcaaataagtgaaatataccctcactttgttttcaagcttataggccacattaagaacatttctgtattatacaaaatgggtgcaacatttatcccttgctataaccatcaaaataacctgtgttgagtgctttgctctagcagtctaacagaaatatctgacatccttaaatctgcaactcaacaggctaaaagaccggaaaatagatttctgcattaccagtcaaacactcagaaccataatcaaactttccctttctgttattttactggtttttcttaaaatgtcaggaagtatgattagcttcacaaatcttaaactattcagtttctctactctcctcccaatacttgtaaggaacttagagtgttttaactttgatctcccaattactacataccaaattattgtctgtcagtatttagttctaccttacttccacaattcctccattagccattatttcttttaatatttacagttagtgtttatttaaattcactagcaacttctttgcttgccgtttttttcttacatcctactccatgccttttgtttaaactacagtgtatccttttagtgaagtttttataagcaatgaactctctcagttttatttttttctgagattgaaatttcactttcactggtttaatgatgggttagctggatggagatatctcagtccccaccaacaacctcagtactttaaaaatactactccatttggtgctgatgagaagtctattaatacaagtttgccagggggataaatcatggaagagagaaaggaaacactttatatccaaaggctcagagattcaagagagtctaggtgcctggggacgaccatatcaatagctcctgtcaagtggaatgctataaacatcaaaggaataggtaatcctctgccctggcctcttgcacaggcacttgtgccctcaacacactgagctccccactttcccatgcaagtttcctgatgattacaaagagatgcaggacctatgggcttagggtctgtgacagaactaccaggcttgggtaaagttccagcaaacagccccaccgtgcgcttcatcatttcataaatgcgtatcagtccagatgctaaattctgaaactggagaggaaagaggaataaccaacttaaaaaaacaaaagcagttctagcatgccttttagcacatacttactgattatgtgccagaaaatatgctgaggatacagcagtgcacagaccacatccctattcatgtgtatcttatgtgccaaagtgaggagacagaataaatgtggaagccaatatacacctaatgtctaaaagtcatcaatgttctaaagaaacacagcaaggtgagtggacagggaataattggagagcacttctttacttaaggtggggtcgagttggtattaagaatgagacccaaatgataagaaggggctagcctcatcaaggaaagaggttaatgagtgatccaggccaagggcagaggaattgcaaagcctctatggcagggacatgttgattatgttcaaagggcagaaaaaaagcagtgaactaggggaagagtcagaggagataaggccagggaagtggccaggggtaatgtcatataaagccttgtaggccatgccaaggggtttgggttttcttctgcatgacatgggaagccattggacagttttaagtgagaggcaacacaatcagatttcagtttttaaaggcttgctctgatgattatatgaataattgagtagaaggggctgaaaatgcagaaggggagatatattgggaagctattagaatctagcagaggagtagtggcatcttggactagggttgtggctgtgaggatgatgagagtgatcagatttgggacctgtttttgacatagagctcatgggaactgctggtggattggaattgagggtgtgtgggaaggagagatacccagattctctactgtgttcctggatagtaccttttattgagatggagaagattaagagaaggaacagaggtggaaggatgagtataaagagttgcagttttgagggatggagggatgagaatggagatactgtgtaagaatggtttgttgaggagtttggacatgatcctgtctggatccctgagttagtggagttttagacattagtaagtgacatggtcagcttatggtatgtaaatgcagctgagagtccagtgggagcctcaaaatattgactggtgctcttgaatcacattacattttcaattagtaaaaagaacctgactgacttaccaggcctggtaggacatctcatcatttttagctttaattctccttccttttctcttctcccattttttttatctccaaaaccgagctcctttcatgagaataaacccagggcatatgcacatatactcacacgcatagacacttacatattcatatacgtacataactgtgctatttctaattttctgaccaaaaatgagtgacctcacttagggaggtggactagctagttgtctgcttcatgcttctaattgcaggcaatttcttgagggcggtgggaactagttatccatttattaattaccttaagaaaagctaaaaatattctttttggggtaaatacactgcatagaaggttcttttttggagaaatccaagatggagggcatcctgagctggtatcattcagttcattcttgtcttggcccatcatgtacatagttttgaaacttctttctctaattctggcagcttcctggtttgagatccagaaagcttttctgggtatgtgtatcgtggaccaagtagcctcagtttctcatgaaatcttgcaagcatttcaagaatgtcaactttggcaagcattctccccaagaaatggagagaattgtgccgatatggctggctttttgtgctaaggaaagggatgataaagtgaccttacccagcacctggaaggatgccccatgggatatgagtgcagggtatagtctggacagggtgctatgctgcacatgacagggggattgtaattggcttaacaaccatgacattgaaatttgtatttaaatacaagcttccatttccccatgtttctcctactcatgcatatcaaccttagcctatagccagtaactgttgagtttctacatgttcttataacccaacccccccaaaaaacacaagctttttttctcatctgagtctttccaatatgcaagccaaagcagcaactgacttagccttgaataaaagactaaataaaagctagagaacctgagaaaacatgagagacacagcattgaatctggtttctaattccatggacttgacggctggaatcgtgatggagcagggaggggaggccagtcccaccagtgtgaaagtaaacaccagaaagatttttcctcagtaaaaggagatgttccaagcattttagtgtgacaacctccttctgagcctttgataggggcatagaagagagaataagagagaagagaagggaggcaacaataaatcaccaaagagcttttgtcaattatttctccctcaaactgccaattgcacaggaaaggcagatgacgcaaattctctcctttccatctataaaattgctctaatattttatgaagatgttaaaagaaatgattctcttttttatcctctccctctcacgaatctcccccttcccaacaaacttggggcatttaatcacctctcaatattatttaaaccttctatgaaaaaaaatctatgaatgcttcaaaatagtaaaaggacacagaggggaaaaaagggagtctggacacattgactgaaggtgaaataattctttgtgtttctttttcaaagaactgggacataaagtgggtgctgggcctttcatggtccttgcacttacatgtttgcctcagtgagtgagtagaaggaaatgagacaaaagcatccattgaatccacatataccaagcgtctacttagcacgtggtaaattgcctggcctggcccccactagatgttcaagaaatatttatgaaccaactacttttagctttgaccctgtactagtcactgatgacgcataagtaaataatataggtagtgcttgcactcaaacaactcatacattttaggtagttaaagggtgtgcaatggaatgctgttcataccccctccctttctcctgcttgtttgcagctctactaggaagtcataatttgtattgttgttgttaatgtcagaggatgcatttttaaatagaagagcaaatatgcctcttgtagcgggagaaagatcccatggcatttatttaggcaagtgggatttaacttcagaggcagctgatgttctgtctaagctttgtacatgtggtgtgatttgtcagcagtgctactgaaagcctgagagggtgttccctgatccatgaggtgtttgtgagagtcctatgaatatttgacctcatcaagataaaacaaaggtatgggcttttgggttcctttatcacagagataataattctgattcagatctgaatctggaccagtgcccaggctgtgaagtgcattcttatgacaaattgccatggctgatcatgcaagccctagatgtggtgtgagggctgagactcatcaacctcatagtagtttggtggtgtgaactctttggttctgtgcctgctgtgctcagcttaatcagcaagtgtgcccagcctcagacggacccttaaagtcttccagatccaacacgatggaaatagtgctggcccagcagacagagatatgacaagtgtgtagcatctgctgtggctggctctgcttccctgatgcttcactggtaggtttttcttctagattctcaacaactctacctgatgtcatgtggccttagaacttgctcacataattgttcatagcagttagtgatcaacagaatgtgaaccattccaagactgagatccatattcacttagccaagcaaggctgaatagagtcccaggcccttccaatatgcaagccaaaggagcaacagacttagccttgaataaagaaaaaaaaaactgaaaataagctgggcgtggtggctcacctctgtaatcccagcactttcgtaggccaaagcgggcagatcacttgagcccaggaattggagaccagcctgggcaacatggcgaaaccccatctctacaaaaaatacaaaaattagctgggcatggtagtgtgcacctgtagtcccagctactctggaggctgaggtggaagaatgtcttgagcctgggaggcggaggttgcagtgagccaagatcataccactgcaccccagcctaggtgacagagccagaccctgtctcaaggtgcattttctgtcttgcctctgaagtggccccaacatgtacatgctacacgtcccgtgttcccacccccggaactttagactggatccaggatttaggtgctcaccgtcatctgccatcatctacgtgatctcattacttttctgtcaaatatgccatagctactgcagtggtgtcctgagggataggtagggcacattcagacagagtggcacaggtaaggttgagggaggcattccaggaaggaggaatggcatgtaaaagtgtcagatgtcgaagggcaattattttcccatttaacaaacaaggacactgatgtttagagaagttagacatcctgcttaagttaacatagctaaaagcacagccaagattcaagctcaagtctgcctaactccaaagcctgtttatttgtacatatgctgtcttatgaaggatagggtgaggagtttggatatatcttataagaagtcgggagccattgaatggttagagaggagacttagatgatgaaatcaatgttttatgaagattaatttggcggccatgtgcaggatggattaggaaagtgagaggctagaatagagactggttggtgaaagaaaagtataggtgaaaatgatttatgactcattattgtgtactgagctattgatatttaattcccctatcatagtatttatctcaagtatattttttaacttttattttaaattgacaagtagtattggtacatatttatggggtacaatgtgacgttttgagatataaataaaaatatatatacacacacacacaaattgtggaatgattaatcaagctaattaacatatccatcatctcatatacttaccatttttatagtgagaatatttgaaatttactattagcaattgtgaaaagtacactacattattattatagtcagcatgctgtgcaataaatctcacaaatgtattcctcctaattgaaatgctgtaccctttaatctttgtaccctttgagcccaggagttcaagaccttcttccatccccaacctctgataattcttctctctatttctatgagttcaacattttaaaatttcacatgtatgtgatatcatgcagtatttgaccttgtgtgcctggcttatttcacttagcctaagtttttcaggttcatgaatgttgtagcatgtgataaaatttccttatattttgtggctgaatagtattccactgtgtatatatgtcacattttcttcatctattcatccattgatggacattcattgactccttatcttgcctattgtgaataaaactgcaatgaacttgggactgaagatatcttttcaacatactaattttatttcctttggatatatacccgtgtgaaattgctggatcatatggtagtactatttttagtttctcaggtacctccatactatttttcattatggctgtaccaatgtacattcccactaacactgtacaaatctcttatctatgtgataatgaccatcctaacagatgtgaggtgattacctcattatggttttgatttgttgaataccttttcatatacttattggccaattttatgtctcctttgggaaaatgtctatttgaatcctttgcccattttttaattagatgatttggggtttccttttttgtttgtatgaattccctatacattttagatattaacccatcagataaaagtgtcctcacccttcctcccaacacacacatacatggtaactgtggatggtgatggatgtgctgatttgattggtgtaataattacaccatgtatacatatatcacatcatcaagttgtacaccttgaatatatcctgtttcatttgtcaagtatacatcaataaagctggaaaaaataggttgtcaagtaagggagcccaagaaaagtatcaggtatatttacagagccaaatcaggtgtttcacattcccagtatggatgtgtagcatgtttatactctgggttacatttattgatttgcgtatgttgaacctgccttgtatccgagggaagaagcccactcgatcatggtggataagcatttgatgtgctgctggattcggtttgccagtattttattgaggatttttgcatcagtgttcatcagggatattggtctaaaattctctttttttgttgtgtctctgccaggctttggtatcaggatgttgctggcctcataaaatgagttagggaggattccctctttttctattgattggaatagtttcagaaggaatggtaccagctcctccttgtacctctggtagaattcggctgtgaatccatctggtcctggacttttttttttggttggtaggctattaattattgcttcagtttcagaacctgttattggtctattcagggattcaacttcttcctggtttagtcttgggatggtgtatgtgtccaggaatttatccatttcttctggattttctagtttatttgcatagagttgtttatagtattctctgatcatagtttgtatttctgtgggattggtggttatatcccctttatcattttttattgcatctattggatttttctctcttttcttctttattagtcttgctagcggtctatcaattttgttgatcttttcaaaaaaccagctccttgattcattgattttttttgaagggttttttgtgtctctatctccttcagttctgctctgatcttagttatttcttgccttctgctagcttttgaatgtgtttgctcttgcttctctagttctttccattgtgatggaaagagaagatactacaggtcctttagtctttcctccgaatcccccgagacccggggcattttgaaatagagaacacttttgtgtattagaatggtaaaaaagttggattaataaagacagtaagtttcctcctggcagttcagataaaattttgctgcccaataagtccattcggctcatataataccacagaaatatgtcttttctatgtagaactttttggagtttggaattactaataacctcgtaaggtatggtagacctgtattataccaataataatgaatgtaaacatcatgaatagaaaaatatgagctctctgcttggctcattcagatcatgactctgattagtgcattgaggagcattttgtggacaggctggagtcagcattacaattgtgagtctgtttacccataatagctcctatttttgagcaatatgtgggtgtctatgctgggcactatacaaggtggctcaccttacaggttgcacaagtaattcagacttatttcacgttatccacctagtgaagtgttaccaatataggcttcaggtgaagcttttctctaatacctgtttttttttccttacccttaagtgattgatgacatgaaatcattctcggacaaaaagctcaactccttgcaggaggcagcatagcagggtgaaggaagcatctgagtggtcatacctgacttgtcatttattaggtgactcttgggcaagtcatttcatctctctaggcatcagcttccctatctttaaaatgggggtggtaatcccttccgagcccacctgacaagagagctgtgaggattttgatagataataaataaacgtgagggcaccttgtaatctccgaggcaccacttcaacataaggtggaaaaattataagcgcaaggacaagcctcgtgtatcaatttgctatgaggcaaatggccaaaatggagtgagaaggatatctcaaaaagcaaaggatctgggtgtgggtacagggtgaagggaagatagatgtcaccagggaaagccagtcactcataccatctgaccttttcagccttctcagttacctccgaggtccttctcatatccctgggagtctcttaattgtcccctttctcttctaatccctgtgcttcaaatgttgcatggattttttgagctgcctcggtagctaccttttgtagtctgctttgtagcttcttacaacatcaccttcatcttcctctctctccctccctccctccctttctgcccacccccctttgcttcctccccacttgtatctatgtattcctgggtcttggtgggtagtcactaaatattggatgggtgcattcttagggcactttaaaccttagaggagacaaacattcatgtagctaagtatgtctaccacccatatatgctccccttgaattctcaactaggttctctagaacccactatatatgagcccccatctcctcttcctggcattcgagggctcatctaaatcagccaaacttataactagaggctccccactaagcaccagctattcttggcagcctgatccctggtcactcctttggaggcttctactcattcccactcccagacctctatattagctcaagttgtttccccatctgaaacactctgcctcctctgcttcacttattgttaagaatcctttagcccttacctcctgcaaaaaaccttcattgacacagtttatacagatcttgtctgtatattacttgtctctgctgaccttctgtagcactttaccctctgtaccactaattccctacttaatctttctctgcttcttgtgatatacatatatgtattgctagtatgaattgtttgctttgtgtcagacactgtacttaatattttacatcaataacacaacttaatccctaccattcagtgttatccatttgcccattttataaggttcagaggggttgagtaactttcccaaggacacatggtttgtaggtggtgaaactgaggtttaaactcagttattgtatgaattcagcactgtataactaccacatatttgggtaataatctctgccctaaaagtgcttgcactctagatgggaagataagacttggacatcaactcttatttccctgttatagactgtattagtcagggttctcttagagggacagaactagtaggagataatacacacacacacacacacacacacacacacatatgtatatatagagagagagacagagattggagtttaagtattaacttacacgatcacaagatctcacaataggccatctgcaagctggggagcaaggagagtcagtccgagtcccaaaactgaagaacttcgagttagatgtttgggggcaggaagcatccagcacggaagaaagagggaagctaggcctgtctctccttttcatgtttttctgcctgctttatattcgctggcagctgattagattgtgcataccagattaagggtggaactgccttccccagcccactgacttaaatgttaatctcttttggcaacaccctcacagacacacccaggatcaatactttgtatccttcaattcaatcaagttgacacgcagaattaaccatcacatggactgaatgtgtttctgacaaattcatacatttcatgcattgaggtcctaacctctaacgtgaaggtgttaggaggtggggcctttgggaggtaattaggcttagatgagttcatgaggggtgagccccagtgatgggattagtgttcttataagaagagaaaccagagcttcctctcttcacaacatgaggatacagaaataaggtggccatctgaaccaggaagtgagccctcaccagaagccgaacatgctgacaccctgactttggatattcagcctccagaactgtgaggaacaatttttttttctgttttttgagtcggagtcccactctgttgcccaggctggaatgcagtggcgcaatctcggctcactgcaagctccgcctcccgagttcacggcattctcctgcctcagcctccggagtagctggaactacaggtgcccgacaccacaaatttttttgtatttttagtagagacggggtttcaccgtgttagccaggatggtctcgatctcctgacctcgtgatctgctcacctcagcctcccaaagtgctgggattacaggcgtgagccaccgctcccggccacaaatgtttttttaagccactcagtctatggtattttattatagcagctccagctaagacatgcctctccattttgtatcaagttgcacacattaacagaaatgacaacagcaataataccaatcacagaaacatacatccattgaaggatctccccttaggaccttagaatggacctaggaacttgttttatgctcagtatttgtgagttgatcccaaagcccaattgattggttaataagtgaggggctgctgaaccttagtaaaggctagcatagtgtatcttagtttggcacatggtaagggtactgaaagcattcctgaaatggtgtatttcaacaccagactgagtgagtaagcaaaaagaatgctaaaacttcttcaagtggcttaagctctctgtactttaattatcagtaaaataagaataataatagtaccttcctcacaaggttattatggggaataagtgaattaatgtatgtacaatactcaatacctggcaaagagaaagacctatttttttttgtcattggtatcattgctgttgccattgctgttaatgtgtgcaacttggtacaaaatggagagggctagtgttaataatgacaccaatgattcatatatctcaaggaaagagaagcactatcactatcttatatgtaactcggcactgtacttgccacataacaggtactacaaaaatatttgtagaatgaaaaagtcatggaatgatgtcaaaccctcacagtgctcaagtatctacatagaaaaagttcaggccgggcgtggtggctcacacctgtaatcctagcactttgggaggctgaggcaggtggatcacctgaggtcaggagtttgagaccagcctcaccaacatggtgaaaccatatctctaccaaaaatacaaaaattagctgggtgtggtggcaggtgcctgtaatcccagctacttgggaggccgaggcaggagaatcgcttgaacccgggaggtggaggttgcagtgagccaagactgtaccactgaactccagcctgggcgatagagtaagactgcatctcaaaaaaaaaaaaaagttcaaaagggagaggttgggtaacatattcctctcatgttaaaatgaatgggtttccaatatacactaacatctagcctctctctccattctgagctccgaaagcccgatttctggctcagtagtgcttattgcttccttttcatggcagacttttctctgttctagccttgatatacagttctaaacaaggatgccaccgtaataactctttgctctggcatatgaatgagaatgatttttcatggagctctctccatgcctgctgcttagagttatttgtcatttcttttatgggccatttcaagagagccaggctatgggatgggttgtgaaagccacctgtgttgtcttctctaagacaccagggagatttgatgggttttcattttctaagattctaaggagatgtttttatcttggacagactgcctgttgttacccttggggtttgccatggtgacaccaaatcaaaggatttttatttgcttgaaaggaaaaacaatcaaatattcttgctgggaggtctttttagtacatctggtccaaattcccatctaagggtggggaccatgtttgccttatttccttttgtatctctagtgcacatcactgtgcttggcatagagttgttatgcaacagacatgtgttgattacataaatattttgcagagggaagaaatgctttgtgttactagcctatttggatttggccattctcttctgtagttcagcaaagaaggccttttctctccccctacaccccaaccctggattatcctgctctcttctgcaccaacagacatactttgtatccaccattagagcactcacgatactgtgatatttgttttcgcctgtctttctgttcccactcctattcctggggctctgtgtctgacagtgctgagcacatggacatggttggtgctcaaaaaatattagttgaatgaatgattctaatgcccatggaagacagcaaaaataattacagtgtcatgcatcatatttatattgcactaaggacttcttgtggacaaagatatcagaagaatgatggcattcatgagattgctgctaacagaatggttgacgatagagtttcttcatttggaacgtaggcatgataatactgaattgcaggaaggttgtagagattcagcaggaagatcttttaaagggtgctgctgactcatgacttttatggtagcaggtggaatttttttttttttctttttcttggtcctatgagcaggtagaaggaagaagaaggaaaaatggcagtaacttgggaagcaagcaaagacaacacctcttctctctcctcacctccatcccctccccgccacccttgataagccaaaaggagtgctaaatgtcagctgccaaccttagggagcctgagaatcaccatcacagataaagacctggtgagcatgggtcttagaagacccaacagtagagcactaagccaggttccatgctaagctatagatataggtggctgggggctcaaatcctagaagtagaagagatagtgagagtccaaagacaagaaagttagtctcttgggatcataatgaaacagatgggtgctcacaaagactgaggtggagttctggccttctcaatttcagtatctgagaatattttatagtgcatttttcctgataaataataggacttgcaaagtgatattcccaagagcattggaatggaatgatacaactcaatggcgtattattattgatgtaggttagcaaatggccaaggttaacaaatgtagattagcaaatggccaaggcacaaaaaatagagtggtgagcaaggtagacatgggccctgccctgacagtctttatagtctagtaggaagaatgaaacaaccatacaaatgtaacataattcaagttccatgaaggagatatgggaaaaactataacggcaggagaagctctgaggagagaaagggccttttgagctgagaactgatggatgaataggtattaaactagaagggagaagaaggaggagagaaatcatgagagacattctattaggcagaggaagccaacataaaaaggcagtcacatttaagtgggataaatgctagggaaggaaaagagaggttactacaggagccactgctcagtctttaaataaccttgacagggaggcagggtaactatcatcatccccttgaatgcataagttgggactcagacatattgatttatttaatttatttaatgagtcattgtcaagcccctactagtttcaaatcattgtgctggggctggatgaacacatttatatattgtctctcccctctaggagctttcattctagtggggaagtagcgggagtttatctgtgtcacaatgctggtaagtggtagggccaaaacttgaagtcttttgacttcaagtccagtgctcttttcatggtgtcacattgcagctcaacaaggaagaggcctggttagttacatccatgatgacttggccggatgaggtagcttagcttttgttctaatagctgataaggatttccatagtgctaacttagcacggtgggaacttgattctattaaagtaaaattgaaacaaaaacagaatttgggtatagctcatctgtgtgacaatcatagctagcccttctggagtttgctgtgagctagacattgtacacatttcatatatttatttaatcctaataacaatcctataagtgaggtaaatacttgtactgatttgcccactttccgaatgagaatgctgagactcagggagataattatgcagcattattaagcttgctcagttagtaatttagggttataggatgcaaactcattcaatctgatgccacaacccatgatcttaaccaccatgcaacattggatctacttgccagactagaacaaagtagatgacactatcccagagacaaaggagcagtctgggataaaggccaaagtttgctcttcctggcaggactcccagtcatagttgtttaacaggtacaaaagcacaggactggacttaaaagtgactattgaatccaggtttcctaccatcgtatccatagtactttgtggtcataatttacaaggactttatatctgcctagtgtggtggagtttttttttccaagtaattaaaactatgaaacacaacgcttatacttgctgaattttagaggcctactgagaggccagatttacctcaaaccatgtgtattattgtttacagagtactttcacatccatgatctcatgagatgctcacaacaaccctgaggagggttattcacattttatagctgagaaaacaaagctgagaaagcccaaggtcatgaaactactaaggttttggagccattgctgtgcacctttactatgggaaatgggtgaaatctaccagagcttgcaattctgtttttgtgtcccaattgaaatgaatcagttagtaaaacatttggcttttcaaaatactaggatttctttttcattccagattcaaaagactgactccgtaagtattgactttgttcataaaacactgtattataaataggaatacaaaagtagcatgcattattttctaggtttcaaaataaatagtacataatggatgtctttagttaataaaagctacttggatttctgttcagatgcagctcattggggtgggggtaggggctttggtcttttttagaatgtagaacgcaccttcattccatttgaatgtcatttttgcacttcgtaagtgaaagtacattctttcttatagtgccttgtccctcatgaccggcagaattggtagctttaagtattttcattctcaaaacaaacatgactcataacccatgtggatgcaatgactgtacttgatttggtgaacatttgaaaatacgaagtgggaataaacaataccattaccgtagttatttttttaaagggaaacgaatgcactggaagtggtgtagatgaagtacagggaaatatatgaacattggaattatattccagttagctcaagcttagggtagaagaaattaaaattaaggaaatatttattcatctatttaacacatatttaatgaacaaggcattgctctagacactggagatacattggtgaagaataataataaagatgaaaattcatgccctgttggagttaacattcaagaggggccgtaatgggtggtagtattggcggggggggttagagaagccctcatggagaagatgacatctgaataatgaactaaaggagttaagggaggatgtaacgcagatacatgctcacagagagctccaagcagagaccttgcaatgatgatatactccaatgtggctgaagtagagtgagcaagacagagaataatgggagatgaagtcaaagaagtggccaggagttggctgacccatggaaagaagtttacaaagtaactggtgatattcaactgtgtagtggacactgttgatcccctttaccaggcagaggtacctatcccttagctacttggagcgttgtttgctaaagcttatagtcacccccttctctatagcagaagcactgggggcagcccacagccaatgactggctcaaccccttggcctcaaggtgagaccaatcctatggttccattcatggtcctgagcttctcctggggtcagttagagctagactccaggtgagaccacagccttgcttttttagttccttcatttccccttccttcttaatcccattctaccccaaataatccatctcaggatctgcttctacctaaggaacctgacctaaaacaacaaactttcaacaacataattttagaagctaatatgctgtatttttctctgcaagtgtcaactttgagttatattttattaaactaggcaccctgatggtaaggcagatcattcttgccagtctaaaggagctaggaaagatatttttgaactagatggctaatggtgccattttcgacatctgtgaatgtctttctaattctgtcactcagtaaaggggagcattttaactagggtctcaatggcatggtgttgcagcgattgattcatttttacattgataagtgaatccacaggaaggtcccattagatgcctccttttagttatttgaaatcctagtcaataaatatcgacttccttcctgtcctcttgcaattgtgtgtgtgaatgtagtatttgtccttttctgagataccctagtgctttatgtcactttgtctttacgtcatttaattgatgatatttctcaataatagccaaccaggagccaagacaataaaaagatattccttgtatcaactttaagaaggggaaataagctgtggctggaaaatctgaactaatctcaataataccaagtaacaaatttgacttttctccacttctcactagtttgggcaaatggactttgttattggggacaaggtttagagaacaaatactttgggtaacaggtgtctgcttataagtatgaactttagcaagcagtgtgagaaaattccaacaggaggccctctcccttgcatgggctctgaatgagcaaatccaagattgggaaaagctgctccaactctttgaggttctccactacccatctttggcatgtgatttgaccatggtcctgaggacatttgattctccctttcacaaaaccacttctaaggtataagaccagggaaactcatattgtataatatactccttttgtctggctctctatttctccaacacctgtagtagtccaaatggtgtgaattgccctgtctcttgccttaattaatactatcctgtgaattaggaaatggagtcacaattttttccagtttgcagatgaagaaataaagactcagagatttaagtgacttacccaagatcacaaagctagcaagtggctaagtcagaaatagaccccacgtcttctaactgctatacccttctggagaaagtgtcagggaaagataatgacttattttttagcattttgcttgttaatatgatcattttacttcttctttgtgtggggatgccaatgaatttccatttattcaagccaaatctttgttttctccaaataatttgctgaggtagtgctcttctcattaaagccccctgaagattggctgtgattcccacagagtggttctgtgagctctgatattctggattgtggctgtattattcctggatctcattttacattgcttttcatcagatgtaagacacctatttctttgtctatctctgttatctgctagcatatttgccaccttctttttattgtcttggctcctggttgactattattgagacatatcatcaattaatcccatacaccattgtatgagattttcagtaaccatgactctatacctccgcttcgtggtggcatgccttccatccccttaaagtgattgatcttccctccattagcctgtgcttgctcttctaaattcaaacttggtatcccagtttggacatgagctcaccttatgacctgaagaaaagctttcttttatgaggtaggatcacatgtactcgtctctggtcctctacccaatatctaattcccatatgttggctaagatgctgctgtatacaattctggctgacagagatgaagttgggctttacctccaaatcagaggcgattacttctgcaatctcaggaatagagaggaaatgttcacactaggctgaatttatttgtttggtgcatggaaaagttgcagtgaaatgagtgctgacactgcagcagaaaacttctttgttgaagctgatgcaaggcttggacagctgatgccaaagatgacaacactgtaatttgcttgatccatgtgtctgtgcttcttctttacatcatatctacttctgtgcctgacagtattccataggccagtggtggctgccactatcctagaggcagagaggatagacaagttttggggggcaggtttctctatcttttctcctagcctcaaagcctgtgatctagggcagaggttttcaaacctctgggatgaagagggaggcttgagggagggaaggggaaggaggaaatctagcagggattcctctttaacccttcctcaaacaagtttatgtattgagtttccatgcaagagtttgtttgaacaaagggttcggctgttgaagaaagtttgggaatcactggtctactgcactaaacaggttaacttctgtactgaaaccagcccaactgagtcctacaaaatgagagctgaggctaacagctagtttaccctggatggcttgagtttcctgaggtgtaaaatgaaaccatgcttcccttgatgtaacagcttacatagtggggagctaaaggttttgttggttatcctgaataatttggggctcctttgaggatggatgatagaagaaagttaattattttgagaaagttatttgattccaacctgataatgccaaacttcttctcataaaatgactgttaaatagaatcacgctgtacatcaactagacctaacaggcatatatagaacactccatccaacaacagcagaataaacattttttctcaagtgcacatggaaagttatctaggatagaccatatgttaggttacaaaataagtctcagaagtttaaaaaagatctaagtcatccaaagtatcttctccaaccacaatagaatgaaactagaaatcaataatagaaggaaacctggaaaattcaggaattttgaacaaccaatagccaaaacagaaatcacaatagaaattagaaaatacattgagattaatgaaaacacagagccacataccaaaacttatgggatatagcaaagggactactcagagtgaaattaaaactgtaaatacctaaattaagaaagaataaagatatcaaatcaataacctaactttacaccttgagaaactatagaaagaagaactaactagacataaagcaagcagaggaaggaaataataaagattagagcagagatttttgaaatagagaatagagaaaaacaatatggagaatcaatgaaatcagaagttggtcgtttgaaaagatcagaacaattgagaaaactttgtttagattgacaaagaacagagaagatacaaataacaaaaatgagaatgtaagtggagacattactaccaaccttacagaaatataaatataaagaggataatataaacaactatatacaaacaaatcagataacctagacaaaatgttcaaacttttagaaacacacaatctgccaagactgaatgatgaagaaacagaatatctaaatagactgacaacaagtaaggagatggaatccgtaatttgaaactacccaataaagagtccaggaccagatgactctgctagtgaattctaccaaacatttaaagaagaattaacaatgatcctgctcaaacacttccataacatagaagagaagggaacacttcctaattcattcactgaggccaagattaccctgctacaaaattggagaggaagaataaaactgttttttttgcatgtgacataatactatgtacagaaaatcccaaggaatccacaagaaagctactagagataataaacaaatagagcaaaattgcagggtgcaaaaacaacatgtaaatttggttgtatctctaaacaccaataatgaaaaatccgaaaaggaaattaagacaacagttccatttattataacatctaaaagaataacgtacctaggaataaatttaacaaaggaggtaaaagacttgcacacactaaaaactataaaacattgctgaaagagattaataacctaaattagtggaaaggcatcctgtgttcatgaatagaaagacttaataatgttaagatgtcagtactactcaaagtgatctacagattcagtgcaatccctatcaaaattccaatagcattttttacagaaatgtaaaagctcatcctcaaaacaatatggaattacaagggcctcctatatagacccctatcatgaaaaagaagaacaaagttggaggactcacactaatagatttcaaaattttctataaagtacagtaatcaaaacagtatgatactggcataaggatatacatatagactaatagcgtagaattgaggtttcaaaaataagcctatacatctaagataaattgatttttgaaagagtgctaagtcaattcaatggagaaacagtttctttaacaggtgctgcggagtcgactggatttccacatgcaagttgaacccatatctcataccatatgcaaaaataaactcatctagtgtttggttttctgttcttgtgttagtttgctgagaatgatggtttccagcttcatccatgtccctgtaaaggacgtgaactcatccttgtttatggctgtatagtattccttagtgtatatgtgccatattttctttatccagtctatcattggtgggcatttgggttggttccaagtctttgctattgtaaatagtgccacagtaaacatacgtgtgcatgtgtccttatagcagcatgatttataatcctttgggtatatacccagtagtgggattgctgggtcaaatggtatttctgattctagatccttgaggaatggccacactgtcttccacaatggttgaactaatttacactcccatcaacagtgtaaaagcgttcctatttcttcacatcctctccagcttctgttgtttcctgactttttaacaatcgccattctaactggcatgagatggtatctcactgtggttttgatctgcatttctctaatgaccagtgatgatgagctttttttcatacgtttgttggtcacatgaatgtcttcttttaagaagtgtctgtttatatccttccaccactttttgatggggttgtttgtttttttcttgtaaatttgtttaagttatttgtgcattctggatattaaccctttgtcagatggatagactgcaaaaatgttttcccattccgtaggttgcctgttcactctgatgatagtttattttgctgtgcagaagctctttagtttaattagatcccatttgtcaatttgggctttgctgccattgcttttggtgttttagtcatgaagtctttgcccatgcctatgtgctgaatggcattgactaggtagtgggagttgaacaatgagaacacatggacacagggaagggaacatcacacactggggactgtcagggggtggggggctaggggagggatagcattaggagaaatgcctaatgtagatgacgggttgatgggtgcagcaaaccaccatggcacgtgtatacctatgtaacaaacctgcacattctgcacatgtacccccgaacttaataaaaaaattaactaacgttaaccaatatctaaatataagatctaaaaccataaaactcttagaaaacataagggtaactcttcatgaatttggatttggcagtgggttcttagatattacagcaaaagcatgagcaacggaagtaaaattggattatatcaaaattaaaaatcgttgtgtatcaaagaacattatcaagaaagtgaaaaagacaatttacacagtggatgaaaatatttgtgagttgtttatctgataaaggcttgatatatagaatatagaaagaactcctaacagtcaacaacaaaaagacaaaagaaaattgaatggacaaaggacttaaatagatatttctccaatgaagatatacaaatgtccaataagaacatgacaatatactcaatatcattaatcattagggcaaagcaaataaaaaacaaaatgagagaaaattttcgcaacctactcatgtgacaaagatgtccagaatctacaatgaactcaaacaaatgtacaagaaaaaaacaaacaaccccatcaaaaagtgggcgaaggatatgaacagacacttctcaaaagaagacatttatgcagccaaaaaaacacatgaaaaaatgctcatcatcactggccatcagagaaacgcaaataaaaaccacaatgagataccatcgcacaccagttagaatggcaatcattaaaaagtcaggaaacaacaggtgctggagaggacgtggagaaataggaacacttttacactgttggtgggactgtaaactagttcaaccattgtgaagtcagcgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtaggggcagggatgaaactggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgttaaatgacgaattaatgggtgcagcacaccaacatggcacatgtatacatatgtaacaaacctgcacattgtgcacatgtaccctaaaacttaaagtgtaatgataataaaattaaaaaaaaaatgagataccacttcacactcattagggtgtatacttttttaaaggaaaataagtgaagatgaggatgtggagaaactggaacccttatgtggtgttggtggaaatgtaaaatggtacagtcactgtggacaatagtttggcagctcttcaaattgctaaatagagactcatcatctgattcagcaattccattcccaggtgtatatacacaaaataatttaaaacagggactcaaacagatatatgtatgccaaagttcactgtagtgttactcacgattagctcaaaggtggaaacaacctgagaatccatcaatagatgaaaagataaataaaaatgtgctgtatatatgcacaatcgaatattattcaaccataaaaaggaattaagttctgatacatgctacaacatgaataaagcttgaagacattatgctaagtaaaagaagctagttaccaaaggataaatactatgtgattccacttaggcaaattcatagagataaaaagtagattttatgctactaggggctgggggaagagaaggatagaaagttgttgtttaatggttacagaatttgtttgtggtgatgaaaagattttcgaaatagtggtgatggcttcatagcatggtgattataatctatgccactgaattgtacacttaaaaactatttaaatggctggtttcacgctgtatatattttaccacaataaaaaattcccattaaaaataaagttattcaaaagtggtttcattatttaaaatgaagcaaaagtgttttcacgtctttttctctaatagagaaaataaagatgatcacaaatgtgtcccttctatgaataaaaatgaaatgttcattaaaaggaggcttttttcctttttttttcttcatttcttcttaaaaaaaaaacagaatacatgtgcagaacgtgcagtttgttacataggtatacgtgtgccatggtggtttgctgcacctactgacttgtcctctaagttcccgtccctcaccccccaccaccccctgacaggccctggtgtgtgttgttccccacctggtgtccatgtgttctcattgttcaactcccagttataagtgagaacaagcggtgcttggttttctgttaaaaggaagcttttatatttcatatttaaaatgactttttgatggaagaaatagtaccgacactttatttgctttacttagattctattaagaaatttttcttttgttgtatcctttctgaggtaactaagtattgagataattgtttatctttatcatggtaatctttatagaccacatagagagatccatcttaaatattctggtccatcaccatagtttgtttcttcaaacttaacactcaaagtctcaaaatgacagcacatttggggctagtaaactctctgccagtgaatgcttagaggacgtagcataggtagctcagtatctcacaaggcctacggctgtgctcttttctggaggtcagcatcctcttctaagctcatgtgattgttggcagacttcagttgtttgtggcaataggaccaacatccccatttattgctggctgtcacacagggcctattccgagctcctagagacttcccaaagtcccttgccatgtggccccctcgtaggcctgctcacatggcagcttacttttttaaggcctgaaggtaaatctctcttttaatgctttcacttgattaagtcagacccacccagattagtgtgccttttgatgaactcaaaatcaactgatcaggggcatgaattacatcttaaaaatcactttacctttactatattctattggctaaaagcatatcagaggttctgcctacattttaaggtgagagggttatacaagggtgtaatccattgggcatcattctagggtgtgtccaccacaatgtggaactatcaccctgtattgttgagagatggaaagaagagaactgatttttacaatgaaaaaccaaagcagccatgtcaaacttggtaaaagaaatgggcaagtggtccctttatgtgtttcagcttcccatagtgtgcgtttgcttcaatcagggttctccagagaaacagaaccaataaagtgtgtgtgtgtgtgtgtgtgtgtgtgtgtgtgtgtgtacaagccgatagggagataataataaatcagactttcatggttatgcaggtatgcaagtcccaagatctgcaaggttagtcaacaagctagagatgcagaagagctgatttatatatctaatccaagtccaaacgcctgagaaccgggagagctgatgatgtaattctagtccattggctggcagtgctgagacacaggaagtgccagtgtttcagcttaagtttgaaggcaagagaaaagctgatgactcagttcaaaggtcaccaggcatgaagaattatttcttacttaggagaggatcagtcctcttgttctattcaggccttcaactgattgggtgaggcccacccacattatggagagtaatctgctttactcagtctaccgattaagaaaaaaaacactcataggcatacctagaataatgtttgaccaactatctgggcaccacatggcccagtcaagttaacacataaaattagccatcacattgtccttcagtaatcgcatgtcatttcccctaacaagtgacactaattcagttattatgacaaatggactcaaccagtttctgctattccaataaaccagtcaaggatgagtggcctccatcaggctgtttcctgcatctgttgctggagtacattacaggtgtggttacaaggttttaagctgtgtgtctccagtgaactgctggactgctgggagaagagaagtaagctgcactttctttcttttcttttctgtttttttttttttttttgagacagagtctcgctctgtcaccgaggctggagtgcagtggtgcaatcttggctcactgcaaccttcgcctcccgggttcaagtgattctcctgcctcagcctcctgagtagctgggattgcaggcacgtgccaccatacccagctaatttttagtagagacggggtttcaccatgttggtcaggctggtctcaaactcctgacctcatgatccgcccgcctcggcctcccaaagtgctgggattacaggcatgagccacctcgcccagtcacaagctgcactttctcaggagcagagaggctaatatgaagctaagtacagagagaggcccgaggctgcttgtagtttcccagctaggcatgcctattgcctcctctgtctatttgcctttgccacattctccattcattaggactgacctaagtatagatatcaaaaagagaaccaagttactcttctgctgaccaggaatttggtaaggagctcccaatgttccctgcagagaagaggaacttacagagaaatggcctgctgaaaaaggctgacaacccaaatttgcatgtaagtcagtccatgatcattgctgcttcttagatttgagtgtgacccatcctgctctcttgcccaaaacatctttttcaagcttgccataacttcacctaatgatcgctttgccagatagagacttgcgtcaagtgatgtcttgagtagcttagaatatctcatatatagtaagcttgtctttgagaggctgtcagttaaacaggtgttacaaaaagccgttggggaaaaaaaagagaagaaagaattgccctctaggcaactcttaaaggattgtgattattctgcatttcataggaactctaaaagtatctcttttaccactcagcaagtaagcatctaaattggctgggagataatttacgtggaactttttgccctgtctttcttgagtctaatcttaaattctacttaactgtccattaaggaagacgcagagagctgtccttagtatgagaattgggaaatggttttttttttttaattttactttatatatatatatatatatatttattatactttaagttctagggtatgtgtgcacgacgtgcaggtttgttacatatgtatacatgtaccatgttggtgtgctgcacccattaactcatcattttcattaggtatatctcctaatgctacccctcccccctcccccccaccccacaacaggccccggtgtgtgatgtgccccttcctgtgtccaagtgtcctcattgttcaattcccacctatgagtgagaacatgcggtgtttggttttttgtccttgccatagtttgctgagaatgatggtttccactttcatccacgtccctacaaaggacgtgaattcatccttttttatggctacatagtattccatggtgtatatgtgccacattttcttaatccagtcgggaaatggttttactctggctgacatttttgaagcttgtgaaaactggcatgtttcaatttctagaagacaccaataaacactccccaaatgaccagtttctcaacatgaatttaattaatgggaaaatcggaggcacgtcaggagagactcactgacaggggccactggaaaagacagggaggtaagatttgggaagcttgtgctgcctcccagtgtggacattactccaatgccattcaagaagaatgaattcacagctttatttcccctttgcgttagttttcctgttcccatgtatgacctacattatctttcccacgtccttattgctgctttgaaatagagattttgacagagcttcctgtgggactacaagaacttcagtcaataactagtgatttccatggcagcagaaggtttttaaattaatgtggcagtctgtaccttccatctgtgaaggaccaaaccggcactccctcacctctctctttccttctacctggtgtttttaccattcctccttccaatttttttctggccttatagtgcaggtctcctggtactgatctggaccatgaaacacaggaagccagagccaaattggccagcaaagcttcacgttttgtagaggatttaggcttctccaatactatgaaggccatgattctgagcattcacaaatattgctgggagttgtggcagcggagcacaaaaaaacctcaaaacgttctttttctccccctgtctaagttgcaaacaaattaagaagtaaaatgagaacagtgtataaaaagcaattggatagacgtaatcacttggccacagaaaatcctgagtgacagtagacccttgtccccctcttccacccctcacttgtcacaaaggccctccccctacaaacttaaggcataaaggagcagagaagaatgaatgctttctccagtgagctgactcccaaggagaaagtaaaaaggaaggagctgagctaggaatgctagtttatcttttgaaacctcaccagtcagtctaccacttccataaaagagtgaatcatgggccagagggaagccagcactgttatgctaatgcgattcatatcaaaaacagtatcaagaagagggaagaaccccctgccccatgtaagctctgaaaaaaattagaggtcatctggtcaactccagttgaggaaatctggattcacacagatgatgtggcttattcaataaggagtagagcttaggctgatttaggctgatctagaggacagaaacaagaatggtgtaggagttctagagaatcagtttttcaaggatgttgttttgcaaactgcccatcatcatttccatcactgccatcagtactctcctgcaatgttaatatttgccgggtacctatttgatcacattctacatagatagatttagtgcaatgagacaccacaggagagagctaactgtgggatgtctctcctccttgcccaaagagtagagttagctaatccacagtaattattttccgtttgtgaaatgtatatcccagggagttattattatcaaagggtatctatattaaatagtgtcattagatgctgcctgccatcagccattacttctgttcatcagagttttatattcctagtgtgtataaccagaatctaactacttcttcccaactacacaactgccactggtcctaactactgtcacctgttgcttagattatagccgtagcctcctaaccagtctccctgcttccatctttgcgccctgcagtctgttctctacatagcagcaagagtgagcctttgaacacataagccagctcacatcattcttctgcctgacactatccagtggctgcccgccagtcagaattaaagccagagctgttacaatggcctacatgagcagacttccttttacccttctggcctcatctcctacctctctcctcttcaatctctcagttcctgccatactggtctccttcattttctacaaaaacagcaattcacactcctatctcaggacctttacatttttgatacttctactggaaactcttttctcctgggtatctctgtggctcactcccttccgcacttcctccagcctctgcgccaatgtcttcttcttagtgaggacttctatattatgtagattaggctgaattatactgcaatagcagaaagctaattgacacattaggaacttaactcataaatagttatttctcacttaggtggatctagcagcaatttggagcagcttctttccaatcagtgactcagatacccttggaggtctcagcttaacaatttgtttactgtctctttactcctcaccaccctcaaatgtgtaaactatatgaaagcaagaatttttgtctgttccccccccatcttctatatactgtatgctttgaatagtgcctggcatacagtagatttccaataaatatttgttggaagaatgttgaaaggtagtgagatgagaaggaatggaaaataaaaacctcaaaggaagcttctttgtgtgtatgttttcttctcaggttaaatacagtgaagctgtgtcaattctgcatacaatatttggttattgttataactatagaaggcatgtggactttaaaacctacttaggttttcagtatcaagatttgaacatttcatttgttttctattgctgccataacatattaccacaaacttaggggctcaaacaacacaaattgattatcctacatttctgtaggtcagaaatcagacacccatctccctaggccaaaattaaggtcttggcagggctgcattcctttttggagactctaggcaggatctgtttccttgctccttttgatcctcagcacgattcaattccttgcggaatggagatctctgctttattgttggctgtcaactgagggccatccctggcttctagagactatgtgtactctttggcacatggcttccttcctacatctccaaagccagcaatggcaagctgagtctcttcaaacttttgatccctcctgcctcttctttcctttcatctctctgctccactattctaccttcctcattttattttaagagttcatgtgactacattgggcctacctggataatccaggctaatatcccccatctaagggtaaattgaatagcaaccttaatttcatctgcagtcttaaggtaacatagtcataggttccagggatttaggacatgggcatttttgaggaccattattcagcctttcagagatacgcagacaaatagaaggtatgggatagttggtaagaatgtaggtttgggaggcatgcagaccttgctttgaatcagctcttcatcttgatagctgggttaatcgggatatgttgtaacctctttgacattcagttttctctctgttaaatgtgaacatgggttgctatgaatattaaaaatgatatgtaaaagtgtatggtatatatcaagaactctactttactacttaaaaaaataatgtgacaattcctaatgttctgaatctaagcatcaaatgcagcttagagctcaatgtggaggacattgcctttaataaaacaaagtaggccaagtgctcttttgctaaaacctcaattaaccagctaggtttatagggaatgagaggggagttacatataagtgttgataattcatttatacctaaatcgttaaacgctattttaaggacatttgatgacttgaggctttcaaagaagtcgtaatgcctttttcttaaatagtaatgctgccaagagtaagcaaactaaaataccatttgctttgaaattcttctcaaacaaatttggagcgggttctaacctggcacaatatattcttccatctgtaatccctgcaaggacagcccccctgaaaataaacaccagcgctatttactgaatggggaattagaatctgtggcaggcaagaatgcaaagaaaagcacccatttagttggaatatttatttctctattagaattgtttaatggatttcaactatcgtaattgagagttatgttctagtgttttccattagctaaaaatgtgcttcttttaagtatctaaggaggacaaattcctccacagcaaataggtagagaaatgcatttcctggaggtgttgaccgtttgagcttgcaaattgatgaatacaatgttggggccaaattgaactaactgccttttgatgagcttgagtgcagcttgtgactaactagggagaggattttaccagtgcattctttaaatgaaacaagaggatccaaggactcatgtcttgatcaattggaagagcttctcctacatcccttcctgtacttcctccctgcttttgctactactctcatcagtggcacagccacatcatatggaaagccaggtagcacaaagccaaaatgtcatacacatacttcatatttcagaaatggttctgtagatcagcccacctattggtatctgcttcatggtttttgccaaaaggtcagtcaagatgggttgttaatgtacttgagtgaattttcaccattgttcctgggcatggagaaaagcatcaataggtgacagaagcatatatgatcacagaacgttggcaggaaggaaaagaagagcaccctacctgcttgaaaataaaagtatttcctgactaataaggtaaaatgagtttgctacttagatacttttggggggtggttatggaaagatggaggtgcacatgatggcattgatcattcttccaatcatataattttccagcaacatttgcactataattttttttgccgctagcactagaaccaaggaattcctagcggtcaactgagcctggggtggggtcttcgtgaggcagggagctctggacacatccctggaaatttcgggcaaccatcaggaccaaatttctcgcttgacccatgaaatttggatcagagattaggtttccaaacaccaaataaaagtgtgaaggggatagtgatgatgcatagtgcagggctcttccagcatgccatgtgaagaggtgtggtgttgatgagcacattttctaggaagacaggagtgtaatgcctgagaatgcactctatagtatattggtgaggaaacctcagtcctctgagctttaatactccaaaaattgaaaagattgagagaagaaaataggctttctctagcaatttagcctataatattgcctgagaaaggtgttaagatcaaaggctgagaagatttcgggcaagaaagtttatatgagtaactatgacatcactctgtgagcctaactggagtttctctactaattgttactaatgtcaaagacatatgtccagcctcacacacacgtgcatgcaaacacacacacacacgcacacacacacacactgggccccgctggctggaacaacatgcatagggcagtgagttttctagaaactttgcctgaaatgttggcagtgacctccataagtatgcatggaggaagaggcaaaatttagtgcaaaaacaatgcctggaatcgatatgtaaataatctttaaaggctgcctagataattcagttcctgggacactgtggccagaggcactttacatttaaagcaaagtgagtgagaccaaacatttttcaatgaagccagtcacatattgaacattttcatgaaatttcagacagcattttgaaagaaatactattagtcaatttgataatccataagcagtacagccatctttttctccactgagtcatctctcctactttggttagaaaactaaagtgaagttcgtgtgaggccttctctggaccagcagttataagtggttgaaaattttttgtgcgtggtgggagtggaagacaccttcacgttaacttgaattcagcttcagttactacttagggaggatagatagatagatgatagatagatagatagatagatagatagatagatagatagatagatagatttagagacagtgatacggtttggctgtgttcccacccaaatctcatcttgaattatagttcccataattcccacatattgtgggagagacccggtgggagataattgaatcatgggggtagtgcccccatactgttcttgtggtagtgaataagtctcagaagatctgatggttttataggggaaaagcccttttgcttggttctcattctttctcttccctgatgccatgtaacatgtgatttgctcctccttgccttccaccgtgatgtgaggcctccccaaccaagtggaactgtgagtccattaaacctcctttccagtctggggtatgtctttatcagcagcatgaaaatggactaatacagacagagtcttgctttgtcacccaggtttgagtagggtggcacaatcataggtcactgcagcctcgaactcgtgggctcaagcaagcctcccacctcagcctcctgagtagccatgactacaggtgtgtgtcactatgtctggctaatattttttacattaaaattttttttgtagagatgtggtctcactatgttgcccaggctggtctcaaactcctgcatcagcctctcaaagcccttggattacaggtgtgagccattgcacccaccagggagtacttaatacatagggaatagctatcatggggtaggcactatgctggatgctcccacccacattatcttgtttaattgttaaagtgaccttgttaggaattaaacgtcgagattcagtttggtcatctgtaagagataggaaattgacttgcacaaggtcatgttgtaggtgatgttctttccccaacctttagttgtgtttccatgtgtatatatttaactgatgcccaaataatgcttggcctcagaagagaagagaattgacccatacttagtactgactatgtgactgtgtgccagctattgtgcaatgtgcatctccaactttaatgtgcatagcagtcgcttcagaacctcgtgaaaatagattctgattctgctgatctggagttagcagtcctgcaagtctgcatttctaacaagctcccaggtgaaacccaggatgctgggccaggatttacacttaaccctagctatcatctcatcttatggttgaggaaactaagcctcaaggagtatacaggacttgcccaaggtcacactggtggtaagtggtggtgggggtgggagcggaactgtgatttgaaagcaggataggttgattataaggccgttgctggtacagtgcaatctgccacatcgcccaaggtttttgaaaccttcttcttaagagaggagaaaatccatttgaattccaggcttgatgaaggggcctggcactttaaagtcctagtttcttctaaagctctttcttctaagctcagaaaaacatggtctttgcagttaattgtgcatacgtttatgttttttctcttggcttcttcagatagacactttggtttgccacccttgcttcaccttgggaactctaaactactaaggcccaagccccactcataggccaattaaaccagaatctctggaggtggggcccaaacatgggcatgttattaaagctccccaggtgattctgatgtgcagctaggataaagaaccactgaattacagattcaaggaaacaatttctggaaaaatgtagcctcagtcccctttctcgtggatgtcattaaagaaggtccagtgtatttaactagacattcaccaacaagatttccaattagttcttggtaccattttattttgtgactgcgagcttggactgctctgagattgcagcctatataaagtttgaaatgattctgtacagaccctaagggtggggagctggtaaggagggatgagagtagaaagatacaacatcatagaccagctccagggcaaagacacatgttgtaggtcctgattttcttgctaacctaagttcttgggggggtattttgaaaaactgaatttgattttattcaattcaacaaaactggctagtcaagagatggtcatttttaaaaatgagaacacagtgcagggttggattaatgctatagaactctgagcagaccaccttggtgggtgaggctggaacagggcttctgtgtagagacgtgtgctgctgtgcaattttacacagtgaacagcgccactgcacaagagtacatactctagcctgaggtgtgggaagaaacgcaaataattggataatcatgagccagagcctgccctcagggaagagagaggagagagagaggagagagagaggagagagagagaggagagagagagagagagagagaggagagagagagagagagaagagagagaggaattttcactggagagagtaaagaaaggctttacttagagcagtaattttcaaccttggctctgtagtcaaatcatctgaggagcattgaaacctaccagtgctcaggccccagccaggtgtttctgttttaattgatctggtgtggcaacatgggtgttttggtttttaaaagtcctccaggtgatgctaatgctaaaccacaactgagaaccactggtttagattgcgttcgtactgggcagaggagaatgcatacaggcagagaaacctgggagagacaagtagcttgggagagtcgttctccaatctaagtatgatccttgaccagcagcatcagcaccacctgggaacttgttataaatgccaattctcaagttccagcccaaaccacctcaattagaaactcctgggtgggggtccacagtcagtctcaataagccctctaggtgactgtgaggctcacttaagttcgacttggacatgaacgtttatggaaagggagtgcaatgagctaaagctataagacttgaacctaacaagctgatgtcaactctcctgatggtaccattgagatgtacagcaataaccagtgttctaaggtggaatgtactcctctctagtcttaccatatctttcttatctgtttgaaactgtagcacagaaaaaagtatatgtcattcatgcaggggcagaatacttctggaagaagactctgcttttctggtagaagctgcacttttcttcttagtggacctatttctgtcttcagcagggggatctatcctccctggccacatgggcctttggctgatggaaaggctgggctttgaggaagctgcataggtaaggtgaaagagggtcccccaacctcccctttttgcttctcgttcccacctgggccaggacttcggttggctgggccccacctgccattcacagcaggcccctgaggctactcacagaatgccaagtgatgccactcagtagagaaagtctttgtcctatgctgagtaaagaccccactgatgtgtagcagtggtgctttatgttttgccagtcagaggctttcttttacctgggaggttgatgtgcacaccagtgcattcccctctcttcctggtctgcattgtatgggccaaactctccaaaatggaatagctgagtccttgcaggatgctgagcatctttgagggtcaaaaaagtgtttccaggattggagctaactcttcacaaagaggtttgtaggacaaagggactttacccatcaagtccagtgattctcaaataaggcaattttgccttcagttgtcagggcggggattggggggatttgacaatgtccggaggcattttttgttgtcacaactttggggagcagtgccactggcatctagtgagtagaggctagggatacagctcaacatcctacaatggacaaaacagcccttcacaacaaagaattatcaggcttcgaatatcaaaagttccagtgttgagaaaccctgacctagtctaaaccccttatttttgaaatgaggcagctgaggctcacagaggtgaaattacattctaaaggttacacagaaagcatcaagtcagggtgaggctcctggttttccaactaccagagtgcattgctcaacagtttcatctctggcagggacagtgtttcctccattgcagataccatttactttgtgcctactaggtgccaggcaatgggctagactcttcatttattaccgcttcatagcacacaccttcaatgtaggcatgactatccctagaagtggctcattttgtgcatgcaaaacaactgtatgaaaagtgttataggccattaagaaagcaaaaatgattgcaaaagagactgagacatggttcttgtcctgggagcttacattcaagtagtggagaaaagatatatgtcaaaatagtgatcatctagctttttacttaaggcccatgataataaccaaaaacctgtcccgaggcaccacaagataaatttcttaaaacgtatgtggaaattgagagttaggagagggagctgactgtatgccttagcatcatgggaaggctacataggtcaaagagaattatttgtgtgtattatgagtaagcactatcctagatcccacatataaatggtcaatgagacatataatgtctctgcctcagggggcttatattcttgtagggaaagccagacaagagagaaatacatacatatataagtaattatagactgtgacaaattgaaacctccctaacgtggctaaaagggcatctctgaggaggtgacattttagtggaaccctgaaggacataaaggggccacttgaaggacataaaggggtacaaggccttgaggcaggagaaagcctggcatattctagatactaatggaaagctaacgtgagccagaagagaggcatataataaaattgaggaggtgaggggccagcatggtagggagtttgcatttcattctaccatgaaaagagcaagttagcctgaagaaacataggatggatgaagacctagtaatgcttggagaatgagggaggttgcaaaggagaaggtaactgaaatttccaaacattgaaaagttgtttctaccttgaacaaattgaaagaccattagcattgatctgttccattcagtgaattatttacttaagttactcatgcacatttaaacctgctaacttcatagtgtccatggtggcagtaaagcttaaatcttatatagagataagtagatggttagctgggaggaaaaatggaggtcttgagctaacacatcctgtggttgaatgcacttttcagcatgacaggtgctcagtgacatggaagagtcattgctctaattaccccatttttttttctctctttctgattaggtaaggatgtctgataatctgtatgttttgccatattttctgtttcatagattttttaagtattttattgttggagtcactaatatgtgtctaataattttgattggtagtcccattgctgtctacattgctgtggccttggtgatctcagatttgctttgatttaaaatcatgtatcattaattatgttctgttatctttcggaagagttaatttaaaggcaaacagcatcatcatcaaataattgagggcttgttaactgcttccagcttgaagccagcaaaccttgcgaattacagtggcctgctgagggggcagatgcctctgtggcattgtcaaaacagtttcctaggctgtctctggttgcttttctgtctttgaataagggaaaaagttttttggagacaggggtagtcttgaaaagtaaaaaatactgaagaacccaatagctatctaatatattgatgcttttacaaagttgtcttactttatttatttatttaatttttttgagatggcgtctcactctgtcgcccaggttggtgtgtagtggtgccatcttggctcactgcaaccttcgcctcctgggttcgagcaattctcctgtctcagcctcccgagtagctgggattacaggcgtgtgccaccatgcctggctaatttttgtatttttagtagagatagggttttgccatgttggccagtctagtctcgaactcatgacctcaggtgatccacctgccttggcctcccaaaatgctgagattacaggcgtgagccaccacacccgacaaaagctgtcttactttagacttgttgacaaacacactggaatcctggctacatgataggctttttcaataacttactatgtgacttttaagaagttgcttcccctcctgagttttattttccttatgttttaaaacaaaggagtggcattaaattatctctaaagaaattttgtttgaaatgacatagaggatttcatcatagtgtttgtcacgtactaaatatttaggtagctgttttctgaggccaatgttatgtctattgatacaacttttatagagtaaaccaaaacattctaaatataggaaagataaatgattaacttatttagcttcaaatatatttaaaggatacattgcattggaatttttttattctatcagagattaaggtttactataagattggttctttctttacctctagtttgaaatgggaatactgtatttctgtgaacatgagtacgttaggccaggtcagcaggcttagactctgttaaactctctcctcttaccatgactgctccctgactgtgtccttaaccttgacaatggcagaacagcactgctgctgctgagaaaccaaacctagatgcaagcttgcccacctgatggttagtcaatggaaaaacatttgcaatgggaactagctcttttataaaagttgcttataaccatcatcccaccactaaagtcacttattcttatcacctctgtgtctgagtatgccacctgtcagtgtctgtgtgtctgtggatgtgtggatttgcacatgtgcacttgtgtcctcctactctgcactactcctgtgagacttcggagtcctgaatgggagggctgtgttttcgaggctgggggcactgcctatatgggcaaaatttccccccaaaggcctgttctttggcagctattctcatggggctcagcagcctttcaaaaagcatggggcttccagatccagaaataaaccaggagccacttttaccaccttatctgtcttgaagagtcaagttgaatttctgaaatcggaggaagctttgtataaatctaatgtctacctaatcactggaattttttgtccacctccaagactggataaatctatttttgggtagggcagcaggagtcactgaatgaaaggtggacaaatggttcagatgaacagtggcaagagtggttgtcagaggatagaggtcatgtgcaagaagggaatgtaccagattgggtaaaatggcagaaaacattgcattaagccagggaaaaaagaaacccattcccttttcctatcttaatgggctggattctttgcaggtctccttttcccttcataaagctggtaccccatggacgcattgcatcctcatcactttcttagggaatcagaacaaagctacccacctatcttactgctggagtcctgtgggaagtcatctttcattctttctgctgtcaactgcacatacagccaccatcctacttgagggagccctgggaataagtgcatttgatataacagttttaattttccatccaaaatatctcaaattaaagagattttataagccagcgtaatgtgttgcctatacagtgccacttctggtttaaaaaaatcagtgtttctagctcttttgccaacataacatcaagctactgttggttgactactctttttttttctgttttgcttgaattgactgacatttgaggtattgaggagagacagcctgagacccaaagctgacccattaactcccagatgttcacgatttccgaggaaatgttctgtgcctatggttactgttctgatgactccttgaacactctcatcttggcaccttttgcacttgctaaattcaatttgaagaaagaacaaaagacagggaaaattttgtggaaagcaattatcctgcacttttatgaccttcatgtttttcccatcatgatgaattttggggttagcacttgtatcagtcagcatgtagctttcactagaattttgttgtgtgttacagataaccagtcgtatctaattaaacaataatgatgccagtacaaggcattttctgggaattaatgaccagctgggaaaagctgatggctggagagtcagccaaaggctattagcttcagtccactattaatctccagaaatgtcaatttgtgacatcattgttggtactgagcaatgaaaatggaagacagtttactgttatctgtcacgtacttctgaataacaaattccttatgcattgtcaaaaagtcattttttctcttttatcctccaattgtccttcagtcttataatatgttttctatacagcagtgggtgaaaatggaatttctcagtttccatataatcatgggtgcttctttttttaaagagttccaatttggggagttttatttaaatattttggatggtaaaactagaatttgtcttcagctgtgatgctggaatttgatgagtgtctatattatcataactatctgctcatggcaggaaatggttacaaatgttttgaatagcagctgttgctagcaaagatgtgcattcaacaacgagattctaagaagttatagtcgcattcctagtagatgaagggaactctctacggaaaaagctatcgtggtgtgtctatgtaatatttttgattgctgctgctgaatgctagagggaaatagagaactgactaaaatatcagcatcaccatcttgcataatttaatgagttataaaggaagacaacaatccctcatagagtcaatctattaagaacttgttctaaactcataatactaatttaaaagttatgttggtttttatactattttttccttgacatgaaaggaaattcttaaagccccttaagatcccagccaatgagctaggaatgttttacccaacacagaagcttcatatcccatctaaattcagccaccatttgtttatttatttatttttttttttacaaacaccacggcattattcaccccacaagaaatttgctagtagtatcagtcctcctacatgcgtgttaagtgtatgcatttcgggtagtagaatgagtcagctcgtcattaatcaaagctttggaggcactgactcacttctggtgaaatggaatggcctcattgggaagggtgtgaaagaaaacaattcatgctggggtcagttccctgtttctgaaaatgcagatcaaatttgcacctattttcatggaaggttttcagaatagagaatgtagcagtgaaccctataaaggcaaatatcttgcttttgcagggaataaaaataatagtgatacaaaaacactagtgatacacttaggaagcatataaagagcctagaaagaaaaatgtggactgagaggatcctggtgtatacctaaggccaaaattattaaaccaggcctggctcttttacaatccaacaaggtagtcctttgaccaagcgttgtttcgtaggctctcagctggaatctcttgtcttcattaaggggttttgaacatctgaagaatgtttgcaacagcttcagttctctttggaaatcaaaagagtaaagagcagtgactgattcttctgtctgtctccgtgtatactgcttggaagtaaggccctcaccaggagcagaccaagaaaagaaacagaagcaaatttactgataattggtggatattagccagtttaacctatgaatacttatattgtactcaatctgaaacctataagttctacatggtgtttatttagatacaacatgagcatccatattaaaatacgtttttgcactttgggtatgatttaacactgttttcattgtactagcaacagaggtatatatagtcgagtagctatttccacggctttagtattttaaactaagcccattaaaataaaatcgccaagctattagatgtttttctttgaaacttttcttagggctgttgtttctttagtcttccctgggagtatatttgatttaagacattcgctgcttttctgaggctctaacttgagttcattttgttatgtggtgaccacagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaaggtttgtgcacgacagacgcgtgttttgcttgttttctctcattcttctttctttctctttcttttggattgtgcattgccctctggtgtgctgtgtgttgttcaggccctgccatagctaggaggccccctggctggctggtgaaagtgttatacagtctcagatgggacgctgtataatatggtcatctctggcacagcgcacagcgtcaccctgcttttcacagctgaaacattttcagttgctgtcattttactgccccatttgggctggcaaagttgcttgcttctgtagccaacatctggccaattctgttcccatcaccttgcattcctgaagcagcagtcagctgaggaatgaaacttctaaaatgaaataatgagaagattgtttcaaaaattttcaactctccttcactccataaagcttttgcattgcacttgaagaatgctcatgatctacttagtttgctgaagcaggcccagattacctgtataatgcacgccccgttgcactttgccatggtaaaatgcatgcctcaaggaaactatgagtagtttgttttttcttttcagctcaagtacaggtttggacaactctacttgctgttacttaaactgaggttaataaggtactcattgcaatccatatcacaaatatatcttcaaagtatttcatctggccagaaatggtatttattcattgtttccaacatttttgcatctatcaaagagaaatatttttcacattacaaataaaatgtggtaaatttattgccatctgtttacattccagcttccaaaataacttctgagaattataatgtaaatgctaatacttgttaaacagcccattttcccctcacattaaatatcactgaggcagtttaccaatgaataacatttggaagtgacaaaattcacctgttctttggcagttggtgtatacttttgcattagtggtttttgtataatttctaaaagcgaccttgtttctatttcaagttgcccttttgcatcattatgggaatccttatgataattgtctttctgatatgggagagactggcatgtgggttaaaattcggtgagtaaataaatttctccaaatgcactctagtccgtagttttggaagcaaaacttcacaactcaaagtttccccttttcttctttccaaatagagtttaagacaatcattggcagaaaatgagaagcctacatgtatctgtgtttaattcagccatagaatagagcactcatatttatattctacccatacttttggtgtctaaactattcacgttgagtgtgaccaccgacttccacatatattcatctggaggtataaatggtgaacttttacagtgagtaaaagcaatcatttggttgtttagtggagaagataactaactttattttgtactttaatgaaacaaaaaaattttaaccagtgacaattactttactatatatactacattccaatattttctgctttctttactctaaaaattataaacacacacacacacacacacacacacacacagtttttgtacttgcaaatcagcctaaaaatcaaaatttggtttcgttaagaaaaataagccagttaagaagcagctggttaaattcgctcaagcaatcagttacataattaaaatatttttaacaatatttcagattttaaaaaacagttaagaccccattccttttattattacatataattttgacagaatctgttattttcaagtaccatctggagtgtattgtaaatactgttatgaatattttcagatatagagaattcttaagagaataggtagcagttagactctcttctgcaaagttaggtagtttttgatctgtcatttaatccacatattgagctgttgccattgtgtttaatggggctgccatcctttcacttgtgtactgtgatgatgggcattgtcttctttcagattggagattttcctcagtcttgccctccttccaggtcctcctgccacgatatcaaagctaatatttctgtctttattcttatgaatgatttgtaactagtattaaagtcagaggttttctgggatgacatttaaatactatttgcaatcttactgtaccccctcaaacaagatcccagaatctaatgatgaactcagaccttaaaatgaaaacacttgatctctacacaagttaacaggatccagaaggctttagatgggggcgaaagaaaacatgctgtggagctgatcttggataaataaggaaacattgccaagaacttaacatgcttacttcatgtaggatatcgaagctcatcatttccaggaggcgaagtaactatgggtttggaagggttcactggtcattctggcaacctggaagatttttgcaggactgttttttaattgccgtaagttatagtgttcggttccctcttaaggttgttgtgacattttgttataattagtagaaataaaagacctctttttttttttttaacaaatggatagtgttttgcatttaaactatgtctataccttgaaacattttattgttacgtgaaacattttgaagagatactccctgtcatggcctccgtgccaaaacatgagaccttaattgaccttggctgtggatgctcaccaattctacagcaggtgaaggcaatggacagggtggttaaaccatacattgtttgatctatgcaatgcccgtatgctagtataacctcttctaatgagattatttttttatgcaatgttaaaacccccaaatgaaaaattaaaaaaaaatttttaagccttttggggaaataaatgtttgaattgcgtaagctttagaaatgattaattaaacaggtttatgtgtattgtgatacagttggaattactaaattgataaaaattacccaactcttttttaattagtatagataaagtcttgctgtttcttttgtttggcagtggtttataagggctgggctgttttcatagtttatgacctcttaagatttgctacagataatttaacattgtttatagtcacccatctttttatagatatttttgtcttacgtccagggccctcagaatccatataaaataatacacaaagggactgaaatatctcactggcttttcaggatacacgaaggccaaattacactttgccaataccaggtttctatttatgaatatccaattccaaaaaaatttttaatctgttccaaacatttgcgattttcagtgacatgattatttctataaaaaccacttatgatataatattatgtgagtgctggaatttggctgaagaagtgcacacaagtatctgagagtctaatttggcccagtaccagcaatgttctttgttaaaagaaagccacatggagagtggagatcattaccaaaatctttttcttaccgctccaggagccttttggcaaaagaaagtataagcttcatagctttattcttttgttcactttatcttcctatggcatttgtgccaaaatgaaatcactaatttagagtaactcctggaagccaatctaatattagcatagttgtcatttcctaaatgccactccttggacttttactgatgttcgaagattgttaaagagaatcacaccaagataaatatgcttgcaagtagatagtgttggaaatctacagggaaaaataaatcatggattcccagtgtttgcttttagggtttaaaattctgattacgatagtaaatgtgaagaaattaatgcaacataggaaagtactacagagcttggtgatttgtcaccatctttttatcaggcatttgagctctttgctatagtcctgttttcatgtgattacacacacacacacacacacacacacacacgcacacgcacacacacacacattctgtcttccttagggcattcgtaacctttttattcagagagccatccaaccattgcggctttggttggagaagagaatctgtgctggagattgatgataaagtatggcagcttccaccaaccaagagaaagcaaaattacatgctaaatggtaagggggtatatttgtaactaccatgtctgttactctgataatgcgttgggttattccagaaagagcatacatcaccatgaatatcagtcttaccttaatgatgggagaggaagaagtcagaggaatgctgaggaacatgctgagggaaatgtttttcatcttcatgttttttcaacattgttgttttcctgttgtgccttcctcatcttaatgctaattttcctttcgagaaaaatgtgtcagcattaatttgaattaatagttgaataaaactaaactatggttattaaatcattttgtcactaagctagagttgggtaataacctctgatgcttgtcagctgaaaatatcttgactttcaggaaagacataactaggttccatgtctgtctcctttagaataattgaggggacattcctattctgttagaaaagcatggggccttggtttgcatttctttaattatcagtgataatgagcttttttttttctaatgtgtttgttggctgcatgaatgtcttcttttgagaagtgtctgttcatgtcctttgcccactttttaatggggttgtttagtttttcccttgtaaatttgtttaagttccttttaggctctggatattagacctttgccagatagacagattgcaaacattttctcccattttataggctgtttgttcactctgatgatagtttcttttgctgtgcagaagctctttagtttaattaaatcccatttgtcaatttttgcttttgttgcaattgcttttgatgttttcattatggaatctttgcccatgcctatgtcctgaatggcattgcctagattttcttctagggtttttgtagttttgggttttatatttaagtctttaatccatcttgaattaagttttgtataaggtacaaggaagaggtccagttccaattttctgcatatggctagccagttcacccagcaccatttattaagtagggaatcctttcccaactccttgtttttgtcaagtttgtcaaagatcagatggttgtaggtgtgcggtcttatttctgagttctctattctgttccattgttgtatgtgtctgcttttgtaccagtaccatgctgtaccgttacagtatactttgaagtcaggtagtgtgatgcctccagctttgttctttttgcttaggattgtcttggctatgcaggctctttttggtctcatatgaattgtaaaattgtttttttctaattctgtgaataatgtaaatggtagtttaacaggaatagcattgaatctataaattactttgggcagtatggccattttaaacatatttattttttctatccatgagcatggaatgtttttccattggtttgtgtcctctgatttattttgagcagtggtttatagttcccttgaagaggtgtttcacttcccttgttagctgtattcctaggtattttattctctttgtagcaattgtgaatgggagttcattcatgatttggctgtctgcttgtctgttgttggtgtgtaggaatgctcgtaatttttgcacattgactttggatcctgagactttgctgaagttgcttaccagcttaagaagcttttgggctgagacaatggggttttctagatataggatcacatcatctgcaaagaaagacaatttgacttcctctcttcctatttgaatacactttatttctttctcttgcctgattgccctggccagaacttccaatactgtgttgaataggagtggtgagagacggcatccttgtcttgtgccggttttcaaggggaatgcccccagcttttgcccattcagaatgatattggctgtgggtttgtcataaatggctcttattattttgaggtatgttccttccataactagtttattgagagtttttaacatgaaggggagttgaattttattgaagacctttgctgcgtcattagagaaatgcaaatcaaagccacaatgaggtaccatctcatgccagtcagaatagtgattattaaaatgttaagaaacaacagatggtggtaaggctgtggagaaataggaatgcttttccactgttggtgggaatgtaaattagttcaaccattgtggaagacagtgtggcaattcctcaaagacctagaaccagaaataccatttgacccagctatcccattactgggtgtatacttaaaggaatataaatcattctgttataaaaatacatgcatacatatgttcactgcagcactattcacagtagcaaagacatggaatgaacccaaatgcccatcaatgataggctggataaagaaaatgtggtatatatacactgtagaatactatgcagccataaaaaggaacgagatcatgtcctttgcagggacatggatggatccagaggccattatcctcagcaaactaacacaggaacagaaaaccaaacaccacatgttctcacatgtaagtgggagctgaacaatgagaacacatagacacagggagtggaacaacacacaccggagcatgttgaggtgagaggtatcgggggagggagagcatcaggaaaaatagctaatgcatgctgggcttaatatttcggtgatggtttgataggtgcagcaaaccaccatggcacacatttacctatgtaacaaacttgcacatcccacacatgtacaccggaacttaaaaagaaaagcatgggaccatgtgttctggtgactctgaagagataagaagactttgttctcaacctttttatttcaaagtcacttttttctttcatgacttagggccaccctgcctttgatttatgacctgaaggatcacaaaatgacacaagacaattttctttgctcattgaagcaaatggcagcttaattgcagagtcacaagaaagataaaaaaatattagtccaaattaatgccagaaatctggtggccttggtcattagcagtgagtaaacactatcctctccccacaaagtatttaattctatttctcttacagcttatgtcctgataacattagtaaaccagcaatggcaatgaaacccattctttcttcccccttatttcccctaccttatggcagcaaacacaaaatgaagtcatattttggggatagtttctactctctggaaaacttacagtctaatcaaggagtatgtatagtagccagtaattcactttcatgataagatggacatttatcattctcttattgaatatatgcatctccattcagtctctaggctggaggctggcttttagagtacaaactaataaccgttcgttctttaaaatatcattcactttttaaagcaactgacctcccctctcccttgagcttatgtgttccaatcatggtggtggtttccttgagacaaagttgtttctcctttgtaactctcttggctgaagtcttccttagttaatacttggagcagacatttctcctgtatgaagccagcactgatgacccgtttcaggcatttatgtttaaagtgacacttatctgcgaaagtgctttgaaagttctactagatgaatgacagtgtatgctggtgattttgattttaaaaagtcaaaatcaaagatacttgaaaacatctggaagttatacatccatatgggtgcttcccctttcaaggccaagacatcagggattgtgttggcaacatgctcttgggatgatgtcttgccaacttttctggagtttttttctcttcccagccagttggtaaaccacttaagaaattctgccttctggacccagcatggtatgacccagctaggctatgttccatgtccataaaggcatagcctgaaagactggttgattccccaaatcaagcccaatcctgatattagaagtctacgtctattaaggagatgcacaagaatgttctgctccctctgctccaattttcaccctgtcttttgttttaaatgacaattcacttgcctggttgaagagaatacaggagtgaactataatctttttcacagattcttacatagttatcagatcaatgttttccaataatatttcatgcaacactgatcatatatttatgtaaaaagacagcatttgtggtcaaatatgtttcccaaattacacgccattcctagagagtcacaatgcatatgagtatatgaaagattttaaagagtcttgcagattaggaagctgtctaccttaggcagttcagtggtaaacagcatcttctagctactggacccttttactgataatacagatgaacatcttccaagtaacactttgggaaaggctctgctggctctactaagcagtgtgttctcatcaaacatgagctttgtcaagtagcacacttttgaaaatgattgctgttcccttcctctcgattcccacctactatcgttagagaaaggctactcaaatgttcttcatgtgtctcaagttctttgttaccaatccatgactagataaggatcttatgccagaaggtaaatcactgcttccttcatgaagaaaatattgctgtcttgctgtgaaaagtaatgtcagctgaactaaataagaactgtattaagtaacatagttcacagactagtgctatgtttgtgtaccatacattgagtaacactgctttagattagtgattctcaaacttggctgtacattggaatcaactgaggatatttaaatactactgacgcctgagctcaacatcaaaccaaaaactgacaatcaaacaaacaaacaaagaaaacctgcaaaatctcttgtcgtgcttctggtcccaagcatttcaaataagagatactcaacttttagttactagtttttatatggataaaacatttcattctatgtcctcattgtatattttttcttgagaagaaatatttcttgagaagaaataattaagtaaaaaggactttataactggaaaaaaatttattgtggtagcggctcaacaggggtacttttttttaaaatctatctaagtgattctaatgtgctaacagggttggaatcactgccttaggaaataatcaccttggcataaggtctgctgagtgatgtcagctgtcaatccaggaatcttatcatgctgattgcatgggcctcttcaaaaggtgccctgtgatagagggctcagctggagaggcagcccttatatgacctttagaacttatggccatgtaaggtatccgtctttcccaccatgtgcacacacacctttctgaagttcccttacttgtttgccactctgtgcttttagaaaaataattaggattctccataagcgtgtggtaatctgccaccttgtgaccaacattctttcttgcaagcaattgttgaaacacttgttctgctctcagaatctgatgcagcttgcaagtatgggtcaaagagtttctcagactgtacttaaacaagaagatggagaaggagaaaagggtgtcacgatatgccagaaaagtactgacaattctttacttgattgctactgctctagagtaagattgcaaagcttgactcaagcagcttgtagcctgtgtatctgtctctgtgttacaccagaggctgtcatcgaggcattgccctcttatcatctaaatgtaatcggctactgcagcataaaaggattacagcagcccatatgtgaaacttgactctgacatgattaggaggctttaattgctatccatgtttataaatcattcctagcattttaaactacgtggattctgatattcatttcttatactctacggcattttttagtgtgcttaagaatagcaccttcaataatgaccactgtgaaagcgttaaacaagagacattatattctgcattttatcagcacttgcccttgtcttgcctcacagccaatatccacactcactccagcacatgaaaatcacttgtccacttccacccatgtgctagcaaatttttacttatgagccctagctattttaagatatatattctcagaagcatgtccagctttggaagcagcaagtgtacaatggccccaagactatatctacaaaagggaaagggaagagagcgtacttccactgggccacatcttcagtgacaacactgtgcatagccccttagaagcatgatcacgaaaaccctgtcagatagggttgctactaccatttcacagatcagcaaactaagatgcagaaagagtaagtcacttcaccagtaaatgagaggacttgatttgaacctaatttttctggcttctaaaagccatgccttctcccctccatggcttctccatatgctcagtttcccccctcttgctccataagtgcatttgttatctaaaacaaactgtagtgctaaaaagtgatcttaagtgtaaaggaataaaattctgtctacagtccttcctcagctttgtgacagcaagagtttgtcataagcagaagggactcgactcaggaggtacttgctcattctgtaggcctaagattaggtagagtgcagcactcaaaaggaagagatgaaatgacccttacctttaaggaactgatgacttggtcccggcatacaaagaaataatggagtgattaatgaatacttaaattcgatttgaatgcaatagatctgttcctagataaaagatattaaaagctcacttgtctactctgctttctttaggctagggaatgtgcctttccacctatgtgttagtcagttctcacactgctataaagaaatacttgagactgggtaatttataaagaaaataggtttaagtggctcacagttctgcaggctgtacaagaagcatgatgctggcatctgcttagcttctggggaggcctcaggagacatttaatcatggcagaaggcaatgctggagccagcactgagagaggtggcatcctttttacgatagtctgtccacaaatacagggagactcgaggaaatgacacatccatattgaaattatttgcttcttctctctctttccgtgcatgagcacaggtgacttgccctgaattgggtgtaaaaccttcacagaggacttcaatggggcaggagctgtctcagttgagctccaccagagacctgccattgctctcataatggcacagttgattctgtcccttccaaaagcacaaaacactgggacaagggaaacatgcccctttgtggtcgctagttgccattcaaagagggtttgaatacacacacacacacacacacacacacacacacacacaaatggacacatattactatttaaaatagtttatttgggggaaaaaacacttaaaagcagaatagtacagctcacatggttcctctactggagtcctttctacgatacatccagcccaacaaagcccagattaatcacagccctctatgggataatatgggctcaagcaagccattcatacagcgaggacatttgtctagcaaactgcctcaggctgtgaacaaaatcgggttctttttaagcaacaaggaaggaacaaagggcatttcaaaaagtggggattatagaagctgccagcaagtaacttttctcttatgttccttcttcagccatttcccctctgtacttacttgatttttctctgagaagatagcatttagaatccatgttagaagattcatgaactaattcagtaaatctctaattggcatacatggtaagctgttcacttagtggataattggttaaatgtacccagaatatttagtgagggagaaaaaaaatccccaaagcaaatcagcatagtttaggaaccttttcctctagtgccgctttttctttgtgaatggctactggtgcttaaaagtggtctctctcccttcccagtcaggactccatttaaatatacaacctccattgcatccctacttaatagagctttattaaatggataccataagcatagcacagtgtctgtcaacagtaagtgctcaatgaatatttattattacaaataacttatttatctaacacattttgatattctgtgttcaacggccatttgctctaattccaggtggcaaatgactgagtgcttctcatcaccattagcagaattgatatatttgttaataggtgtttattgagtgtcttgcacaagccaggcattatggtgggtaggcacagcatgataagacagattacatctctgccctcaaggaggaattaaagactagcaggaaagcagacttagaactacttgattatcaagattgtgttgcattcaaaaacactctaatacatagtggcttaaacccgctaaatatattttatttctcttgggctataggttggctctgtggttctgctgatctaagctgggcattgcttatccttcctgggctcaacaatatatttgtggtcagctggtaaggcagggtggcattgactgttctatgatgagtttgtacaggacacctcagctctccatgtgtttttcaagtcttatttatctattttaatattcatttattaatttttttcattgaacatttactgagcaacttttctgtgtgtcaggcactatatggccttgcatttcaattgctcaggaatgagttctatgctggtaacacacattcagtattgttagcctctggccagtattaaaaccatgaaagcagatgagacacatagggagagagactagagaagcaaggcctggggcatagaaacattgtaagatgttatagagaagaaaggactccagaagaaaaagaaggaaaaccaaaagaatgaggtctaaggaagccaaggaaggactcggcttcaggaaggaggaatggatcagtagagctgaatgcggtaaatcgttgctaatttaatacaatcctttcatatatcccttttagcatctaggctttgtaatccagttcctttcaatgtagaacagatgtctctgcctctcacgctcttgggaataaatggcataaatcactgaaatagttaaactgacccttgatagatagagtgatgaggaattagatgttgtctaactgctaaggaaagagtaggtctttgtaaagatgtcatcgatttttcttctctataatgcctgtaaagtttaaggctttggcaagaccaatttattcttttgttgtttatccttttgaatgtagttaagcttgctcggtaattttttctgtaatctaaaaatattggatcactgagaattaaaattaaatcaccccttgagtttggtattttaaaactgacaaactttgaagccacattaatatgatacaatcaagatgacattacatgtgtttccaataaagcaagttttctgccaactttacaaacgtgcacttttgctagaaattgattccttgtctagcagtgaacgtttcttgctgaatgaaagaagtagtgtttaaaaagaacaaatacacagttttgtggtgaagaactgttaacaatatgatatagagtctatgtaattaggctaagtttttatctaggatttgtgaatgttgatcctaaggaaatgataacttcctatgcaaaatatgatgaaagttttctgtacagagtgtcccactcaccaaggtcaaatgctacttccttagtagcctcaagggaggaaataggctatgtgtttttgggattaaaaaaataagaaattaaatgaattcatttttcatagtgtaaggtagagtgtttgggaaaaaaattctttttgaaggtctgtcctatgtatttgaaggtttttttcccttgcacttggattgtcccttaattcagactgtattaggatactacccatttctaaactaacatgagagactagagcttttagacactttttgctgactgccctttttcctaagacaggagaatgtcatgacagaaaatactgcattcccaaaacatctattgaaataaaaaaaatgtagaaagaaaatactgcattcatggacctacctctagcagcattccattttttccttagcatatccaatactacttttctccctgaatttgtttaaattaaatctgtgctgagacaggatcttgtgctttgattataggttggaatctcaatagtggaacatgtgagctaaccagggagcttgtgaacccctttgatatcctgtcatccttttctcacctatgtggtaacctagagaaaggactttgaagaagaaggagaaatatctctgtaggtagatggaagaaggttacatttaacatgcgaactgaactttatcttctctcttgtttagtaaaatcactgctggttggaggagcagggagtggacactgggaaaatcagaagccaacctgtgcccctacagtgctccagagctttagtatttattacatttatggaatgttacctattttttttctacatagaaggttttaacaaatcaagcaacacattctcatacttgataatgaataacattggcttaaaaattacaccaaattatcatgagaagcacaagtgagacctaaaacccagtgagcaaatctgttagtgattcttttcagctgtaaaaattagttgagatatttatttttccttcagtcagtagtgccaggctctgtgttgagctagagcaggatttctcaactttggtgctgttgacatttggggctagataattctgttgtcaagggctgtcctatatattgaaggatattgagcagcatcccttgactctacccactagatgccagtagcaccccatcctagttgtgacaactcaaaatatgtccaaatattgccaaatatcccataaggagcaaaatcaccttgttaagaaccactgggctgtgtaatacctatacaaacaaaacacatatattctgaaaattactctgcttctttgagagccagtcaaaatacttctgtttcatcataaccaaggttctccatccttgggttactaaggtagtagtttcaacttaattcaaactccgccttactcttcctgatccttcccctgcccttctcaaacctttaacttatctcagctatttatacaaatataaatatatttatattatataaggctctccagtagagctcaatgcagtgatttggtataagaaaactgaggctgcttcgggttaaattccactgtcattgaatgagttacaacttggtttgttccctgtgtctactataggagatctggagaaatatgacagagtccctgccttttaggagcttgacatgaaaactctgtatatgaaaaggaatgtaagtcagttatatcatgggctcaggctcaaatataagctcattcagaaaaatcttttcattgctgtccttttagaaggcttctgctcagtctagcctttcttcagcagggctgatgatgagcagaggtgaaggtattcctcaagattttatttttcatgttttcatatctagttcaacattgaaaaacttagaacattcaagctaactattcagactcgactaacattgggtacctataatggtgccaggcactgggctagttgcttcactcagtatttaatctttaaaataactgccaaaatgaagcatcactttttccttacctcatcctggttcctttacactgtcagcaagtctatgagatcaggaaagaaggaattttggaattttcacataatattttgggggacatgcagtaactaaactcattaaaattcagagaaattaatactccaaaagactatcaaagaatagaattaagtttacctcttagctaatttaatgtattttgatttattttttcaaaagcaattgtggtttatctggttcctgtttcttagctttgattttgttcctttatcgtagtaaagtgtcctcagtgactcatgttactttggataaggtccgttccttccttgagtctccatatccttatatatatataaataaaaaaaatttttaaaaaggattggataggtactgaattctcttattttgtatatctcaagatagtttaaaataagactcaatttgttattatgtttcctgacaactttatgcatagttaaaatggaaattcaactaatagatatggttgaagtctgacttcataattgtttcaagtttttgctgcgttggttgagcttgaggggaggtttcctggccatataatgatggccgtgggcttctcctttttcacatttttgctgaaactcgtgatcttaattctggactttgagaagattaaagcctaggcatgacctggtatgggcacagggagaaggaaaagtaacattttgtaagtacttgcctgtcttccttttgaaaattaggtaatatgatcgaattagctaagtaacttacccaacatctcaccattagaaaatggggagatcgaagtacaaaactatattctctttccaagccacactctgtttcttccaaaagggagactctcaagacctgccatatggattaggaggtaagcatacttttcctgttaactctgtgacctgttaactcttccttttagtgcctcaaatcttgacttcagggacctaatgctttcatgaacctaatgcaaagaaccccttgctttgtgttattttgtggaagaataatttggagcaaagaaaatcccctcaccataggcagaaagtcagaaactggaagcaagagaaaatgcttggttggtagaccaccaccctggccactggacttcgtacctttatatcctgattcaaaatggtagatatcaattttaacatcactcctcaattcaccagcccctgtcttggggcttccctggcattcatcttctacctatatttccttccttcccttccagataacacaatgagagtcaggtatggggaggctttattctgaaaggaaccacatctgttttcactttccctttttcatttagatatccactgttttattattgttttattatgatttcccctgtagagaagtatacagtggcagggcgacctgttgtgcatattgaattttacccttcatttactccaatgtttgcctatttctgctagaagctgaacagcaatccatattctccctgtgtgtaaactgtttctggataagcattaggtaccatggcgggatgtttgtttatccaactgaaagtctaaaggttttcaaactccccagttctcttttaggtggtagcctattcatagaatcagcactgctgatttatgagcaccatagctgctcagatctctaatatttctacagctattccaaattccagtagtttagataatggaggaatttaatgaatagctagagaaacatacagatgttccagtttcagtggaaactagagaaacttgtagaatattgcctcaagtcaggttttcatttcacctttctttacccttgtccccagcatctgacattggattaagagcagcaacaccatagccaccattgctaaagtgcaatctgggccagatatcacctcaagtttctataatctcgatagaaatgctagaatgtagatattttatcccatttttatacagaaggaaattgagcctcaaagactttaggtaaggcagaactgaaaaccccagtaggtgttaaaaaatataatgtgatttgaattttgaactataagttttctaagccagatggcttttacatctggggtgttacctgggttactgacttgaactgttgtttaagatgtgactaaacttaaatttatattctctattgacaaaacattttattctagagtaattgctgtactagatacaaaaacactgcattggtaaatcttttgttagctgtaaagatggtagctgcatatgtatgcattcaaatctgcttgttcataaatagaagacctgatttattaaagattttcatatctgacattttaacttgagatttttcactttcctttttctgtgaacagcacggctcatctctgtaagttcaaagtttgtcaagttcataactcttaaaaaccttgcacaaaccataacctcgccctttgccttcccagatctattcccgaaactgtcatcttgatagattcgtggaataacccttccttctcaatttctcagcacttttctgaccccctctgtcttagtctgttttctgctgctataaaagaataccatagagtggaaaatttttttttaatgatttatttggcttaccattctgggagatgggaagtccaagaccgaaaggccacatctagtgagggctttcttgctgtgtcataagataatgaaaggtatcatatgacaaagaagtgtggagggatgaaagatagaggaaattgaaccaaacccatccttttatcaggagcccactcctaccttaactaacctactcctacaataatggtattaattcattcatgagggtagagccttcacgccctaattaccttttaaaggtgtcacccataaataccatcacattggcaattaaatttcaacatgagttttgggggacatattcaaaccatagcattcttctcctagtccctcaaaattcatgtatttctcacatgtaaaatagattcattccatcccagtagccccagcaatcttatttcaataccaactcaaatgttcaaagtctcatctaagtcatatatgggtgagactcagggaggcaaattcctcaggcagtttctctccagctgtgagactgtgaaatcaaaacaaactgtctactttcaaaatacaatggagggaatggggaatggccaagaaggctgactagaagctccatagctctcaaagagaggaatggaaaggacagtaaacacagcaccttcaactgaaacattcaggtactcgcattgggactaacgaaggaaacaactcaacccatggagaacaaagaatgacagcccacctgagagtgacacagaaccaagtgaacctcccccacccaaggaagcagttgagtgaatgtgtgaccctgggaaaccacaattctcccatggatctttgcaaccctcaggtcgggagatcccatcgtgaatccactccactgggaccttcagcctgacacacagagctacacggagtttctgcagagtagccactcaggcacatgtggagacccaggagctttagatacgccagcatttcaggcttctcagcaaaagtaactgcaactccagcaaagtgggaggttggacacctgtacatacccctagaaaagaggctgaatccaggggaccaagcagtgatagtctgtggacaccacttccactgtgcctcacaggataagacccactggtttagaattccagccagtcaccagtagcagtattgcacctacctgggacaaagctttctgggggaagggtggggcgccatgtttgctgtttgggcaacttagctgatccagactgtaagctttggagagtctaaacctaccaaggtttgaagggatcccccagcacagcacagctgcttatcaaaacatggccaggctgtttctttaagtgagttcttgctcttttcctcctcactgggcaggagctcccaactggggccaccacccactcaagccagttttctctggccaacagagatttgaaaactccctgggacagagaacccagagtgaggggcaggctgccatctttgctgtttaggtgacatagccagtccagcctgtgagctttggagagtccaaactgacaggggacagaagcagtaccccagcacagtgcagcggctctacaaaagcatggtcagacttcttctttaagcaggtccccagtactcttcctcctcatggggcagaacctcccagccagggcctgcagccaccccgactggtgttccctggtctacagagttttgaaaattccctgagattaaactcccagaaggaggggtgggctgccatctttgctgtttaaacaacttagcctccagcttctgcagagccaaagctgaccaggagtggaagcaataccacagcacagcagagtagacccacgaaaatgtggtcagactgctttttaaagtgggtccccaaccccatttctcatcaccaggtggagcctcgcacctggggtctctggctacccctaatggtgttctctggctgacagacgtctcagctctccctgggatgcagctcccaatggtaggggcagaccgccatctttgctcttaggaaaacttaaccattccagtcttcaggcttcagcgtgtccatggtgaccaggggatgaagtggacccccagcacagcatagcagctctacaaaaatgtggccaggctactttttaaagcatgcccccaatctcattcctcctaactgggcaagaccacccaactgggattgcccgccacctcctatacatgtgtttaggctggcaacaggtccatacctccctgggatggagctaccagaggaaggggttggctcccttatttgctgtttcacagccttcactggtgatacctccaggtactggcaaatccaagtctactagaaactggagcagacccccagaataccacaacagccctatggaaaaggggccagactgttaaagaaaaaaaaaaaaaaacccaccaccaaaaggtcagcaacctcaaagattgaaagtagataatttcacaaagatgagaaataataataatcagcagaagaaccctgaaacctcaaaaagctagagtgccctctttcctctaaatgagtgcatcacctcttcaacaagggttcggaactgggctgaggctgagactgagatgtctgaaatgacagaaggagaattcagaatatggataggaatgaagttcactgagctaaaggagtacattgtaacccaatgcaaggaagctaaaaattatgataaagcattgccggagctgacagacaaaatagatagtatagagaagaacataaccaacctgatagagctgaaaaatacactacaagactttcataatgcagtcacagctattgattgccaaatagaccaagtggaggaaagactctcagagcttgaagactggctttctgaaataagacaggcagacaagaacagagaaaaaaagaatgaaaaggaatgaacaaaccctttgagaaatatgggattatgtaaagagactgaatctgcaaccgattgatgtacctgaaagagatgaggagaatggaaccaatttagaaaacatatttcaggatatcatccatgagaacttctccagcctagcttgagaggccaacattcaaatttcaggaaatgcagaggataccactaagatactctacgataagatcatccccaagacacataatcattagattatccaaggtctaaatgaaagaaaaaatgttacaggcagctagagagaaaggccaggtcacctaaaaagggaggcccatcagactaacagcagacctctcacttgaaaccctgtaagctagaagacattgggggccaatattcaacattctctctctttttttttttaacattcaacaatcttaaagaaaacaaattccaacctagaatttcatatctggccgaactaagcttcataagtgaaagagaaataagatcctttccagacaagcaaatgctgagggagcttgttaccaccagagctgcctcacaagagctcctgaaagaagcactaaatgtggaaaggaaagactgttaccagccactacaaaaacacactgaattacacagtctgtacacagcccagtgacattatacagcaccacataaacaagtctgcaaacataatgatgacaggttgaaatccacagatatcaatacaaactttacatgtaaatgggctaaatgccccaattaaaagacacacagtggcaagctaaacatcaaagacccattggtatgctgtcttcaagagaactatctcacatgcagtgacatacacaggctcaaaaataaagggatggaggaaaatctaccaaggatatggaaaacagaaaaagtagaggttgcaatcctagtttctgacaaaacagactttacccaatgaagatcaaaaaacaaaacaaaacaaaaatccgcatcgcataatggtaaagggttcagttggacaagaagatctaactatcctaaatatttatgcacccaacacaggaggacccagattcataaaacaagttcttagagaccttcaaagagacttagactctcacacaataacagtgggagactttaataacccactgacaacattagatcactggcacagagaattaacacagatattcaggacctgaaatcatcactggatcaaatggacctaatagatatctacagaactctccaactcaaaacaatagaatatacgttctcatcactacatggcacttagtctaaaattgatcacgtaatcagaagtgaaacactcctcagcaaatggaaaataactgcaattataacaaacagcctcttggaccatagcacaatcaaatttgaaatcaagactaagaaattcactgaaaaccatataattacatggaaattgaataacctgatcctgaatgactttggggtaaataataaaatttaggcagaaatcaagaagttcattgaaactaatgagaacaaagatacaatgtaccagaatctctgggacacagctaaagcagtggtaagaggtaaatttatagcattagatgtccacatcagagtgatacaaagatctctagttaacagcctaacatcacaactaaaagaactagagaaccaagagcaaacaaatccagaagctagtagaagacaagaaataaccaaaatcagagcttaactgaaggagatagaaacatgaaaaaccattcaaacgatcactccatccaggagctgttttgttttttttttgaaaaaaaataagtaaataaaatagactgctagttagactaataaagaaggaaagagaagattaaaataaacacaatcagaaatgacaagagggatattaccactgaccccatagaaatgcaaacaactatcagagaataggatgaacacttctttgcacacaaaccagaaaccctagaagaaatggataaattcctggacacatacaccctcccaagactgaattaggaagaaactgaatcccttaacagaccaatagcaggttccgaaattgaggcattaatagatagtctaccaactgataaaagtccaggaccagagggattcacagctgaattctaccagttgtacaaagaagagctggtaccattcctactgaaaatgttccaaaaaattgaaaacaagggattcatccttaactcattctgtgaggccagcattatcctgataccaaaacctggcagagatacaacaaaaaagaaaacttcaggccaatatcctcaacacaaaaatcctcaagaaaatactggcaagccaaatccagcaagcacatcaaaaagttaatccaccatgatcaagtaggctttatatctgggatgcaaggttggttcagcatacacaaatcaataaatgtgattcatcacataaacagaactaaagacaaaaaccacatgattatctcaatggatgcataaaaggctttcaataaaattcagcattgatttatgttaaaaactctcagtaacctaggtatcaaaggaatataccacaaaataataaaaaccatctataacaaagccactgacaacattatactgaatgggcaaaagctaaaaacactccccttgataaccagcacaagacaaggatgccctctgtcacaactcttattcaacgtagtattggacgtctcggccagagcaatcagtgaagagagaaaaaataaagcacctccacataggaggagaggaagtcaaattatccctgttagcagatgacatgatcctttatctagaaaaccctagtctcagctcaaaagctttttaagctgataagaaacttcagcaaagtctcaggatacaaaatcagtgtgcaaaattcactagcattcctgtacaccaacagtcaagccgaaagccaaatcaggaatgaactcccattcacaattgccacaaaaagaataaaatatctaggaatatagctaatgactgacgtgaaagatctctgcaataagaatcgcaaaacactgctcaaagaaatcggagatgacacaaacaaagggagaaacattccatgctcatggacaggaagaatcaatattgttaaaatggccttattgcccaaagcaatttatagattcagtgccattcctattaaactaccattgacattatttatagaactagaaactattttaaaattcatatggaacctacaaagatcttgaatagccaaggcaatcctaagcaaaaagaacaaagtaggaggcatcatgctacctgacttcaagctatatactacaggactacagtaaccaaaaccacatggtactggtacaaaaatagacacgtagaccaatggaacagaatagagagcccagtaataagtctgcacacctataactatctgatcattgacaaacctgactaaaacaagcaatggaggaaggagtcactattcaataaattgtgccgggataaatgactagccatatgcagaagtttgaaactggaaccttttcttacaccatatacaaaaatcaactgaagaaggattaaagacttaaatgtaaaatccaaaactataaaaaccctagaagaaaacctaggcaatatcattcaggatataggcatgggcaaagattttattatgaagatgccaaaagcaatagtgacagaagcaaaaattgacaaatggaatctaattaaactaaagaggttttgcacagcaaaataagctatcaaaagactaaacagacaacctacagaatgggagacaattttggcaagacatgcatctgacaaaggtcgacatccagcatctataaggtacttaaacaaatttacaagaataaaaacaaacaaccctattaaaaagtgggtaaaggacatcaacagatacttttccaaagaagacatacatgtgaccaataatcaaatgaaaaaaaaatcaacatcactggtcattagagtaatgcaaatcaaaactacaatgagataccatgtcacaccagtcagaatggctattattaaaaagtcaaaaaatacctgatgctggcaaggttgtggagaaaaaggaacacttatgcactgttggtgggagtgtaaattagtttagccactgtggaagacaatgtggcaatttctcagagacctaaaacagaaataccattcaactcaacaatcccattactggatatatactgaaaggagtataaatcaatctattataaagacacattcatgtgtatgttcattgcagcactattcacaatagcaaagacagaatgatagactggataaagaaaatgtggtatatatacaccatggaatactattcaaccataaaaaatgagatcctctcctttgcaggaacatggatggagctggaggccattatccttagcaaactaacacaggagcagaaaaccaaatactaaatactgcatgttctcacttataagtgggagctaaattatgagaacacatggacacatagagggaacagcacatactggcgcatttcagaaggtggagggtaggaggagggagaggatcagcaaaaataactaatgggtacttggcttagtacctgaatgatgaaataatctgtaaaacaaaccctcatgacacaaatttacctacgtaaaaaacctacaattgttcccttgaacttaaaataaaagttaaaaaaaaaaagaaatggaatagcaaggaaaaaataacaacatacaatggaaggacaggaatagaatatatattcctattctaaaatggagaaataggcaggaagggttagttgtttcaaataattcccaaacccagcagggaaaacatcattaaatttaaagctggagaataatctcctttgactccatgtctcacttcttggatacactgaggttgggattgggcccccaaggtcccagaacgttctgcctctatggcttttctgggcccagtctacccagcagctctcacaatttggagtctcatgcctgtagctttcccagtatggagttgcccacttgtggccccatagttcttgattctctgaggttgcctttctcccatggctcctctagtcattgccctagtagtctctctgtggtggctccacccctgtgacaagtttctaattaagcccccaggcagtccacaacatcctttgaaatataagtggaggaagccatctctacacagctcctgccttccacacacctgaacaattagcgtcacatggatgctgctaacatgtatggcttgtacgttctggagcaacaggttgagctgcacctgagctcacttgggccacagctgggttggccaggggacactgtgctggaatgtggggagaatagacccaaggcatccttaggcagagagtccatggaagatgccctaagcccttcacccaaaaccattctgccccactggtgctcttggactttgatgagaggggcagcctcaaagatcttcgagatctttgaaatgccttcaggatatttctcccattgtcttgacaagtagcacctgctcccttcatttatgataatctctttagcaaatggttgcttggcaatacctttgatttgctctcctaaacacaccttttctcctactgtaggagatagcttaaaacacacacacacacacacacacacacacacacacacacacacaaacaccccttttcactctttacatggccaggttgcaaattttccaaacttttctgttctgcttctctattttaattataaattttatctttaagtaatttcttttctcttacatctcactgtatgtggttaaaagttgccaagcaatagcttgaatgctatactgcttagatatttcttcagccagattcaccactcttaaattatgcattctataaagttctaggacacgtgcacaatcctgccaagttttttaaaattatataacaaggatggtctttactccagtttccagtactttgtttctcatttctctctgagacatcctcagaagggtctttactttccctatttctgtcaacattctgatcataatcacttaagtaatctctaagaagatttgaacttctcctatagctctcctcttcttttgagccttcaccagaatcccccttaacattctattcacagccatctaggctttctctagcctgttcctccaaattgttccagcctctgcccattacccagttccaaagctacttccacagttttaggaatttgttataacaacattcccgtctttattacccattttctgtttttatttgttttctgttgttaaagtaaactactacagactgggtcatttataaagaatagaagtttaagccaggcgcgatggctcacgcctgtaatcccagcactttgggaggccaaggtgggtggatcacctgagatcaggagtttgagaccagcctggccaacatggtgaaaccctgtctctactaaaaatatacaaaaattagccaagcattgtggcacacacctgtaataccagctacttgggaggctgaggcaggagaatcacttgaacctgggaggcagaggttgcagtgagctgagatcatgctactgcactccagcctgggtgacagagcaataatctgtctaaaaaaaaaatagaatagaagcttatttggctcagggttctgcaatctgtgaagtcaaagattgagtggctgcatcttgtgaggaccttcttgctgagtcaaaaaatggcagaaagcatctgccttagtccattttgtgttgctatatggaatacctgaggctggttaatttgtaaagaaaagaggtttatttggctcagagttctgcctgaacaagaagcatggcactggtatctacatctggtgaaggtctcagagtgcttccactcatggaagaagcagcagaacaggcgtctgcagagatcacatggtgagagaggaaggaagagaaggggaagaggtgccaggctatttataacaaccagctctcttgggaaccagtagagtaataactcaccccccagggacagcattactctattcaagagggatctacttccataccccaaataccttctactaggccccatcttacaacaccaccatactggggatgaaattttaatatgagatttagtggggacaaacaaaccatacccaaactatagcagcatcacatgctgagaaaacgtgtgtgtgagacagagaaaggaaattgggccaaactcatccttttatcaggagcacacttctgccttaagtaacccattcctgttataacagcattagttcatttatggggccatagcacacatgacataatcacctcttaaagtttccacctcttaataccatcacaatggcaattaaatttcagtattggttttagaggggatattgaaactattgtactctccatttaagttcttatcacttcctgctaaaaattaaaggattttgtcttcccatagagggaatgtcctgtgtctttttcctggcacgtagtaggtgcccaatacatgtttctgaattgaagaccacaatgctactgttttataaagcagatggcgggggaggggtgcatacaaagtaaatggaaccttctgatacctctcaatgcaaaaaaaaaaaatacttctaataattggaaatattgactgttccacaccattgttaagggcatgttagccttactagtaagtggctttcacagaatgtgttgcacaataagatctgtctcttgagtgctgttttaccttaatggagatttttttttttttttttttgagacggagtctcgctctgtcgcccaggctggagtgcagtggcgcgatctcggctcactgcaagctccgcctcccgggttcacgccattctcccgcctcagcctctcgagtagctgggactacaggcgcccgccaccacgcccggctaattttttttgtatttttagtagagacggggtttcaccgtgttagccaggatggtctcgatctcctgacctcgtgatccgcccgcctcggcctcccaaagtgctgggattacaggcgtgaccaccgcgcccggcccttaatggagattttaaaatgcagagtgagcaatagattcattagttaatcgaggcaactagcctccacatagaatttttttgcaagttactttgggttaaagacatttgggttgctgattgtattttcctgtatttttaattctgagctgtgagagtccattcatatatatcgttttctcctagtgccttctgccgattgcaattacctataatgtaaaccactgtacatgatattctgaaggtccttgagaatttgtcgtcaccagtgtattcatgagggaacattccactagaattaaaacaaagaactcgtagctgaacaaacccgggttttaaccccacctctgccacttattagctgtgtgattggaggaaaacaagcataaaatagagacaatgataagattcaacttacagagttgtcttgaggattgattaagcatagtgcctataacatagcaagtaatcaataaagggaaattatttttattacctttgtttatgattatgatgatttagctctgagtgattcttttaacttatcttgccatccttaagcttatacagtcattgacatgtaaaaatgggccttcagagtcctcatctgtttttagccactcgcaaactgctcactgggacctatcttatactttgcttctagaatgattcctgagtttcacatattctgttcctaacacttaataaattctagctattctaactattgttaaaattgcctttacagcagcatttcctaatatgttacccaaatgaaatactcacctaggaaagttcccaagagtaaaaactatttgagaaacaggtactagccataaccctgccctggaaattttcactgtacattagaatattaaataatctaaacagtcctatatgatttattttatgtatataaaatcatttccacagttacaaagtactgcctccccccatgaaagctcttctgtgctgctgtcttaatttctatattcaggaccctcaacattctttcactctctttctacttcaggagtgtccctcaatacgcaagggcatgaagttgcaatcactgggatccagccacagcaccgcagaacaacctgatctgttcattagaagtttccagggagttgcttctcaatgcctttttctatcttggatacaaactcttctagcattagaacatgctctggtagctggcagacttttcctttgataccattgaatcttaaaatgtagccaatggaacaggaagtggaatctatatagaggcggctatgtgccataaatgctcccccatgttacaattcctgatgttacaagccttatggcttgtctttcagtttactgtgctttaatatacctgtgtaccagtgtagtgccataagatccttgttggaataaaagttacttaaggtatgtagctattgagctaggatctcttgggtcataagtaaatgccactttattactatttgagtatttggatttataaagaggtaaatgggagtgattattcaatttgctaatagatccactgaaagattgctttgtaatgctgttccaaagtatatttaaataagcattgattcatatgcacctttctaagatcaaaccattttattagataaaataagggattaccttatttgattccatcccttagcagcattcttaggatctgattttctgtttccgtttagtcggcagatcatgaagaggctttcataactggaatatatattgtgaaatattaccatgtagatctttcctttaccacttgagaaatgcatactttaaacatgtgtttctgtgttttatattctgtggaaagatatcataatttggtttcactttggatagattttgtttgaaaattataaatgacttttatggaaatgagttaggaatttaaggggtgtgccaaattttaggccacctgggtgccattagtatattgtagacatatgttgtctaatggaattcacttagcctaaaagaattaagaggtttccggaaatagcaataacctaatgcattgggcaaggcatcctaaaactagagttacagcaccatggcacatggttctgtggaaaatagcacatccaaatatttcagaaaggatagatgtaatgatcttctagaaaggatctttatgaatcagaaagctgagctgatggtgactgagagcatagatggctattcaatccagaaaagtttttctgtcagatgctatctctgaatgcccttgcccacattgtgagacccataattggaggtctagacgtcctcataggttgtcccagtgtagctgaactatttctttattgcctaaggagttagaaactccctatttaagaagccatgtaattaaccatcctagggtgagttttgctgccaccacagaaccaagtatagtgcagaattttgtacactattggtaggaagcctaaaattccatttttgtcatactgccactgaaaaaactatcagcttatcttcatgagctaagagtgaggctgcctattaatatcatttgcttacatatttaacatattatatgctagtcgctgcactttaaatacatgattccatttactgctcattttgcgaatgagaaaactgaggcttagaaaggtaacttgcctgaggtcacacagcttgtaagtagcagaacagagactcaaacccaggcaatcagagtccagaggtcaagttcttaactatagcagttcattttcagagggtctgtgtgcttatcatgggggcctggaaaagtaaagaatgaaagagttgctttttcctttgaagtaaaagcaagagaaagcactgagttatttttatgtagctgcacattatggacgactattatgtgccaggtaccaataataagtctttatacacattatttttgtaatcgccataagaatatcatgagtttgatcttaatgtttgtccttaatttcaggatgagaaatggagatgtggagtatgaatttgtgtttacttgcccaaggtcacctggctagtaaattggagctggaatttgaacccagatttgtctgactccaaagacaatgctctttaactattatgtatacatttccccagtaagcaactcctaaaacattgaaactgtcacaacctgtatggggatttctcacaactaagatgtcacagtgataggtaagaggaagagaagatcagtgtaataacagcccaaacatcccgtagccttattcagtgatcctagagtcatcctctttaaaggaacacttttctcatgtccttggtcctgtatgcataaaaaatgtattggaagctacctgtgtagtggaggaaatgcccagaggagaaaatggttgagcatgaatattgttcttacgcacgaattgaacagggcatataattcccttgaagcagaaagacattgttccttttccttaggggccatgaaactatagctaagtgaaggaaaaggaggtgagttagagactttgtaacatagaaaatcctagccgtgcccaatcacttttcttcaaagaccaaatgttaacatatcatgggctctttgaatatacttagaaggaatataggcaaaatttagtaaaatttggcctgtatttatggccaatatcatatatagctccacttaaaatgtactttttatctttaagactaacatattactgtcattatatatgttcagttatcccttaacttttgacctgcattaggtcagttttgaacaaaaagtatcgtagttggtcaggttctaattttttaggttatttaaaaagaataattctccctatttgctctttgccctgacaagtgagtaggtcaagtgcatttaggatacagctttgccactgaagtcaccacatcagtcattcagtcatgtatcttattgttttcttctttcatcttccacagcagatgtcctaaacctctgcaactgggctcaagcctttgccccatctgaagcctactcatcagatgaactgtcttgactttgcagatgaaagtccaggggaattcccttagcttccctcttctgcaccttcaaacttaccccatttgtagtcagcctccatcccattccccatcttagagaaaatgtctttcttcctgtgccaagttaatcctcctttcctttttggtatgtgctgtggatcacattcttcctgccccttcaattaccttgatctcaatcagtcttccctctcttacatttctagcttcttccttctcacttcattgactatgctgtctttcaaaatataaatatgctcagataaaggagctctagagactggatgactattggtgctaattggcagggataggacatgcaagaaaatgagttacaggttcactcacatgcttcacctattccctatataaaaataatccatcagtttaatgttctgatctcttaaatggatataataatatgggcatggtatggttcttttgaggatccgatgaaacagtgcatgtcacctcactgaacaatatgtatcaccaaacatagaaactagcacctagtaagtgctcagaaatgataacaattgcagtcatggtgttatttacagtacttatagtagtaatagcaggagtaattgtataggggaattgaactgaaatagattcaaggtgccccttgcttctaaaagtagaagcttgaatcccattgttgcaggacttttccttagctcagctacagatagggttcttgtcacatagccatgaaagattaggcttgcagacaatttgaagggtgagtaaggcagggttttattgggtaaaaaggaaaaaaaaggggaaacagaaactcttagtgaagtgagagagtgtgtttatcctgccagcgggcttcccaacttacagattgaattctgggttccacccagaaagaggagaggccaggctcctccctgctgcaaactgtgaacttctgtggccccaccctatcatgcactcctcctagtgcgcaggcgggctggagtctctctggggactccttcccacctagctatctcaccatagccccactgcccaatcctttttcacagtgtttaatatattacaactgtatctcaaccctctatcatctcctctcaaagcttctcttgttccagacacattggaccacttgacaatccccaaatcaggaggctgtgaactttcacgcctcctgactctgttcatgctgttccttcagtcttccccgcctttcccccttctccataacacctcgaatgatgttctctgatatgtgacactttcctcatctccacactactctgtgcagtgttggttatcccacagtctctatatgtactgtaccacactgtatgttcatagctgacttggttttccatttgctacacttggaactcccagaggacaaggatgagttcagcttggtatctccactgcctaggcattcagtaaaagcataatgattgtggtaatggacaacttctgtggcaccatgacactgcctgccaggtaaggaactgcatggccagtttaacaaaaattttgattacattattagagattctttatttttgaaattttagagcagttaaatagcaatgtcactttcctaaaatttcggattcctgtatctgttgcccttctttcaagcctgcagctctttgtaagtttcagtaataactctgtccacttgcccttccaagtttaagtgtgataacaactttatactcttgctcatccctgggagcttcaccacctcataagggttttgtgagtgctatctatacttctttaaatggtccctttattaaacactcttcagttattcccttgagtgtgctatctattttctgcaaggacactgcccatatgaaatgacccttctctttcagtgaacccaggtagcttttggtaatttgtttccatcaggttattgactgcccctgaggtgtctcgaaagatttctatcccattatctataactgtagtctgggaaagttgttgacaatccgtagcattactatgtgcaacaatgtaaaggtaagaaattgctttgactctcttactgtgaagaatatagtgctacaacctgtcctcatttctgcaggaggagataaacagaggccttctgtatgctttagaatgattgattctaaccaagcatagaaatcctgggcagaggaaaaaccacatttcttgacttgatcttgatcttttaggtcacttctaaacctgaggttgatcttgatttggtgtgtaatcatatcatgtcatcatcatcagatattttgtacctctcatatgtgaggacctataatgctagacacaaaaatgcagggtatgagccttggttctccttcccatattgaagaaactaggctatgggagaataatttgattatttttctttttaaaaggcttgaaattaactttctcttatactcttcctcctgtcattcaattttatcgccattgatccctccactctgttccatgtatttagtcacagaaccatagaaatctcttttaaagcaggattattcaatagaaacataatgtaagccacatgtgtaattttacattttctagtagtcacatttaaaaactaaaaagaaactggtgaacgtaattttgatcatgtatcttatttaacccaatatgtccaaaatattatttcaacatttaatcattataaaaatatttagtgaaatagtgtactttctaaatacgaagtcttcaaaatcttgtatagattttgtacttaaagtacatctcaatgcagatactaactactcatcagaaatattttgtatttcaatttcatcacatttatagctgaaaaagtagattgacattgcccaagtcgttccaggcatactcaaaagttttctgataactgaaccacgtacaggtttttgtatcgaaataaaagtttattaaaattttaaacaagttaaacattcagttgctcggtcacattagctacattttaggtgttcaagagccttatgttgctagtggacaccatcttggacaatgcagttataagctatctctagaatgtatctccttttttcacttcactaataaagcctaagatgaaggctttaccattggctgtttggcctattaccacattctcctatctagcctctttgtctttcattttctgccagcttacctcaggctgtcatgctccctgattcctgaggcattttggtaaatcacatatctggtcacataattttactgcttaagaattctttactgcccactgttgagtgaaatgcaatgcccaattttctgaatatgacttgctggaccctctctgagctggtccctgacaagcttcctagtgtcttagtctgccacccctcatgtatttccctgtactttaaatgcactggactattctccattatctaggagcaccatgcacaaacaaccttccacaaattcactctcactaatgtctcccaaattttgcactttcttcagaacccagatcaaatgccatttactataagaagctttccacaagcccttctatcagacagtggtaactttcccatgtatctctcaaataaaatactttttccactgcgttaccttcagatgtaagttgatttgtctcacgaactagtctgtgagctcagagcagaggttagcaaactatagcccgtgagccaaattgtgtgttttaattaatataggttttttttggagcacacctatgctcattcatttacatattatctattgctgctgtcatgctgcagtggcagaattgaatagttccaacagaaacttaatgaccccaaacccaaaatattgattatcttgccttttgcagaaaaagtttggctacctatgtcctagaggatgaggacactgtcttatgcatcctcagtgctaagcattgcactaggtacatgcaagttttcagtacatgtttgtggaatcgaacaatagataaattgaatcaaattgaattgatgagttttatgaaagttgatgtttctgtctgtaattggtaagttatttgaggacaggaatggttcttgctatttctttagaatgccttatgatatttaccttattgttagttactttataactgttcacttaaataaaagaatttttgtttttccaccttcattctttttgtttaatactatgtaccacctaccattttttctgtaatttctatttgattttacttgtttctcaaggatgcaaatggattaaatcctgagaagttgagtgcctccaatacacaattacataatggaagctgtgaactcaagtcttggcttgatctttggtctaattggctgcttcagataagccacttggcctaacttgttgtttttttctgaatcttcagtgcaaatcacaatattccaccttcaagttattgtttgaagtacatgtgaatgtgatatgcagttccataataagtattatgaacataatttttttaaataaagaaggtatttttctccactaaaaatggagaaataaacattatatgtgctgattttaaacattacttagagtcagcctccattattgaaagttttctgttttgggtaagaaactggtggccaccaatacttccatattaacaccaaaagaccatttggccatcccttttaatgtcatatttaaaaagcggaattctgaaagcaaacctgggaaatggcttccacacttgagccatacatttatgaatggagaacttgaagaacaagagcatacaaatctcagagaaggatctggaggctttatgatatgaaagcaaaaagtacaagagctgtcactggggagttccatttctataaggactttctatgtactagtagctagaagcattcattattcactccaacctccagccttatagtttatgtttctagcttgccttttctcagaattcttaggttaatgacagattctagttactgagcactactatataccatttatatattttgtttatataattgatatcttgtcctaaaaaaaccccactgaggtaggtattaatatttttaatttacagaaaaggatattgagcctcaaaaaggctacataagaagtaagtagcagatctgggttttctacctaagtctctagagcccatactcttaactaccatacaaactgtaagattttctgagattaaagcaatggggcttccgaaaaaaaagtttccatatggtgctttgaaatattctacctttttcctctgaagaatgaagtcctagagctgggagaggccagagaagtcacctgttaagaggctgaatgacttgcccaagttaacttagcaaaattagtggcccatacaattctctagcctcctgacacctggtctactgctctgtatactacatttcaatccacatttctggataaaaatagccaagtgcatacccattttatttttattttaaaattcatttaaagaaaagtatttctgctttgagaaaatgaaagaaaaaaaatgacagccctcccaaagtaaactaaggatgattcttttttaccaaatctttagggaatccagccagagatgccagcacataccgaattgcttgtttaagagttctgctgctgacagtctggggtgctgtgagcaaatctctaaatttctctgagccttaattctcatctgtaaaatgaagaacttgaactagatgaaatataaagtcctttctagcatatgagtgtgtgtgtgtgtgtgtgtgtgtgtgtgtgtgtgtgtgtgtgtgtctgtgcatatatatatccttatataactttaggagtatgattagataactttaggagtatgattaggaggtgccaggaccaattgaaggagatagatttgggctcaaataagaaattccttcgtatggacatagccttccttaagtagactgagataccgtaagtagtggtgaatttcctgtcattgaagttattcaagtagaaatggatagcaacttgttggaaatgtcatagtagtcattcagacattaaattgatgattgggttacaattatgattaatgttattccatacttcacactctgagaaatcaaatatgtagaaatctctaagcacaaccacaaattttaaccctgtgctcaactacacactcattcaacagtcgattattgagtacctttgaggattctaggtactgtgctagaactggagatgtcaagacttaggacattgcctctgtcttgagtgttacagaccaggagtgtgcaaactgtggcccaaaagcctgatctcacccactgtatgttttggtaataatagtttactggaacgcatccatacttattcactttcatattatctatggctacatttacgttacaacagaattgagcagttgcaacagagaccatatggcccacaaaacccaaagtatttactatgtgattctttataacaaaagtttgccaggccttgttgtagataaacatgtacatctgtaacttcaatccagtgacctaagtgggaaactggagaaaacataaaggcagcacatatgattacttcttcttgaacaaggatcagaaatttttcagaggaattaaaccatatcattgtgctgtctttgagtgggaagagacattacaggttataactgtcttcattttccatcagtatctctgcatattgcccctatagcattcatgacacaccactgacattttcttaaaaaggagagcatacatgcaccctacagataagtggcaaaattatataaagtttagcctgccaatttatgcaggagtgacagcaacatccataggttgcctttgcattctaaaataaattaagaaccagttatgttcatgttactgttttaatttaaaaccaaacaatttcagggtctttatctggttcatgctgaggacatcaatctataggaaactcttcaggaaataaaggactagggtccatcctccttcccatacagagggatggaagcccagtgtctgtggccattgttgttaccacaaggcggtatacctaagtcctattaagcaggactcacaagttctcaataatcagttttagggcagatatggaaaaataaccataataatcacatttgccctcctatcattgcagggcctcctgaagtgctatccacacagttgaaattctcaagataaatgttgttgactgattgactgtattcttccaaatttactaccaatctggagaggactacaacagtgtgattaatgatttgtaaaatattcttttcacttacatattcaaagccttaatcctctaattatttttaaaatgcaatgtgagatggatactatgacaataggggtcctgaatgctctcctaataagcagatgaaggtctccttagagcagggatgtcccatcttttggcttccctgggccatattggaagaagaagaattgtctttgagccacacttaaaataccctaacagtaacaatagctgatgaggtttaaaaaaattgcaaaaaaggtctcataatgttttaagaaagtttatgaatttgtgttgggccacattcgaagctgtcctgggcctcatgcggcccatgggccatgggttggacaagcttgccttagagaaaaacaaatcatttgttaaagttttaattttgacatgatttcagacttccagaaaagtcacaaaaacagtactctatagtacatcagtttcctattttttgcaattacaagaaatgctgcaataagtagccttgtgcttacatattttcatattgttggtgatacattttcaggataaattctgatgagtgcgattgctgggtcaaaatacatatatttttgttaaatattgccaaattcccttcagaaattttatatttctaccagcaataggaattgtgcctgtttcttcacagcctcacctacagagtaggttgcactatttaatttttgcctgataggtgagaactagttatcagtgtagttttaatttacatgtccttttttatgagtaagggtgaatattttttcataaacgtaaaagccattttaatatctcttgtgacttattttcatatttttgatcattgttctatctgagatttgtttttttatccccttgaattttaagaattctttgcatattagaggtattagccatttatctgttatatgtgtttcaattattcctcctcttttgccagttatcttttgatttctttatggtttctttatggtatcttttgatttctttatggtaattttgggcatgcattaggtttttggttgttgctatgtagtcagatttaacaatcatttgttttattgtacctggatttggagttctaattaggagaactctttctacacccagtttaagaagaattcacccatgttttctcctagtgtttgtttggttttattgaacaattagatccctgatccatttggaatttatttttatttttactttttttcttcttttttttttaaattatactttaagttttagggtacatgtgcacattgtgcaggttagttacatatgtatacatgtgccatgctggtaatcatggatgtaatgtatcttttcctaaatggtgtccattgttgcagtatcatttgaaaactccatcttctctaaagttatttgagatgtcacctttattatatactaaagttccatattttcttatgtctatttctgaactttctactctatttaactgggctctattgatgtgtcagtaccacacctgcattttttttcattttttcccgcagctttttttggatataattgaccaataaaaattttacgtatttacaatgtacggtgtgacattttgatatatgtatacattgtgaaatgattacgtcaagctaattaacatatgtattaccttatatacttattttttgtggtaagaacatgtaagttttactttcttagcactttttaagtatacaatgtagtattattaactataatcatcatgctatatgtaagattctttgaacttatttctcctatctaatccaaactctgtactctttaaccaaccccatcacccctccccagcccctggcaaccagcattctactctctgcttctatgagtttgacatttttagatttcatatataagtgatatcaagcagtattcatctttctgtgtctagcttatttaacttaacatgatgccctccaggttcacccatgttgctgcaaatgacaggaattcattttattttaacactgattattgtttcattgtgtatatagaccacattttatgtatccattcacccactgatggacacttaggttgattccatatcttgagtattgtaaataacgctgcaatgaacatgagagtgcaagtatctctttggcatactggttttatttttttaacgtgtatccagaaatggaattactggatcatatgatagttctatttttaattttttgagcaacctccatactgttttccatgatagctgtactaatttacattcccactgaatgagaacacaatgatattccctacatcctccccaacacttgttatcttgtgataatagtcattctaagaggtatcaagtagtatctcattatgattttaatttgcatttccctgataattaggatgtcgagcattttttcttatacctgttggccatttgtatgccttcttttgggaaatgtctacttaagtgctttgctcattttttcttttggttatttgttttcttgctattgagttgtttgagttccttatatattttgtatactaatcccttaaatgtatggtttgaaatttttttttccattccataggttatctcttcactctgttcattgtttcttttgctgtgcagaagctatttagtttgatgcaatcccaacaccctttaaattatagatgatttatagtatgttttactgtctagtagggctagtacctgctcatagtttatcattttttgtgtgtttcactggctattgttaatttttccatgtgaggttcagtgacaacttgtctaattctaaaaataacttattgttatttttattgggattatattaaatttatgaattaatttacatatttatactattgagtcatcctatcaaaaaacaagaaatgtctttctatttcttcaagtctactttcctttcctttatggatggagaaaatgtaaattaagaaaaatatagttttgggattttgaatttatacaggatgtgaaaagtatatttaacaagcagaacatgtgcatatgtaacaagcagagaagaacaaattttctccactgccattctaattatattccaagatagaaatgtcctagtccttcctttattcattcatatattctcattggtgactccactgaagccagaaaacatacttaccaaaaccaatgagaatactcataagagatgacagtcatgactgataatactcaaaattcaaaaccatcttaacagtctggaatgatcaacctaaactcaacaagtggagaaaattctgcactgagtcttaaaagtggaattgcataggtgaaagtcaggaaaaagttgcttcaactgcattacttttgacatctggaggaggtatctagattgactgcaaacttaacagagcacggtatttcactgtagcaactgttaaaatggtatgtttatccaagcttcattaaatgggtatcagtagcacatcattgccctagagggtggatcaagaagcagcagaaaagtaaaacaaggaggcaggtgttgtttcaacttggatttcctagtaaagtttatttgaccaaagaatttgagggagagaagaaagagagggagaattagaatgaaggaatggacaatcatagagcaacaacaaaagcagagagctcagttaggaagctgttggtgcagtaataagcagagtatgaggtgctctggctagactccgcaatgatagtggagattatgaaaagttatcagcattgtggaagacagtatggtgattcctcaaagacctagaaccagaaataccatttgacccagcaatcccattactgggtatatactcaaaggaatataaatcattctactataaagacacatgaacatgtatgtttattgcaacactatttaaatgcccatcagtgatagactggattaagaaaatgtggcacatatacaccatgaaatactatgcagccataaaagggaatgtgatcatgtcctttgcagggatgtggctgaagctggaagccatcattctcagcaaactaacacaggaacagaaaaccaaacactgcatgttctcactcataagtgggagatgaacactgagaacacatggacacagataggggaacaatacacgccagggcctgttacagggtggggttgaggggagggaacttagaagacgggtcaataggtacagcaaaacaccatggcacacgtatacctatgtaacaaacctggaaacccgcacgttctgcacatgtatcccattttttttagaagaaatttttttaaaatccaaaaaatttttaaaaagaaaatgttacaaatcttattcatgtaaaaacatgtgtaactatatttcccaacttttctacatatggaatgtattatcacattggtctaaaatcaaggtataaccaagatcatcaggaatggagaggtaggaagtggtataagagccataaattctcctttttccatagtgagacattaacagataccatcaaaagtggaaaaatttggaggtaaaccacttaaaaagtttaaatgataactagatgatgaaccaaaaaccaaagactattcaaaacaagtgcctcatatccaagagaaatgaaaacatgtccacacaaaatcttgtacatgaatgttcatagcaccattgttaataatagcttaaaagtggaaatgactcaaagttcatcacctgatgaatgggtaaagataatgtgggctgtctgtactactattatgataaaaactgaaatattatgcatgccgcaaatggataaactttgaaaacattatgctaagtgaaaggaaccaatcacaaaagaccacatgttgtatgattccacttatgtgaaatgttttagaataggcaaatctagagacagatggtaggttagtgcttgcaggggctgggaggaggagggatggagagtgattgctaatgggtatggggtttctttttggggtgttgaaaacattctaaaattgattgtggtgatggttgcaaaccttgtcaacacattaaaaaccactgaactgtaaaaaaaaaaaagaaagtggttggatttgtaatatattttataggtagaattaatgagatgtaatgatggattggattggggatgagggaacgacaaaaataaagggtaaagtttagtttttgtgattgaacaacctggtggatggtggtgtcatttactaacataggaaatactggagggaaagtaggatagggtacaggtgggactggaaatctagagtcctgttatagtcatgtccattttgagatgtagaagtttgacatagagctacacagttaattactatacagtgtctatcttaaaagagcccctagtcttgttacagaggcagaaaactatttttttattcttttttattattattatactttaaattctagggtacatgtgcacaatgtgcaggtttgttacatatggatacgtgcgccatgttggtgtgctgcacccattaactcgtcatttacattaggtatatctcctaatgctatccctccacactccccccaccccacaacaggccccggtttgtgatgttccccttcctgtgtccgagtgttctcattgttcagttcccacctacaagtgagaacatgtggtgtttggttttttgtccttgggatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgtaataaacatatgtgtgcatgtgtctttatagcagcatgatttataatcctttgagtatatacccagtaatgggatggctgcgtcaaatggtatttctagttctagatccttaaggaatcgccacactgtcttccacaatggttgaactagtttacagtcccaccaacagtgtaaaactgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataagtgtcttcttctgagcagtgtctgttcatatccttcatccacttgttgatggggttgtttgattttttcctgtaaacttgtttaagttctttgtagattctggatattagccctttgtcagatgggtagattgtaaacattttgtcccattctgtaggttgccagttcactctgatggtagtttctttagctgtgcagaagttctttagtttcattagatcccatttgtcaattttgtcttttgttgccattacttttggtgttttagtcatgaagtctttgcgcatccctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatgcttatagatgtgtggtattatttctgagggctctgttttgttccattggtctatatctctgttttggcaccagtaccatgctgttttggttattgtagccttgtagtatagtttgaagtcaggtagcatgatgcctccagctttgttcttttggcttaggattgtcttggcaatgcaggctcttttttgtctccatatgaactttaaagtagttttttctaattctgtgaagaaagtcattggtagcttgatggggatggcattgaatctataagttaccttgggcagtatggccattttcacaatattgattcttcctatccatgagcatgggatgttcttccgtttgtttgtgtcctcttttatttcgttgagcaggggtttgtagttctccttgaagaggtccttcacatcccttgtaagttggattcctaggtattttattctctttgaagcagttgtgaatgggagttcactcatgatttggctctctgtttgtctgttattggtgtataagaatacttgtgatttttgcactttgattttgtatcctgagactttcctgaagttgcttatcagcttaaggagattttgggctgagatggggttttctaaatacacaatcatgtcatctgcaaacggggacaatttgacttcctcttttcttaattgaacaccctttatttctttctcatgcttgattgccctggccagaacttcaaacactatgttgaataggagtggtgagagaaggcctccctgccttgtgccagttttcaaagggaatgcttccaggttttgcccattcagtatgatattggctgtgggtttgtcataagtagctcttattattttgagatatgttctatcaatacctaatttattgagagtttttagcatgaagggctgtagaattttgtcgaaggccttttctgcatctattgagataatcatgtggtttttgtctttggttctgtttatgtgatggattacatttattgatttgcatatgttgaaccaggcttgcatcccagggatgaagccaacttgatcgtgatggataagctttttgatatactgctggattcggtttgccagtattttattgaagatttttgcatcaatgttcatcagggatattggtctaaaattctctttttttgttgtgtctctgccagattttggtatcaggatgatgctggcctcataaaatgagttagggaggattccctctttttctattgattggaatagtgtcagaaggaatggtaccagctcctccttgtaactctggtagaattcggctgtgaatccatcaggtcctggactttttttgtttggtaggctattaattattgcctcaatttcagagactgttattgttctattcagggattcaacttcttcctggtttagtcttgggatggtgtatgtgtccaggaatttatccatttcttctggattttctagtttatttgcatagaggtgtttatagcattctctgatggtagtttgtatttctgtggcattggtggtgatatcccctttatcattttttattgcatctatttgattcttctctcttttcttctttattagtcttgctagtgatcttgttagtgattttgttgatcttgtcaaaacccagctcctggattcattgatttttttaagggttttttgtgtctctatctccttcagttctgctctgatcttagtaatttcttgccttctgctagctttcgaatatgtttgctcttgcttctctagttctttccattgtgatgttagggtgtcaattttagatctttcctcctttcttatgcgggcatttagtgctctaaatttccctctgcacactgctttaaatgtgtcccagagattctggtatgttgtgtctttgttctcatttgtttcaaagaacatctttatttctgccttcattttattatgtacccagtagtcattcaggagcaggttgttcactttccttgcagttgagcggttttgagtgagtttcttaatcctgaattctagtttgattgcactgtggtctgagagacagtttgttataatttctgttcttttacatttgctgaggagtgctttacttccaactatgtggtcaattttagaataagtgcgatgtggtgcggagaagaatgtatattctgttgatttggggtggagagttccgtagatgtctattaggtccgcttggtgcagagctgagttcaattcctggatatccttgttaactttctgtctcgttgatctgtctaatgttgacagtggggtgttaaagtctccctttgtcattgtgtgggagtctaagtctctttgtaggtctctaaggacttgctttatgaatctgggtgctcctgtattgggtgcatatatatttaggatagttagctcttcttgttgaattgattcctttaccattatgtaatggcctttgtctcttttgatctttgttggtttaaagtctgttttatcagagactaggattgcaacccctgcttttttttgttttctatttcattggtagatcttcctccatccttttattttgagcctatgtgtgtctctgcacatgagatgggtctcctgaatacagcacactgatgggtcttgactctttatccagttttccagtctgtgtcttttaattggagcatttagcccatttacagttaatgttaatattgttatgtgtgaatttaatcctgtcattatgatgttagctgattattttgcttgttagttgatgcagtttcttcctagcatcgatagtctttacaatttggcatgtttttgcagtggctggtaccagttgttcctttccatgtttagtgcttccttcaggagctcttgtagggcaggcctggtggtgacaaaatctcttagcatttgtttgtctgtaaaggattttatttctccttcacttatgaagcttagcttcctacctccccatacatccaagctctgcttttaattgttttgtcttgagtttcacatagtgtttcagttacataaactgaaatttgctgttgtaaaacgtaaaaataatagaaaataatcattcattttttttttgctagtaacatcagttttatatcactggggcatcgactataaagcctggctgaaggcagggccggccctcaacagattacatagttagagtagggtctggttcaaggtctggtgagtctccacattcttttccttgggactattcgtggtcttctctagcttattggtggccttctccaattttgctgtagacctttttgtaaattctgcttgagtctcaacccccttcagctttttctccaccaatttgatatcctctgcgtatttacacattttcatggaatattccctctctaaggccctcagtgccttgatggcctagtccatggcttgaagtttctcctccagctgtctggctcagatcttggtcacctgagctatctctcctgagtgatctagttttcctccccagatcttctcctcatacttcatgggctggtatttgatgaacttcatccttctgtccctctcattggctacctactgagtatcttccagcttttgcagggctacagccagatgcacctgtgccagtcaagctcctcttctatctgctcaatgaggcgttttatagagaccacatttgcctcagcaacagtatccttatcttcctgttccagtttctccaagatatcattcatgaatttaaatactcttctgtgtcatctcctgtccccttcagattcttctggaggccctgctgctcctcacccagctgtttgtagcagtcttcagtttgcttctcattggctttgacttcctcgacggggttggtggcattatccttctccacctttagcgtctgaattttcttattgatagtgtccatggttacagtggtggatgggccacctggcacgcagtgaggatggggcagattttgctggctccactgactgagattcacgctcctaatatgactaaagtctttcaataagttgggagattttttttcagaattgttggctgcttctgaaacataagaaagtttatttttatgattaggtaagttatatagcagaaaaaatatgaattttaaaaggagaataaaccttcaaagttaacaacaaaaatgactagagtaagatgccactgaactaaatgattaagagaatattttggaaaactatgttattatataaggatcttattttcattaacctagttattcattaacagccatttattaaacacccatactgagtcaagtgccatgcttcatcctagggtcacaaagacgaactagatgcaagggttgtagacttttttaatcaaataataagccataccaggttttgagtagtgacccagcattcccctttctctttaggattaaaagtgggagtgaaaaaagggggagttaatcaaggggcataaagtttcatttaagcaagatgaataagatctaaagatctgctgtacaaccttgtacccatagtcaacaataatatattgtatgtgtaaaaatttgttaagagggcagatttcatgttgtgttcttactacaataaaataaaattttttgaagaaaataaatgtttttgaattggttatatcctaaaatttacagaatttaactggcctttatgcttttttgaattatgcaatttttgtttctcattccaactacttagcagatgattgattagattgtagagcctaaaatattcccccactctcacccttgacttcagattgctggagcacaggtccaatcaaatgttgcatttaaaaaaaatacaatccatgcaggcaatttaatgaaagcatcagccatttttgtagttagattccttcctaaaagtatgggtgtgcttatgtttatcacaattttctcaattcagttaatttcaaggttaatctgccaactgtctgaacatatggcaaagtattttaaatgggtttaagggaaggaaatgatgagatttcctcagacatcaatcttagcatctgatattaccttgtatatttattttccccaagttaccatatatagatgatttttgttatccgtatctgagggtatttatataaagttgaatgtgtaggaagttatacatctccaaatttgtgtttacaaaacatggataaacccaggtcaattaatatttcacctgcttaaagcatctgccttttcaatttgattcgtgtcaagaaataatttttataagatagttttatcctgaatgaatcatgataccatttagtattaactgctattatccatcttcaccctatgatcaatctgatatttcaatatttatttaaaataagatgggatcttttagaccccacattctgaaatgaagttataagactgtaaagaatctgtttctaatattaaaattgttttaatgtatagtttagtggaaaagacagtctgaaaaatcaaataatcatatgtttccaagtttaccacaacatagtacaaagaaagattgaatgtgaactgttttttaatatacttatacagcacagacttgaatcgcaaggcggccttctaaaaataggacgtgtgtacttacacaaatataacctaagtcaaattgcatagtgacctatcatgttaatgattccccatttataaaccaggaagatctcaatattatatgtggtttcaagtgtatgtgtgtttgtgtgaatgtgtacacatcccacagaaacatacataatattggaataattcatgctgaagaattatggttaaaagtgcattcattgaacaattaatggctccaaataatgattgtggccacataccctgggaaactggtgcacagtgaattgcacagttcaggtgaaggtgacatatgacagataatgatggtggcaggaagagctgtgacaatgagatagagagcattttctgagaaaatataatgccacatttgaagaatttagctgtccatgagaataaagtgaatggttctgataaggtcaggaaaacgggtttgagaggataaatcagaagcagagtgcttgctgtttaacttcagtgccttttccttgttagggagctaaggatattttaagtgaatgaaaaagaaaatgtaaattctgtgggagcaaagtgtgtcaggtttttaaagcatattaagtctaaatgtggtaatgcattcctcactttggaggggtcacctggagagctgactcctttcagaaatgatggcacagactgcaccaaagtgagcattattggttagagtatgaatttatttttttttcatttgcttcttactttcaagccacacgctatgctgccactgcatttggcatcaaatcaaaagaccaactctgcttcacaggaagaaatgtcaccacaaagttgtgctttttgtgaaaactgtgctgttgctatttttctgaaatgctgtggaattgtgtggaacagaggaaggcctcatcagaactctgggccaaaacattatcagctagtcatgaaggacatagaaatggatagctgtagtagccaagagattccctacaatgacatcgtcagataactgaggtagtatcttaccagtttcatacactcttagctaaaacatcacactctggggctcagatgtcatgcataagcttggcctctaatatagattctgcgggtaatgctcctttgggcttcacccagtaggctgtgaggatggaaatcctaaaggtttagtctgaactgccaagaccctcacccaggaaaataaattgtgagagagactagcctaagcagaaatgaataccatggaatggacttcaataaacatgagatgatgcccactccaagcagtctagatgctcatcttgatctaatttctagagctgtacctcttacctgccctgttagctaatggaagggatcttacagatttctactcaaattctttatctaatggttggatcacctctgaatcatcctcacgtgctttcagcagtagcaattatgtagccaagataggtcataccttcacatccaaatagagagaacttcaaatcctagtgatttgaattggtagactagaaatggtggcagaaaggctaattaagagatagatacactataataagaaagaggtggtgagcctgaaccaaagtagttgccattagagttggagaaatgcaggaataattgggtaaaaagttccaggagaacttggtgttggcgtggatgtgtggctcagagagagtgaagaaaaaacaatgagtctgaggtttcaagtcttggttccttaataaacagaggtgcttttcctagaaagaaataagaaggaagagttagtggaagttgtttagccatgtttcaaatattaagagtctgaggtgctgaaaaaacatggcattctgcaattgatgctttggagggggcgaaaatttgaggagaatggagtgagtaatacataaaagtatgtgagaccaacaaggaagagcatgtagatagagaggaaagggagtcagggatagaatccctgtgaatacttgcttttagtgcagagaaaggaaaagacaaagagcaactaggaaaaggaggcagggaacagtggtcagaaaggtaagaagaaaactaggacagcacaatgtcatagaagccaagatacaagaggagttggccaataatatcagatacttaaaaaaattcaaggaagtgttccttttaggacatctggcaagttggccaaataggaacagctccagtctgcagctcccagtgagaccaatgcagaagatgggtgatttctgcatttccaactgaggtccccagttcatctcattgggactggttaggtagagggtacagcccagcaagggtgagcagaagcaggatggggagttgcctcacctgggaagtacaaggagctgggaccctacctcccccagccaagggaagccgtgagggactgtgctacccggctgacatactatgcttttcccatggtttttgcaatccacaggccaggagattccctcgtgtgcttacaccaccagggccgtgggtttcaagcacaaatctgggtggctgtttggccagacactgagctagctgcagtagtttgtttttgtttttgtttttgttttcataccccagtgatacctggaaacccagcaagagagaaaagagagaactgtttactcccctggaaagggggctgaagccagagagccaagtggtctcactcagtgggtgccactcccatggagcccagcaagctaagaaccactggcttgaaattcctgctgccagcgcagcagtctgaagtccacctgagacaatgaagcttggtagggggaggggcatccaccattactgaggcttgagtaggtggttttcccctgacagtgctaagaaggctgggaagttcggactgggtggaacgcaccacagtgcagcaaagcagctgtggacagactgcctctctagattcctcctcactaggcagggcatctctgaaagaaaggcagtagccccagtcaggggcttatagataaaactaccatctccctgggaaagagcacctgggggaaggggcggctttgggtgcaggttcagcaaacttaaacgttcctgcctgccagctctaagagagcagtagatctcccagtacagtgctcgagctctgctaagagacagactgcctcctcaagtgggtccctgaaccccgtgcctcctgactgggagacacctcccagcaggggtcaacagacaccacatacgagagaacagtggctagcatcaggcgggtgcccctctggggtgaaacttccagaggaaggagcaggcagcaatctttgctgttctgcagcctccactggtgatacccaggcaaacaggacctggcatggacttccccgaaactccagcagacctgcagaagaggggcctaactgtaagaagaaaaactaacaaacaaaagcaataacatcaacatcaacaaaaaggacgcccacacaaaaagtcccattcgaaggtcatcaacatcaaagatcaaaggtagataaatccacaaagatgaggaaaaaccagcacaaaaatgctgaaaatttcaaaaaccagaatgcctcttctcctccaaatgattgtaactcctcttcagcaagggcacaaaattggacagagaatgagtttgagaaattgacaaaagtaggcttcagaagatgggtaataacaaactcctctgagctaagggagcatgttctgccaatgcaaggaagctaagaaccttgataaaaggttacaggaactgctaactagaatagccagtttagagaagaacaaaaatgacctgatggagctgaaaaacagagcaagaactttgtgatgcatacacaagtatcagttgctgaattgatcaagtggaagaaaggatatcagagtttgaagatcagcttactgaaataaagcatgaggataagattagacaaaaaagaatgaaaaggagcaaacaaagcctccaagcaatatgggactaagtgaaaaagtgaaaagaccaaacgtacgattgattggtgtacctgaaagtgacggggagaatggaatcaagttggaaaacacacttcaggatattatccaggagaacttccccaacatagcaagacaggccatcattcaaattcaggaaatacagagaacaccacaaagatactcctcgagaagagcaaccccaagacacataatcgtccgtttctccaaggtcaaagcaaaggaaaacatgttaagggcagccagagagaaaggtcaggttacttacaaagaggagcccatcagactaacagcggatctctgtgcagaaaccctacaagccagaagagagtggggtccaatattcaacattgttaaagaaaagacttttcaacccagactttcatatccacccaatctaggcttcataagcgaagcagaaataaaatcctttacagacaagcaaatgctgagggattttgtcaccgccaggcttgccttacaggagctcctgaaggaagcactaaatatggaaaggaaaaactggtaccagccactgcaaaaacatatcaaaatataaagatcaatgacaatatgaagaaactgcatcaactaatgtgcaaaataaccagcaagcatcatgatgacaggatcaaattcacacataacaatattaatcttaaatgtaaatgggctaaatgccccaattaacagacacagactcgcaaattggataaagagtcaatacccatcagtgtgctgtattcaggagacccatctcatgtacaaagaaacaggctcaaaataaagggatggaggaataattaccaagcaaatggaaagcaaataaaagcaggggttgcaatcctagtctctgataaaacaaatttaaaccaacaaagataaaaaaagacaaagaaggccattacataatggtaaagggatcaatgcaacaagaagagctaactatcctaaatatatatgcacccaatataggtgcatatatatgcatatatacacacccactttcataaaacaagttcttagagacctacagagacttagactcccacacaatattagtgggagactttagcaccccattgtcaatattagacagatcaatgagacagaacattaaaaaggatattcaggacttgaactcagctctggaccaagctgacctaatagacatcaacagaactctccaccccagatcaacaaaatatacattcttctcagcaccacataacacttactctaaaattgaccacataattggaaataaaacacggttcagcaaatgcaaaagaatggaaatcataacaaacagtctctcagaccacagtgcaatcaaattagaactcaggattaagaaactcactcaaaactgcacaactacatggaaactgaacaacctgctcctgaatgactactgggtaaataacgaaatgaaggcagaaatgaataacttctttgaaaccaaagagaacaaagagacaatcttccagaatctctgggacacagctaaagcagtgttaagagggaaatttatagcaccaaatgcccacatcagaaagtgggaaagatctaaaatcgacaccctaagatcacaattaaaagaactagagaagcaagagcaaacaaatttaaaagctagcagaagacaagaaataactaagatcagagcagaactgaaggagatagagacacaaaaaacccttcaaaaatcaatgaatccaggaggtggttttttgaaaagaataacaaaatagatggaccgctagccagactaataaagaacagagagaagaatcaaataaacacaaaaaaattataaagaggatatcacaactgaccccacagaaatacaaactgccatcagagaatactataaacaactctacacaaataaactagaaaatctagaagaaatggataaattactggacacatacaccctcccaagactaaaccagggagaagtcgaatccctgaatagaccaataacaagttctgaaattgaggaagtaattattagcctagcaaccaaaaaaagcaaaggttaagacagattcagagacgaattttaccagaggtacaaagaggagctggtaccattccttctgaaactattccaatcaataaaaaaagagggactcctcccgaactcattttatgaggccagcatcctcctgataccaaaacctggcagagacacaacagaaaaagaaaaaaaaatcaggccaatatccctgatgaacatcgatgtgaaattcctcaatcaaatactggtaaaccgaatccagcaacacatcaaaaagcttatccaccacgatgaagtcaacttcatccctgggatgcgaggcaggttcaacatatgcaaatcaatcaatgtaatccatcacataaacagatccaatgacaaaaacctcatggtttatctcaatagatgcagaaaaggcctttgataaaatacagcaccccttcatgctaaaactctaaaaaaactgggtatttatggaacatatctcaaaataataagggctatttatgacaaacccctagccaatatcatactaaatggacaaaggctggaagcattcctttgaaaactggaacaacaaaaggatgccctctcccaccactcctattcaacatagtattggaagttctgttcagggcaatcaggcaagaaaaagaaataaagtgtactcaaattggaacacaggaagtcaaattgtctctatttgcagacgacgtgattgtatctttagaaaacctcatcatctcagcccaagaactccttaagctgataaacaacttcagcaaagtctcaggttacaaaatcaatgtgcaaaaatcacaagcattcctatacaccaataatagacaagtagagagccaaatcatgaatgaactcccattcacaattgttacaaagagaataaaatacctaggaataaaacttacaaggtacatgaaggacctcttcaaagagaataacaaaccactgctcaaggaaataagagaggacagaaacaaatggaaaaaaaaatccatgctcatggataggaagagtcaatatcgtgaaaatggccacactggccaaagtaatttatagattcagtgctattccattaagctaccattgactttcttcacagaagtagaaaaaaaaaactacctttagtttcatatggaaccaaaaaagaacccgtatagtcaagacaatcctaagcagaaagaacaaagctggagccatgatgctacatgacttcaaactatactacaaggctacagtaaccaaatcagcatggtactgataccaaaatagatatatagtccaatggaacagaacagaggcttgagaaataacagcacacatctacaatcatctggtcttcagtaaactttacccaaaaaaaagcaatagggaaaggattccctatttaataaatggcgttgggaaaactggctagccgtatccagaaaacagaaagtggattcctttcttacaccttatacaaaaattggctcaagatggattaaagacataaacataaaacgtaataccataaaaaccctagcagaaaacctaggcaataccattcaggacacaggcatgggcaaagacttcatgactaaaacatcaaaagcaattgcaacaaaagccaaaattgacagatgggacctaattcaacttaatagcttctgcacagcaaaataaactatcatcagagtgaacaggcaacctacagaatgggagaacatttttgaaatctatccatctggcaaaggtctaatatccagaatctacaaggaacttaaacaaatttacaagaaaaaaacaaccccatcataaagggggcaacgtaaatgaacagacaattctcaaaagaagacatttatgcggccaacaaacatatgaaaaaaactcatcatcactggtcattagagaaatgcaaaccaaaaccacaatgagataccatctcatgctagttagaatgacgatcattaaaaagtcaggaaacaacagatcctggcgaggatgcagagaaatacactgttggtgggagtgtaaattagttcagccattgtggaagacagtgtggccactcctcaaggatctagaaccagaaataccatttgacccagaaatcccattactgggtatatacccaaaggattacaaatcattctactataaagacacatgcacacgtatgtttatcacggaactatttacaatagcaaagacttggaaccaacccaaatgcccatcaatgatagactggataaagaaaatgtggcacatacacactatggaatactatgaagccataaaaaaagaatgagttcatgtgctttgcagggacatggatgaagctggaaaccatcattctcagcaaactaacacaggaatggaaaaccaaatacctcatgttctcactcataagtgggagttgaacaataagaacacatggacacatggaggggaagatcacacaccgggcctatcggcgggtgggggacaaggggagggagagccttgggacaaatacctaatgcatgtggggcttaaaacctagatgacggattgataggtgcagcaaaccaccatggcacatgtatacccatgtaacaaacctgcatgttcagcacatgtatcccagaacttaaagtaaaattaaaaaaaaaagaaagacacaaaacttactaaaaaaaattcaagaagaatgtgtcatctgaaacaaagtcattggatttgatggttagaacatcattctctccctttattataacatcaatactgccaccaccaagtctttaataatggttcacttcaccaacctcagtgatcagtgcttgaaggacactggagaagtaaagtgattcaactttaatttattcctttaataaacttttgttggactttactgtaagccaggcatcatgcaaggtattagctctctgttgccactgaggtataatattagcagtgcctgctccctgctttatagctgggtcttagtataatttttcatagttcttcattatatcttcaaaagtatcctgatttggacaataaattatatttatgtaattatatttattacttatgggccagtccagtcctacatttcttttagcatgaacttgactggaatgaaacatctatgttggccatgtggtctatgaaaagaaccattttcaacaccattgtctttccaacataggctgtgtgttcctgaactcacctgtcccagacctgctatctatgtgttatctgccaatcaaccatgacagccattcaatttggattgatcttgatgattcagagtaactctgtcacttacaggaataacttatagtacaaagtatcctaaaataattgtgtattttagcactgttttgtgtcattgtgtttattgtaggactttttgccaaattatatagtgtgaagaatgagtaaggctagtagaactgacctggttaaactaaaatttctcctctatagaagctagactcaggatatttttagctggtcaataaagagttaagagtgttagctagaggcacttgggaatccaggctgtgcttatttctcaggtttatgaataacttaaacctatgtaggagttaattaatttggctccattccacctacagtttagcttcttgagcgaataacttgacccctcctatactctgagttcgtagttataaagagaactcccaacagaatgaataaaacctcacttggattgtctgagtttaacttcttgcatactttcatggagaaactataagatgtcaggcacagcacaaaatgtcaaaatacctcttcagttaaggacaaacacaggcattgtactatttctggctagagttatttatgattctgtttttttctctcttaaatgactgacattctgaagagggagttaacctgtgacttggtaacagtgatagagactgttaaaagcacaccgaattttgctcactgcatcctgacctctcctttccctagagaatagttcaaaacaaattattacctttgggacgataggtcagtttccttacctttgatgttctccgcgactaaataagaagttacaggtattttctcacttgtcagaattttaaaaagaccacccattaggttggcagatcttccttgtaatacctctaaaaggacatgagagatcagactggaggtaaggcctgttaactgagtgaaacagatgagctgaatcatatgatgtcgcaatgtaaatgtcacaatgtaaatgaagtgtgacttcatagaaagtactcatgtcactaggatcatccaatcttcatagctactcaagtgcatgccttcactgaacatcatgacattctagagtatagcctattagctgtgatggcaacttgtatagttttgctgacttcattaaaaaaatttaatccttatgaatcattcatttcataaatgtgactacattttatcctgagttgcaaaaaatactggctggggacaatcgcattactcacccaaacaattttatcgtaagatctgagaaacaattaccagataaggtgagaagccatcacctattttcagagttataaaatatactggatttcaccatttcccccactttgagaatttgttccaggatggaggggaggctgttgttctgagccatcttccacttaaattagagcattgggcatgggagtacagtccctgccccttgctcccaaaccacctggaggagaggatggcaatgttagagctgcagcctgaggtctcattactgaatggagcagcaactaccatttagtgagcacttattttgtgtcaatgatattgcatgtaaaattgcaatattgaatttaatcctgacagcatctcaatgagttagttattgtcactatcccaattttacatacaaggaaactgagaagcttctagtcatgttagctcaaaataactgtgaccttggacaggaccagaattctaacccaggtttttaggccaaagcccatgtggacttcactacatcatgaatcttcagatgaagtttaaaggcagggcaaattgacctaattgaagcctagctgaagccctcacacgtataggttaatacatgttgtacggtattaattcctcctctgttagaatttttacattcagaattatcaagaatttactgacacacatattagaccaggagatgtttccaatcacagggcatttactaggtcctgactgccacccattgattccctatgccttgcagtccaagaagtttggcctgcaccctgaatgctgaccatcctggaatctgtagctggggatttgtaagaattaaagtactcagccctagaggtaaatggaactatcctcttgtgtatctagaaatgaaggtaccttaaaccatgctcagagcacgtagtagtttcctgtggttgccgtaacaaattaccacaaatctggtggcttaaattaatagagttttattctcttgagtttctggaggcaagaaatttaaaatcaagttttcaccagggcactctctctagaaggtctagaggagaattcgtttcaagcttcttgtagcttatagtggccccaggcattggtgttccttggcttgtggctgtagcacttcagtctctacctgtcttcgcatcacttcctcttcttatgtgtcttctcctcttctgtcttaagtattcctatgccttccttttataaagaaactgctgtttttgaatttagagcctatcagataatccaatataatcttatctcaaagttcttaattacatctacaaagaccccttttccaaacatggtaacattcacaggttacaggagttagggcagggacatgtattctgggggaatataactcaacccactacaggggacttgacatccccaactgtgctctgaaatacaggaaaccaggatgtacagggccaaattggaccactaggaatatgaagagagaattatggctgccttccattcctactttttaaaatatcactcctcactcatcatgccccatcagtctccagattctcttaacagcctgtgggatcagtctcaggccatcctaggtccatttgttcactgaaacaaagtagtataagagaaagagtataaatttaggaatatgacagaagttggttaaaagctactccaataattcttggtgatatggccttggataagttattttaacctctctaggactcagaatgctcacctgcaaaatagaaatgagatcactttggtcacatgctctagggagaaaaaaatatctaggctttggagacaaggagacatgggtttatttcctggctctgccacccactatctagccatgcaatttggggcaagacattgaaactctctaaaccttagtttcctaatctgaagaataggcgtaataacttgaagagatgtcaagatttaattttaaaaagtacagaaaatatagttggtgtcaattcatgtttattaaatttatcgttgttattgttgttgatgtcagctacaacttacagagtacctagtctatgctagacattctgccatgcatgatggagcaatgcagatatgtatctcagtcctcctatagagcagattgatcgtaagggagaaagatagtattattgtgagaagctagcaacactactcagctttttggccactaaaattattttctttgaatacagttaagtcatctttgctcttgggtaaaattgcataaattttaggaatttagaagggaatgaagaagctggaggtgaattaaatattaatgggcaaacattttaactatggttaaaattttgatatcaagaccacagatcaaagctaatgtcttttctgtcaaaattcgtagattttaaatatatcctgggggtaagttgagaaatgttgatgactaacaaatgaaccttttaaaattgcatttacttttctagctgaatgctcctggagtttttccaatgatgttcattagggtgacaaaaccagcttgaatgtacataaatatcttgctttgtacagaaattaaagtgttggtacagacattaagatactaccattcaggccactgagagagccttccaggacaacaatctaggagttattacttcttcctttgattgcagtttcatacaaagcagtagctaagtcttctgtgatcagttcaaatgcaacagcacaaccaatggtagaagaaagaactttccaaataaaacagccaattaacagtttgacataaaaaggtgggcctagctatcattctagagattaggtaaaggaagcacaactttttggtttcatgaataggcaaatccaggttttgaggatccattgttgtgttcgtttattcaacagacagtgactaactacagccatcagttggtacttatgaaggattggttctagaacccccctccacaatgtggataccaaaatctgaggatgccatagtgccctatataagatggtgtggtatttacatatgacctacacatatcctctggcatactttaagtcagctttagattacttaaaataccttatacaatgtaaatgctatggacatagttgttatgctgtattggttttcttaaagttttggttttctttttgttaaatttttatctgtacatagtagttgtatatatttatggggttcttgacatatttttatttgtattttttattgttacacagttttttattgttttttctgaatatgttttatgtgtggctggttgaatctgcagatatggaactcacagataaggaaggttgactgtacttgagtacaccagccttatgtcaggtgctggcaatatatagataacaatgacttagccttaacaggtaaatttgaaatattttggtacactatggtgcattttggaaagggtatggcaaatagctttgaaagtacagaggaagtaaagcatgcctatgtcttagagagtcaggtgaggcttccaagaggaggggacaattcagctgcatttgagaagatgaataagaagcaaacataggattagaggcagacattttactaaaggcagaggccaaaggcataaggatgagaaaacacaaagaaaccataaggtagatgaaggtgatgagagaaagagttggctctttaggtctgaacttatgtgggaatcatttctgaggtgggttcgccaggaccaggtgatggataggctattgaaaaggaaaaagactgtggaggcaggcaagccatgaggttttagggttggatattggatgggcagttcaggtttgctccagtgccatggatgaaatattgtgtcctcccaagattcatatgttgaaactctaatcccaatgtgatgatattaggaggtggtgcctttgggaggtaattttgggagggtagagtcctcgtgatgtgattaatgcctttatgagaagaggctagagagatagctagttctctttcccccatgtgaggatacaatgggaaattggctttctgcaacctggaagaaggcttcaccaggatccaaccacgctggcatcgtgatcttagacgtccagcctccaagactgtgaaaaatagtcctggaggctggaagtctaagatcatggtgccagcatgtgtgtgtgtgtttgtttttttttttttttttttttttttttgaatggagtctcgctctgtcacccaggttggagtcaagtggcgtgatctcggctcactgcaacctccggctcccaggttcacgccattcttctgcctcagcctcccgagtacctgagactacaggcgcctgccactacgcccggctaattttttgtatttttagtagagacagggtttcaccgtgttagccaggatggtctcgatctcctggcctcgtgatccacccgcctcggcctcccacagtgctgggattacaggcatgagccaccgggcctggccgtgtgtttgttttttaaggccactccatctatggtcctttgttacagcagcctgaactaagacagaaattggtactaagaggtgggttctgatacaataaatacctaaaatgtggaagtggctttggaactagataccagaaactggaggaattttgaagtgcattttggaagaagctggtggtgaagggacttttaaagatgattctggtgagagctcagaaaggaaagaagaacactgtagacaaaacttccatcttcttagagaacaaataaataatcctgggctgggcgcggtggctgacgcctgtaatcccagcattttgggagaccgaggcgggcagatcatgatgtcaggagatcgagaccatcctggccaacatggtgaaaccccatctctactaaaaaaaaaaaaaaaaaatacggaaattagctgagggtagtggcaggcacctgtaatcccagctacttgggaggctgaggcagcagaatcgcttgaacccgggaggcggaggttgcagtgagctgagatcacgccattgcactccagcctggcgacagagggagactctgtctaaaataaaataaaaataaacaaatgaataaataataatcctgtatagaatgcaggtagaaatatgaataaaggccattctgatgaaatttcagatggaaatgaggaacatgttactagacaatgaagaaaagatgatcctttttatgaagttgcaaagaacttagctgagtcatgttcatgttttggtgttttgtggaaggtggaacttgtgatgaaattggatatttatttagctgagcacatttctacacaaactgttgaatgagcagtttggttccttctcactgcttatagtaaaattcaagaggagagaaatgacttcaagatggaattatgcaaaaaggaactagaacttaaagatttggaaatttctcagtatgtccatattgcaaaaaaaaacaaaatgtgaaagtatgtttgaccaaggaatctttgacagggagattagcatggatgtcaaccacaaacataatcagctaccccaatagaaaaaactgacagtttgaactgaagggaatggagatgggaaggaatggaggaaggctgtcagacttcttagattgtattggacaggaccacagagttatttgcttgaaaatgtgctttattcctgaagacaaggcaagaaggatcctaaaggtgattcagagatcattagtgccactgcctgagtttcaaaaggtcaaacaatctccacccatagccatgacgtatgggatacccagagccttaggggcctgacccctgcccagcagagttgcaggggcaagatggccaccccagtgggtccagaagttgggacctctgccccagcatgttcaggagacgagacctccatctcaatgggtctagagggcagagcattaagccaaaaaggattattctcaagccttaagatctcatggaatttgccttgctaggtttcagacttgcttgcaactggtcaccccttctttctttcctatttcttcattttggaagggaatgtctatcatatggccatctcaccactgtattttggaaagacatgacttgcttggtttcacaagtttataaatagagaagaattttgcctaaggatgaattgtaccttgaatctcatccatatctgatttagatgacatttagatgagactttggagttgaaaattaagaatttgggggttggtttgaatggaatgaattattttgctattagaaaggacaagaattttgggaagccagattggaatgcaatgaactgaatgttttcatcctcccaaaatccatatgttgaaatccaatcccaatgtgatggtattaggaggtgtggtctttggcaggtaattaagttatgagggtggagccctaatgatgggattagtgaccttataagaagaagacagtgttctcactcataagtgggagttgaacaatgagaacacatggacacagggaggggaacaacacacaccagggcctgttggggggtggggggcaaagggagggagagcattaggacaaatacctaatgcatgcaggacttaaaacctagatgacaggttgataggtgcagcaaaccaccatggcacatgtatacccatgtaacaaacctgcacattctgtacatgtatctgggaacttagagcaaaataaacaaacaaacaaataaacaaaaagaagccagagaactaactggctgtctttctgccatgtgaagagacaaagggaagttggctctttgcaatgcagaagactactctcaccagaacccaactatgctggcatcctgatcttgaatttctagcctcaagaactatgagaaataaatgcttgtttttaagccatccagcctctggtaatttgttatagctgccccaaatgactaagacatccagtgtctgttatggggagcagcactctttctctgtgcagcaaaatctgggctgccaaagccaatacttccctgatgcttccacagccccatctggctgattaagggctaattcaaatatcaattaatcgttcctcatttaatttcttttaaaacattttcacagtgcagataatgaggaagaatattctgctttgaaaagtcaaacaaaaccctccactttaaagaaattagtctaaaactgttgcaaattgtaaactagtaagtgagcagatagtgacaatttggtccaggagcttaagatttctctgtttcacaagggaaagattaaagcgttgcttcactatgtaggatttcccaaaaagaagggaaaatgcccagttacagtttttccaaaatgacctattgcatttcctctccttgacttggtgctaatagaactggtgatatgttgtgacctgaaaagtagaaactaatgatggaattgtggtgttaatagggaccactttaacactatgaaggcacagaaaggttatgtgccttgcccagcatcacacactagttattagcagatctacatgggacctgaagtcgagaggccaaaaagtttctgttgcctttccttgggtcattgctgcctctggcttgctggtgaatgatcattggatttggctaagtgaggatacagtaggaggtgaagtaaagagatgggtgggggaattctgacaaactctgagaggcaacaagttgtctgactcactgtgacaccttgaagaaataagcatgcttgaagcaggggctttatattagagaaatttggaaagtagtcccccaaggaaggctctggaggtggcagactgagtcatccttacttggaaaagagctgccatggtcttttgatttcctgccagtaaagcagcttcctcctcttcaggtgcagatacagagtgggtatttatactttagttccatcccaccttggcccaattttttttttctggggagtgaagatggaaatccctctgtggcttttcctacaggactagttggaaaaataggcagaaaaaggagtttggattttattatgtctgttgggtagttcctagaagatcttaagaaaaggagtgaatgctttgatttatttttttaaatagattactctggttctgagtgaagaatggatgctacaaagttaacgaagctaagaaagaaaacatctgaagcaattgctttagaacaaatgggtatagtggatcagattaagatggtaatagtagcgactgacaaaagtagacagaattggtatgtatatttgaaagcaaagtcagaaggacttagaaagaattgaacatgatgtttgaaaatgagtggaatcaatcctagctttcttatgtgagcaactagaaattgctgggagagatgatttgtgggtaagaatcatgagtttgcatctggaatcctaggtttgaggtccctatgagacattcaagtagagatgtcaagtagtcagttggacatgagtagaaatataaacttgggagtcatcaacacatacatagtgtttaaatctgtaggactgaatgaggccgaggtcatttagagtgagaagaaaaggagctgtaaaaaatatttagaagcaaagaccagtggcatagaaatagaactatgagaataaaatgtcctggaagcccagagaagaacagatttttttaaaagattggctagttggctgtgtcaaatcctgctgggagctcaagtaaatgaagagcagagatcactgactttgattacctgaaggttgttgataactttgataacagtgatgtctatatagtggtggagaaggaaaagctacattagagtgagtcaaggggagaaaaagaatttagggttgaaaatagtgatggtagactacttatgaaagagatttggttgtgaaaggggacagagacatggagaggtagctggaatgcagaggtgagttaagatatttgataaatagggtatgcctatctgctgatgtgggcaatcctgtaaagagggaaaaacttaagatgcaagaaagagaggaaagcccttgagaaggctagatgggttgagatggatactgagcacagttggaggagttagccatggagcgaagtaaggacatttcactacagtgctcctcctggtcaattgagtaaaggtcatcatatgtgactgaaggtctggatgttggatgtacatgtaggtttgagaatagaaaaaacactgtaacatcattgtgttggagaatggaagtgtgaacattaaagggaagtgtagtagactgttcaggcaacacagagggctcatttgaaatgtccaaccatgattttaaagtgaaacttgttaacactgctgtgtgcttttctcaagcaacactcacctgctaaaatacagcagtgaagtaggaagagagtagagttaactagagttggggctttgcaaggcagatgtgtgtgatggagggaaagagaaattagggagttaatatttggaaaatggtgaatataatggattatcaaatataaggtctggatagagagacttgaatacatgaggtagatgacgaactgtgagaaggtggtgaggtcagtaccttgcaggtcttgctaaaattagagaattaatagaatgagattactctggcatatgaactggaaggaaaagaagtaggctaatagagaaataagggcccaaaaatgagattaagattggccaatgagataggaggtggaaagtatttccaaaaggaaagagcaggtaactagtcaagatatcaagtaaaatagggatagaaaggtaaacattagacataatgacaagaagatcattgttgaccttaacatgagccatttcaatggaatggtaggattcattgtagtggattaaagattgagtgggcaatgaggaaactgacacaagagaactcaggacaccttttctttttttttttttttaattttttttttattattatactttaagttttagggtacatgtgcacattgtgcaggttagttacatacgtatacatgtgccatgctggtgcgctgcacccactaactcgtcatctagcattaggtatatctcccagtgctatccctcccccctccccccaccccacaacagtccccagagtgtgatgttcctcttcctgtgtccatgtgatctcattgttcaattcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgtcgcaatagacatacatgtgcatgtgtctttatagcagcatgatttatagtcctttgggtatatacccagtaatgggatggctgcgtcaaatggtatttccagttctagatccctgaggaatcgccacactgacttccacaatggttgaactagttgacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttcttccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagtaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattgtgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttgttgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttccttcctcttttcctaattgaataccctttatttccttctcctgcctaattgccctggccagaacttccaacactttgttgaataggagtggtgagagaggccatccctgtcttgtgccagttttcaaagggaatgcttccagtttttgcccaggcagtatgatattggctgtgggtttgtcatagatagctcttattattttcaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgaacatggtggataagctttttgatgtgctgctggattcgttttgccagtattttattgagggtttttgcatcaatgttcatcaaggatattggtctaaaattctcttttttcgttgtgtctctgcccggctttggtatcagagtgatgctggcctcgtaaaatgagttagggaggattccctctttttctattgattggaatagtttcagaaggaatggtaccacttcctccttgtacctctggtagaattcagctgtgaatccatctggtcctggactctttttggttggtaagctattgattattgccacaatttcagatcctgttattggagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcttttcaaaaaaccagctcccggattcattaattttttgaagggttttttgtgtctctatttccttcagttctgctctgattttagttatttcttgccttctgctagcttttgaatgtgtttgctcttgcttttctagttcttttaattgtgatgttagggtgtcaatttttgatctttcctgctttctcttgtaggcatttagtgctataaatttccctctacacgctgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgcgattattaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgtagatgtctattcggtccgcttggtgcagaggtgagttcaattcctgggtatccttgttgactttccgtctcgtggatctgtctaatgttgacagtggggtgttaaagtctcccattactaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttagttgatgcagtttcttcctagtctcgatggtcgtttcattttggcatgattttgcggcggctggtaccagttgttcctttccatgtttagtgcttccttcaggagctcttttagggaaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggttgcccttaacattttttccttcatttcaactttggtgaatctgacaattatgtgtcttggagttgctcttctcggggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtcttttctcatagtcccatatttcttggaggctttgtttgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttcagcacttctctgtattggttattctagttatacattcttctaaatttttttcaaagttttcaacttctttgcctttggtttgaatatcctccgtagctcagagtagtttgatcatctgaagccttcttctctcagctcgtcaaagtcattctccgtccagctttgtttcgttgctggtgaggagctgggttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaacctcagctgcaggtctgttggagtaccctgcagtgtgaggtgtcagtgtgcccctgctgggggtgcctcccagttaggctgctctggggtcaggagtcagggacccacttgaggaggcagtctgcctgttctcagatctccagctcgtgctggaagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccgggctgctttgtttacctaatcaagcctgggcaatggcgggcgcccctcccccagcctggctgccgccttgctgtttgatctcagagtgttgtgctagcaatcagcgagactccgtgggcctagcaccctccgagccaggtgcgggatatattctcccggtgtgccgttttttaagcctgtcggaaaagcgcagtgttagcgtgggagagacccgattttccaggtgcggtctgtcacccctttctttgactaggaaagggaactccctgaccccttgagcttcctgagggaggcaatacctcgccctgcttcggctcgcgcacggtgtgctgcacccactgtcctgcacccactttctggcactccctagtgagatgaacccggtacctcagatggaagtgcagaaatcacctgtcttctgcctccctcatgctgggagctgtagaccggagctgttcctattcggccatcttgtctccactttggatgtaagccattttaactgggatgtggtaatatctcattatagtgttgattagcatttctctgataattatgttaagcaccttttcatatatctgtgccatttgtatgttttcttttgagaaataccactgtctggcactccctagtgagatgaacccggtacctcagatggaaatgcagaaatcacctgtcttctgcgtcgctcaggctgggagctgtagaccggagctgttcctattcggccatcttggctcctacccccaccttttcaataagttattgctgtttaaacatttttatgatagctgctttaaaatccttatcaatcaggtaatgctaacatctaagtcatctcaatgttattatgaactgagtatctttttttttttcatttatgttttgcgtttcctggatcttggtatgacaggtgatatttttgtttgtgtcctggacattttggctaatatattgggagactatggatcctatctaaatcttgtatttttagcaagaagtcactccattgagatttggcgtcaaggttctggcctactttgtgagttgaggctacaatggcagtttaatatttttagagctttcgcggtgctattttggtcggcatggtttatctggtgccttgggaactcccactggtccttgcttgtgctgcctgagggagcagacagggttttcccaggcccacagaaataaagaaccttccttggtaggccacttgtcgtggctgggcctttcccatcatttccacccacctgctccagcatcctctggcagaagaagggattcttgggtccttttttctcctttgttgggacaaaaatgcttcacgtacagggcaccctcttgtggtagaaatcccctggttgctgtttcctggatacctgatgtctctcaaaatgggagagagtgtcaggtccgtagaaacaaaaaacctttttggacaaggtctgcttgttggggcaggatacccattgccagtactgcctggctgcctggtgtttcacagtaagggaagagagtcctgggctgtcagggaaggagagtgcttcccctggctacttattattagtagggctcccaatcatgtccccttgctgccattcccaggttcacctgatattgtgagaggaattaccatttgatccagtaaagaagcaagcctacctgggctgccatctgctgttctgtcagggatcaggaaatgctgggtctgtgtcaccttgttctgttggatagggggaggatcataagacaccctgctactgtgctatttatccaatactgggatcctaaaccagttagccagccttttaccaccttacagagttttcctctagttgttgcttgcattattcccagggttcatatttgtattaatactttgggcagaggagcagggagaaatacatctacaccatcttgtctggaccagacatctgattgtagtttaaaggcctaaaatgggaagcaaagagagggagaggagagtcaacagagcgaggtcccaaaaagtgcttagagaaaagaactcagaacacagatgaggatataagtattagcaaaggacagagaggaaagaagatgcatattcagataggtttataggtttggtagcaggaatttgaggacattcttagccgatgaatctacttactttcctgtgaaacagagaggcaacataagagcccaaactcgatgttttacatttttggttatgaaccccagttgcacttcttaccagttgtgaggcctttggcatatcacttaaatccctgtgtgcctcagtttcccacaaaatggaaattaaaacagcatatatcctcataggaccgttatgatggttaattgaagtgagttaatatttgaaaatgcatttaatatggtataagtgtttgttatgtaggcaaaaatatctcgtaaggttcttacgagatattaaataagataagctctacaatgtgtgcagcaaactgcctggtatataacattcagtgttactatgattttcaaaagtattctttgcaggcttaggatattttcttgaagtaaaatcataggtcacaatttgccaatcccatgtttttgtcagagagggtctaggtgacagtgggcacaaatacataatatcagtcttggtagaaatagtagggatggggaagctgcatatgaggaactccaagatgcagttggagcatctatttccctgggaagctttaggcaagtgcccaaggcccactgagcttctccagccttagcatacattttgctatgttgtatgcagctttctgccctccttttcttgaagtctgagtgctcctccagggtagagaccggcaataggaaaaggtttcaactccctcacatcacaacatatctccatgctataatatacaccctctcccaaagtaacatttgaaagtccctgagaaagccaaatggactcaagtgtctggaatatgttaatatgggcagtcagctgcataaattgcaaaacagaagtcatgcttctatgtattctgtgacagcagaaaaatcgtaggatcttctatcacgatgggaaaggaatacaaagaagaattagtgccatcttgtggagtgatatatcattaccacttaagagtcgccagtgagaactgggttatatttttttagtatctcccgagtcctggtctgcaagaaatgcttgaaaattacttgcagaattaaatgaataaatgagagacgagataagaattggatggagactttgttaatttaaacatcaccttgataaaatgtttgacgcactgtccattgcgatttggagacctttaaaaatggtgttgtagacaccccaagtcattattatgtacctaccataaaggaaaatgaagaataaaatatttgcattaagaaatcaagaactatgaactttttcttgtcctggccttatcagtagtaggtgagtaaactttctaatggtatttttctcttcctgattatcaatgtgctgcaaattaataaatcattcaaagaacacgaagagctggggcacagtgactcatgcctgtaatcccagcactttgggaggagaaaaagggtggatcacttgaggtcagaagttcaagaccagcctggccaacatggcaaaactccatctctataaaaaatacaaaaataagccagcgtgatggcgcatgcctgaaatcccagctacttgggaggctgaggcacaagaatcacttgaaccttggaggtggaggttgcagtgagccaagattgcaccactgcaccccagcctgggtggcagagcaagaccctgtctcaaataaataaataaacattttaaaaataagaaaaacaaagagcatgaagaatatgggtagcttcggagcaggtgggtgttgtccatattctattaagtttaatgaaaataaattgctgacaatcaactattttgacctataacaatgtcagtttcttatggattggcctaatattttaaatcagttcacttaatttattctgggtatatgataggtcaggatattgtagtaggccctagatgatacagggacaaataatacatgggccttgcctttaggaatcttaccatttggtgtggaagtgggcacttagataccatgccttctattttaataatttctgttaagtgccaacagtgtggagttaagccaaattttgtggaggtgctatgagaggtctaggaaagcataatggtttggaatggtgggtaagagcaaggactctggcaccaaactctctcagtttgaatgttaatttcactacttactagatgggtgactttggccaaagtgctatgcttttctattcctcagtttcctcatatatcaagtgagatcacatactgcccacctcatatgattgaagcaagggttaagtgagttccaaagtacttggaataattcctcatgcatagcaagttgtgtataagttttagctgtcttcgtcaccatcatcagtcatcatcatcatcatcattaccatcatcacctctattcctgcagaagtattagagttgtgttttgtaagctgagttaaatttcattattcgttttttcttttgaaaacgttgccaataatttatttattgagttcctatttttcccagttcctgtgaagaatgggtaggaatacccttacctacttttttctactagatcatcatttttgtaaatctgggcctgaggcaagagctttacaggcaaaagcatgggacaatgaaaggacagaggacagtaagactgttgtcattggaatgaatggctcatgggggcttgtatcaagttatggagaagataagccaagacttagattatttgtatctattcacgtgtatatttgtgaaggcaaaacctgttctcggttggctttaacaaaatcagctgaaatagctggacagaagctacataaggtaagggcaaaggcatgctgcattgctggcatatagtaccttaggcctattctgtggatacttggttgatgctgaatgctctttgtccccaagttgtaaaatcacccctccttgaaaattattctctaataaattttttaatcataaattaattttgtgccatggcaaaggtattgacagctaagaagtaaaactgtaaaattaactgctatggactaagaacggctaaaatttcactttgtttttaatgccttaaccacctgacaacatattgtagcatgactttatgaaacatggataacattcatcatttgagtctggagatccaaattcagtatttcagagtgggatcatgatgggctgtagtcatgagtgtttactatgttgtaaaaacgtccaagtgggaataatgacatgtttgcactccctgtgacttgatcactgaaatctggaaagctcatcaacttcacccattgtcaagtccacctttgctcctttgtcctctgaggacccagtgagatcagcatttttctggaagggctgcaagtgaccccactggaaggagcagcactgtgcatcaggatggattcccaggcacactatacattgtggggtcacaggccatatgggtggactaactgatttcatggctgtatttgaattgacttccctcctggaatcctgatgcctcttttaattttatgtggcaactatcatttgcttttgctgatcattcattcaatcacctctatcatttctcaatgagggcatttttaaatatattatttatatatttttatttttttttttttactaaatatagaccagccatcaacttgaacttaaaaactgacacaccagttagttcggtcaatagtgcagaaatattcttctatgctactatgatttgagcccactatagatacttttatagctagttatgccagcaagactcaatgaatgatacttgtccagattgctatcaggagctaatcatatgaaaggtaacaccagctttatgtaggatctgtttatacttagggtacttcctggattttgacggttttcaaagctaatggcctattaaataggtcccagaggtaaaagaaaaagtggcttggcctaaaccatggtgaatcatcttatggtagagttcaggtttctaattcataatcttgttagcagaacgtgcctttgaatggaaagtaacgtacaacctctgccaatctttgcaactcactaacaaaactcagcaaagtttgcccaatgccaatgtttaaaaaaatggatgaaaacagcatggattgaagaactcacatacaaaatatataaggaatgaagacaaatggcatcaaaattgtatctgggtaaaacatttgctgttgagtgtgccataatttgagagcacaaacacagccttgagggtaaagttcaaggtacgggtgtccccttttctaaggggacataacacataagcacataacagtcctcctgttatgtgctaaaagaaaggaagctcatattagattgctccagatgtagaaatcataacaacaataaagatgataatattaacaagtctaatttctggaacatttagcctaatgtttaggcatgtttacatgcctaatatgcattatcacgtttaattcttgctttttttccagttgaaatcttattttattttttacattcagtatattaattttaaaataaattttgtgcatatttaaggtatacgacatggtgatggatatgttcatttgtcccactatagagatgattttactatatatatatatatatatatatatatatatatatatatacacatatgtatcttaatatttgcttttatgaaatccttgtatataaatatttttattctcctcaatgtaatattttaaaaacttcattttaaagaaaaaataaatttatatgctctcttaaagcagagagaacaaaacctaacaaatcaacagcaaaaatgaaggcactctttttcacttcaaatggatttgttatcacagtctgtacagaatttagcagtgacaccttggtgttctaaatccttctaaactgagtttcctccttttttttctgcaagaagagcttctttatcttccagaatcatgactgtattcttttccttgtatactctatcttgcagtcagggaatgaccggagagcgttctcatgtgtctctattaattactaccccaaatatacctttttctggaggggaagtaccaggaaaatcttccctgtttagctgttgcaggggtatcacatgttgggttttcagatgtagcaaacaaaaatagaggccagccagttaaatttgacttcagagaaacaacaacaaaacaattttagtataagttgatcccaaatattgcatgggacagacttgtactaaaaaatgtatcatttatctgaaattcaaatttaaattggcaccctatatttcatctggcaaacctatatactaattataatttccagattacataattgagttacagcagtaagaccaattttaacttgtttcatcatagtgggaatcctgccgaattgtcttcacttccttagaaacaaatgagtagcagatgtctgatttggtgaatgggttatcagctgagtacaaccaacttacataataatttaagcaggagcaaggatgcatgctaattatatgtaggcttgcatagaaatttttctttagtttactcattttagatgtatagtatttcagagtctgaaaaagctgtggaggtccatcggtgtaatgtcacctccaaaatcccccaccgtggcctgggaccccattctttacactgtagggttgctgacaaaatgttaccaggccagaggggtcagtcgtggccaaagaccaacccacattctgcttttcaaaccttgcacccacagaaggcacttcccaccttctccaccccacaccgacccagacatgtacatacgtgccttgcacttgccagatcatgcactcccagtttgtgcctcctccgagctggtgcctttttatataatttgcatgaaggcagtagactcttggccctgattcataaaaacatttaatgcccatttgcaaagtcactacccagagccaagcaccacattaagttctgggaatgcagagatggatggggcatggtctcttctttctaggaaattagagtctggcatgggacagacaagcaaagaaatcatttaaaaacgtgccacgatagtaggtgtgcataggacacgatgagagcacagaggacagaaagctatctcagcctagtagcatggaactaggagggattctcagaggggttggaacttaagcaggatgtaaatgaaagaatggggttagtgagtcaagagggggtggaagggagggagaaaaggcattctaggttgagggtgacgcagcaccagcaaattcacagagatctgaaattgagtgccctgcttgggaaacctcaagataactcattttagctggggtaaaagtggggggctgagggtgtggcaaattataaagggtctttacagagagaatgatttgggaaacactgaattaaacaatgccctgtggggtaacattgctcctgctatattccccccagtgccgaaaatattgactagctaatagtaagtactcaatatatgttttattaaatgaatgaatgaacaagtgattgaatacatggcaggacttgtcagagcctttgatagaacaatgtgtgttatagatctcaagagaggggcatagtatgcagaattctcaccttatttgaccacataaccgtttttgtcactgaataatacatttctaaaatctattatttttgaaacacacttggggaaatcatgttctaaaggagacatgaaaatgtaaaactacatgaataaatagaaagtgagagaaatctatgataaggtttcagggcttatgcttacatgaaatggtgctcaattttttctctatcgtcttcttggaactaggtgattcattgatagtgggcagcatgagaggccggacacaaggtgggctggcccaaattccagggggctttgcaagtcctcttcggcaacaataatttgtattcactttttattttcccttgtttacacgttcagattgttctatagctaatcagaaaaatattcactttccctgtgggcctaatggtcccacaccaacgctaatctcagaaactgtggtcttaaggtaaaaacatgtatcaagcgctaactttacaccagacactttccacattttaacttactgattttccatgatggtcatggttataatggtataataataattacatattgaatgtttactctctgccaggcagtgggctaagtacagtttacaattgttatctcatttgtccttcgtgacaacccaactcatttataacaatactgaagcacagagaggttaagtaacttgtaaaaagttacacagctggtaacttgcagattagggaagtggacctgggtctgcctgatgccaaagcttacatattacatgtttaaccaccccgccatgttactgttaagcttactataaatcctttgcagtgtataatcaaagagaagttcaatttcactcctatgtccatacaaatatatcttcaagaaaacaatcctaacctcaatgactaccattaaataggatccatttatacctacttgccaagtagtcatggatcagttatgtatcattgctatatatgtgaataggtcaagcgtgttacagtgttattagaacagtcaaccgaatcatgttaaaccctgattcataacttgtacttgatgcaggatattaactactcacagcataacacaattagacacccccagaacagaacaaaagcagtcaagagtatgctgtgctggaccccaaactagtgagttccccactcttccctcagaggctctagggatccatgaatctgcttcttctatcttctcacacatagaccaaaataaaacgaagtaggctggttgtgaggcttaatgaaatgtctcctcctaggctgttggcccagagactggccacttgtgaaattatatatatatatatatcatatatatataatatatacttatatatatatatataatatatacttatatataagtatgatatatatatatactacttttgactttacattttgcacttgcatttaaaagtattcattcagatcattgcatagtccttgtagttgcattaataggtaggaatgacatattttaattttgtcgtaaaatataacatacatacaaaagagtgcatgtacaattaatgatgaatatttacaaactgaactcacctaaataatgagcacccagatgaagaagtagaacattaccagcacccccaaaaagagccactgtggtcactaacccttaagggtaacctctatcctaaattggaacagcataaaagctagaagaactgaaaccgtggtctagctactaaatgacagacatacttggactatctgactccagagcttatacatcagacaatgcatgcttaaaactacaagcctttccacatttcatagagggaagaatatttttagttcaaaaaatgtttcacgatgtttgaagttaaaatgacgagtttctaaatagccaggcctgaaagagtgaccatggctgtggagaggggagcccatgatgatggctgactttcatgatgctgccccctggatgggttcatgacagtagtgatcaaaaagggctaagggccaagtcctaaacctctgtaactttgcagtcccttcggggctctcttttctgagaagatattcccacagtagaaaactgccactgacaaagtttcattggccaggtagtgtgagtcttaattgcaaccagattttatgtggcggaacagacaacactttgctctgatgatgtaattcctgccaaactctgtagtatatctctggtttctaattctccaaattcccccatggaattgttattcccttttcacagatgggaacactgatgttcagaaagtttaaatgccctgaccaaggtcacatggctagtaaattccttggccaggatgaaaagccatgtctgttttgactagaacttctgcctgtatccgttatatatcaagcttgaaacactccatagcttcaccaagagttgcttcattggagatagtttgactatggcctccagaatttcagatagatgtcctgaatttctactattttgagatgattcagaaggaatttgcagggcctcagaatgatcattaatcacatcagttactactgatgatatcagaaccagactaaagtattgcttgtttctcaaagtttgatccatggaccagcagaataaaatgaaggatctcaggccacatcctagacctcctgggtaagaatttgaattttaacaagatccccatgggacttgtgcacacattaaaatttcagatgcatcattgaatgcctggaaacaaagtttagtatattctgcaaaatgggctatgtggattttatatcttggataaaagacataaaaatatgagtgagattatttattttatttcaagaagaagaagccagcaccagtgccttgctgaggccaagaaactcaacttggcaatcccaattcctgaatcctgtttccataatcgctctccaagttctggtcccctctcacctcacatcatatagcagaaaacgtagattcccctgaagccgcttagactctgaaaacttggcccacagagcctcgtccttgagcacctgggcctgtgaatcatctgggcatggatgctctggtgagctttcccggccttggaacctcacctacaaccatttaatcgttgacaaggttgacaaagacaagcaatgggaaaaggacttcctagtcaataaatggtgctgagataattggctagctatatgtagaagattgaagctggaccactacccttcaccatatacaaaaattaactcaaaatggattaaagatgtaaatgtaagacctcaaactataacatgaggagtggtgagaagattctaacaggaaggatctctctccttcactttggtctctttgcaggcatgttctatcgttagcattaattaggtttacagtattcacacacctgctagggaaaaatagactccttaatttgctgcaaggtaaggaaacatcagccatctcagctatgcctttgtagacattataaatcatgtgcaacatcaaaaagatatttaagctccctaaatatgggttgcgttatttgacttctaatagcattctgactagcaatagcaaagagaaatgggtttgcactgaaatcatgtcagcagggaggttgtaactgctactctgaaaacattcttcctgcttcccaaggcattttgtcattagtggaacgaccactgtgcaattgatagccttccagaacttgttagctctgtaaagttgatgtcctctaaaatttcacattagcaagagcacatcacagagtcattcattcatttatacaacaagcatttattgaccacctactatgtagcaggtgcaaatctgtgtgctacagataaaatggtgaggaagtccaaactcaatggtgagctctctgggtgagacagacatttaacaaataatgctcaatttacactttaaaaaatgtaagtattggtgtcaaatgctagtacacaaaggtacaggctacagtggggatcggtgagaaagaattaagtcagttatgtagacatggaggatggagtcagagaagattttcttagagaaatgacttttaagctgaggtgaggtctgaaagatgaatgggtgtcaactaggtaagatgggcgagagagcagagtggaaataggggcttcactcccagcagaggaaatagcaagtacacagtccctttggtgggaaagagcatggaacattcgagaactgaaacaggcccagtaagacttgagagtaaagagagaggaagagttgcacacgacaagtgtgattgtgcagggccttgatagtcatgggaaggatggtgatgttttctctagtgcaatggggagacctcaaagggctcggagagattgagtataatttgttccaggcctcacagctgtaaaggacacagtggtgattcaaacccaaggccatctgactgctgagacagctctttcaatcacaatatagctcctgttcatttttatgcaactacactttttctgaaatctcctccaggccttaaacttcaggccatctctaattcaaattgtgccttgatttgttttgaaagatgtcttgggtgttttctactacataacaaatgggcactgggacagagtgcctgttatagtaccagtgagataagtgagtctagctttctatgtcaaataagctggtggaatttataatagagaacaggaccacagaaatctatctgaagaaaggcagtatgtgtcattagattctgtaaagagaagccgtgcctaatagatctggaattttctgaaggggtgactaagcaagtgaatgagggagagacagtacatgtaataataatcacagctgcatgcaaagcatttttgcattacaaaacactttattaataattacttctctcactggactgctgtgaacattacatggaatgatatattattgcctcatttcacagatgaagaaagaggctcagtgaggtcataagacttttcccaaatacatattaaggaaatgatagaactcatatccaaagcaagatccctccaactcctgagttcttaaccattttattgccattcagaggcttagcacatgtttattgtgttgaatagatgcttgccattattgtggaggaacttattgaaaagaagaaataacagccatttctctgatgaccccagatttctttcctgcctctgtgttgcctttcaaatccccaagaaggcatgtttatatgcatcacctaattggatccttacaaaagtctaaaaataaaggtaaagttaaccacattttataaaacaggctactggagcattaagaaaggggttggcaaatttttctgtgaagtgctagacagtaagtacttaatattttagggtttgcagcctctgttccaactactcaactttctggttagaaaacagccatagactataaaacaaatgagtatgattgtgtctgtaactaatggcaggttctataactatagttacagaccttgacattcgaatttcacataattttatgtatcatgaaacagtcttcatttttatttctttaaaccattttaaaatgtggaagccaccctaaacttgctgctgtgtaaacatagatggcattgggccagatttgaccttgcggccacagtttgcctttaagcagcctacactagagtgtatgcctaatagctgttatactatttgcaaaaagttgagtgtttacatcatcgggggttagaggattgctccatatccaaactttatttcgggcagaaaaatagaatgtgattttattcagctagagtatcacagggttaattacacatgctttcatctggaaaagcagcccctcgtgttgaggtttatgccaagagtctatggcccaggttcagagatggcatgcttcctcatcacagtttgttcctgagatgctggattcttctcatagttccctggatctgaagttctttaggaatggaaggggcttctcagctcagggtctaagctagaaacacagtcagcaaaggctactcatgcagggggaagtaaagccggtttggaatgattggatcagtggaactgccagtgcttacctttctactacgcctcaggcacagggtagttggcaaggtatctagttgacaacctcttgcttctttctaaggagcagccagctggtgtgtgagcacttattgtcctcatgctgccctggtccagccatttccctggctctgttttctcactatctgatatgtaaatgcaagagtgacagctgtcccattgctgaagatgtattattaacacgggatgtagcatataactgcaacataccatgtggagaaagagctaaaggccatgttttacagctggtgacttaaaggcgggcagggggtagtgcacaaagggaagaatgccaactctttagtatccactgaagcagtccctcatgttgaggttcatgatttagggtagaggataatactgtgcatgaagatgctaattaactgttaccagaacactcaatccaaaaacaaatgttgactttagggtcttagcatctaattatcttgcttgcagtgcaagagacacagtgtctttgcatatacaacaagccacgcttttgtgcacaggcaaatgtgttggatgtgacaatgcaaggactacaaacacttgtggagtgtgttctctatcggtccccaaaccagcaaggacatacatgatttcccagctggacttgtaggtagtaagtatccacccaaataggggaaacccctccatatatatagaacatgtatatatataaaatatatatagtttgtgatctgcataatatattatatatttacataagatgtgtgtagtgtaactgaaacaatggatccctttgcttaactcacagcatgctttgaaatatatatatgtatatataatataaactatgtattatcttggtgtatatgatataatacatacacataaacataaacattttttcccaagtttgctgtgagctaagcaggtgtctccattttctctacttatagtcaagtatggtaaaaacaaaactcagccattttggaaattatgtacaagactgtgtctactcagcagttctgctaacttagattctggagtttggggacctccttaagggtatttcatttggacctgagatccagcattcctgggcttcccaatggatcacatatccaagccaaatgtagtgaacacaggaagactgtgattcaggtaaatattagctattattatcatcattattatatgctggatattgctttaggtgcaattttatgcatgatctcatttacttcttgcaatatgcctatcaagtaagtactactattattcccattttacagataagaaaacttaggcacagagagggtaagtgacttgcctattgttgcatagcttgttagtggtacagccagggttcatacccagacaatttgactgtcaataccaagatcttaactctaacactatgcttcctcctcataagacagaattgaagcccataacgtcctaaatgtggtggagaaatataataaatttgaagaaagatgtaaattttatctttgaacaaccagccaattaatttcttctttgtctaaacagtcttcctctcagtccaaaaaatctagttctcacaaaaatggatgaaattaaaattacctatcctttgttcatcctttcattaaataagtatttattatatatgctagggcagtaagtagagatttcagtggagttaacggctatgaaattcttccacatacagtggttatcaggtcaaaggcaccattgggaagttggtatcaagccaaatgacattgaggagtcataaataaagttgctcctgaaaccataggatgagatgagattgccacatgcaaatgtctagagctacattagccaataagataggcacctgccacaggcagctagttaaatttaaacattaaaattaaatgaaattaaaatttcagttcttcagtcacactagatacacttaattatcaatggtcacatatagaaagtggccactatactggactgcagaggtatagaacctttctattatcacagaaagtgctattgcatagcacttacctagagaaaaaaggcaagaagagaaagaaaaaagaggtgttgacagacctctgtcaccacctgcaattaggagtcagaaagtggaaaacgacgcagtaaaggagacaaaggaggggatggatttcgtggaaagataaccaggataatgcagagtcaggaaagtcaaggtatgggaatatcaaagaataaagtgtggttctcaatgtccagtgctggcaagcagtcttttgaagttaaaggtcaaaaatatcctctggaggtggacatatggggcaaacatgatggacactgatgatggggcagctttgttaaaccggcactgtgctggacagtggaggtccctagtcacagtcgctgctttcaagtccaatggggcagacatcatgaggaagtgcagtattgatttgctttttgagcaactgacttgccactggcttactactggctttaaccctgtggatggcagcatggctccttacctatctgctgcctcagtggtcctttcaaagcctttgaccttaaacattcccaaagcagttccaggagtggtgaagcactcagagctccgggagagcagtactactcagttcaagggtgttgactgagtatagtaatgagagtaaaaaattgtgtctgtgacctttgtgaaattcatcagtaatcattaacaagatctgaatggcaagcaagagaaagagcaggcagcattgtagagaatattaaatctcaagaaccataaaaaagtatcgtcaaaggccttttaagttgacttgaattaaacccctgaagttctttcaggcacatttaacatggtgattctgctgagatcagggccggagaggaacataaatctacatgatatgacagtatctacatccagtatctacatccatgtaaatctacatccagtatgacagtattggattttgatccagtacctgatgtaatgcaatttgtgaccagacacatgttcttagaagctgggagaaagtttagctttcattttgacctgtccttacttgattgttccaggtttgtttttttgtttgttttcacttgtagctttctaggcacctcttatggtgagatgttagagaacctaggttaacagtttagatatggattctaatctggctctgtgttgacccagtgacctgtcaataaagtcctcatggtacattatggtacaagaggaaagaaagctggaggacttgacagtaagctcacattgaagtggaatcctggctatgcctcttactagccacatgaccttggacaaagtagttaaacttgctgagcttcacagggttttgtggataaggaggagtggtatggacaaaggcaagcctgctagccctcagtcttctaacttgcaactaattgtctgtaaatgttttcctttgttttggccagattccccacaacaccctcccctgcccaccttggtgggttccagaatctctcttctctaactttgtaaagtggggctaacaccgaggcaggcttgtgtcagctttgtggtcctttttccctaggaatgaacactggaactcaaacgaaggggaagagggttaatggaaagaaactgctttttaagcacttgcaaagggattttattccttgctttctctttggtccaagtatgcacacacaggtacatgcacacatagacattcaaaccacacagtggtgcctttccacttattctgtttaggatgactgcaaagaattgttgaaagatggtaaatatgtgttaggtgcacgacaatataaataacatcgatctgggttaacggtgcattgtttaggaactctggcacaaacatctttgagcttaataatggttgctaaaggtgacaggagttcagaaagcagaggactcctttcattgtaacaatcatctccccacttacccccactacatcctcatacaccccaacaaggcatgcatagcatccagcagagttccaggcatatagcaagggtttattaaaggctgttttcattcataaaatcactggtgctaatcgttaggtatagagaagaggtgaaatataggatcttgaccttcactattaacagtaacaattgccatttacagaaggcctatgatgtgtcagctgctttactgctctagcctcacaacaagcctacacagctccaagttacagatgaggagctaaagttaagagaggtgatgtaattgtcgaaagtcacatgacttctaagtggcagagtggatttaggtctcttggattccacagcccataccccttccacttttccaatgctgcacttgagaagtaggccagttgggacaatgcagtggccagacttcagctacagagtaaggcaggcgggactgcactgagaaggttaaagattactgcatctcccctggaaaccagggcctgagaacagcaagctgatcttttgtagctgctccacatattttctttctcctcagccagcattagaacttcattcttcccttgtttgcttgttcagagaaacaggtgatgagaaaagcacacttgaggtgtctggagagcaatgccctgctttgcttactataaatagctccctctcagccagttgccataaatggcattttacaggggaggcaaccagtttgaaataagccctaaggagatgtcggggcatcaatattcgcttggtgtatgcagtgttcccaatctattgcagaaggttaggagtgttgagttcttgaagcaaaagtggttttgtcagatacgtgatgccatcccaagcccttggtcagggaatctgcaattacccagaaatctgcttttttaatttatgaaccaaaagccagcaatgactcagaccaacctgcaatggaaaccaaatgtggactatgtgcagtaaatatttttacgctctcagcttccactcattactttttgctaccctgttggccttaaggagttgtcgttcaaggaaaggacctgcctgctgttccggcaaacctggaatgtgagcacttttgtattaaaatgtgtgcagaccatcctaaaatgattaaaaggaggagcatgaatttattcacatgagtcgctttcattattttccattagtaaatagccaaataattgattgtggagctgttatttaattagcataaatgaaatgactgttatatggaatagaatgtatatattgattttggctgtgtcctttaacaaggataaattttcttacttctgacagtttttgtaatcaaaactctttttttgctgaaaagcaaaaagagctgggggaccagaaagcttcagggtaggctgcaggagccaagcagtttaaggaggggacacatggtatgccaagggccttgcatttcctgtgtgagaggagccagattggactcatctcaaccactagctagtggtcactgagaagagagggtcgaagatccagagcagagatgagtggagagctgcaatgccaagcatgaggacctaggaacttgctgtgtttttcttgtcagtttcagtggtccggttgctgaggtcttggctgttgattgctctagctgggatgtgtctggaaaagaccatgcatagaaatgtacggtccttgctttgagaaggtaacattctgggactaaaacctgggtgcaagggaagtgcactgagcatcaggagacatgctgtgtgaacacatgacaggtccttttctcttccccagagtacattcccccggtatgtacattgagggaggaggagaggactaggttccctgagctcagatgggaggaagaagtgtagtagtagggacatttagggatcactctggcttcccctgcatttgtttctccccttccaacttgactttgaggagcagacacagcttccttattcccgcctagtaaaagttaacttgccacagatttagagctgaatttcagtactgcatgtgctagttcagcacagtgactaacagtacagtccctgaagtacaattgacctgagttcaattcctacccttactacttttttgatgtgcagctctgggcaactcaattatccttgattttcgttttgtcagacatggatgtaataatactaccaattcacagggttgctaaaggaactgaagtagatcatccatgtaaagcagctgtcacagaatctggtgtatagtaggttctcagtaaactttcctcattttctattcctttctgccttcctgatggtcccacatctccttgcctgtccctcattgtagcactcagtatattgtcttccttattcgtctaaacaattcaaggtcagagatcctgtgttgggcattttttggtgtcttccttcctgtgctccgttgccatgtctcatatactgccagctcactattggttcacacacatttctaggcacagaaaaaaaaattcacagagaaaaaaaattcacagagcagctagctcttccttcaggcctttgactgacattttaaggatggcagaaaacacagcaaaatagttgtttttagagtttcttggaaattcacagaggttccatgctggatttgaattcacctctaaatgtctattcagcaccaagttcagaaaattgcaagccacttgggagaatatgccaagtggcatgcagaaaattgcatgccacttggaattcagcgacatacactataggtgatgctcaaagggtggggaggtgggaaaggggtgaggttggcagggaaaaccctgaggcagtagtgatcaatgcacatgatatgtaatgtgaccaagagtcaaaccaggatgctaggtatgttcctcaggcagcatgggattaggtaccaagccagtaaatggcatactaggtgcacagacagggttgtttctcatcgcacccatcccctgcctctgtgtaccttttgctcaactccttcgatgtggctccagtataggtcccttgtcactatgcaccattacacttcaggaaaagaagccttactgcagcttgtggtgcccaaggaaggcttcacagataacagaggtataattcagcttggaagtaggtaaaggactggaattagatcaagagaaagaaggagggtgttccagatggagtatatagtggacatcacctggagccagaaatatggatggcatgttggggaaggaggattaggaggagggacagaactgtgagttcaacaggatgactggagtgggaaatttacaccccagactgacaatgtaatgtacaattgtcccccaggcagcctggtattcctgaaggctgcggtctgacaaagggctggggtaggggaattgcaattagctaagagcaaatggttatttctaaaagcatttctagggctccccatttcagttagaaacatatggcactggcaagggtccttgctttatttgggcccgttgcttagccttccctggccacaaattgctatggaaaaaagcagaaaggcagctgtcctgcctgaaggagcaatcattagctaatgctgccatctccaggagcctgcctgctaatagccagcacacagcagtcctgcttcaaactggctgcccaggcagactcctcccacccccaccgcagttcccagtgactagtttggcttctccagcctgaaatttgactggacagctggagagagggagaaactgcccagggcttctggaatccttgactgccagctgccttctcttttctctggtttgacaggaattgtagcaaaggttttcatctggaggatgagaaactccttttgttagtttgctagagctgccataacaaaatacggggtgacttaaacaacactaacttattttctcacagttctggaggctagaagtccaagttcaaggtttggtttcttctgaggcctctctccttggcttacagatggacaccttttccttgtgttctcagacagacgtttctttgtgcatgcatccctggtgtctctttgtatgtcctaatatcttcttcttataaggacaccaatcagattgaagtagagcccatcctaacagcctcattttaacttaatcacctctataaagaccttatctccaaatatagtcacattgtgaggtattgggggtatttcaacctatgaattttgtgaggacacaattcaatccataacacactgcatacagttatcagagagccctgattcttttcctctctgaacctttgtctccccatcattacaataatgggttagagcaagaagcttggagttcttgtcaaacaacaagttttgcagaaaagaaatgcaagtttgtgatgacttgctaatgaatggtgtttcacagttcagggtgatttcttattctgagaataaactaatgtaatttcattatagagtttgaacttgctatatattttcatgtatttgttatttaataaccatgtttattgccttatgcaggccacatactaggctaaatgtgagaaagaaaaagctgaatgcattagatcatatttttgaattagttcttattataagtttagacatgtattccacaagaaattgttggaccttgaagtgtaaaaatcaaaaccaatattgagtttataaccattcctctaactattaacaattggtttgtaagtatagactttgattaacttaattccctatagagaattctctggttggtttattgattgattgattcctgaattccaatagtatttttaatatccacaatgtgcaaggcatggagttaggtgctagggatatggtggtgagtgaaaccaggaagattactgccctcataaaacttactgtctagattgaatctgaggctacttgtttatttcatgaaatgtgatgagtgtatagtaaaagatatgttggaggcttctaagatcacccccaggtttgatgattcactctggaacttgttgggctcagcacatagtcatgctcctggctaagatttattacagcaataggacacacagcaaaattaacaaaggggaaaggtgcatggagagaagtctggaggaaactacacacagacttccaagagtccgctcccagtgcaatcacacaggacgtgcttattttccccagcaacaagtatgacagcacacatgaaatattgtctaccagagaagctcattagagaatcagtgcctacggtttttgctggggactgatcacataggcatcttctgcctgggatgtaccaaaattctagatgcccagaagggaaacaggtaggggtttggcataaaccacattgtttgtgcaaaactatttaaacatagtgaggcacttttaccatttagcaagttttgtatcagtgtaaagaacttttgccagccaagttcccagacaccagccaagggccaaatgttgaagcagtcctttctaaggacagaagtctcaggtcctgagactggtgaagtaatgtgagtggggctagtattctggaaattaagattcccaatggcagcagcaaaagatgcaaaagcctagtgggagagagagcctgacttactcatgaagctgaaagtagtttggtatgcccaagagaaggtgagggagtcaaggtaatcaaatggacactctttgtgatactcatatccatttattttttcaaaaaatgtgcattgggtgttatataaggaactgaggacataacagggaatcaaacaaatattcatgtccttatggagcctccattttagtgcactttatatgcatacactgaattatgtcacatccattttactggaaattctccagtctcgagcaaaacatcaacatttacatatatttcgcacactccttgataagaagaaacacaagaagatgccttctactcaaaattccagttaagactgtgtattagtaacctgtgtgtattaaatgctgataaagttgattctacttggaaactatttgttaccactatgatcagaggccttggcattttgtcagttgtgagtcccatgatcagaaacccatttatgtgctggtagtgtgatttttttgttgttgttgataaccataatgaagaacaacctgttagctatttagagagcagtaagacacaaccagttcagtaaagagatcaatcagctttattcaaacaaaagagcatcattagaagcctagcatcagatcaattttgattaagtcaacaagaatgctgccatttagtagactagaactattcttgttaactgtcaagtgtagtcagccaggacacatctcaatcctgtctccatattataccactgagagttcctcttggcttaacttgaggcatttcataaaagaaacatctactttcacagagttcagtcttacactcagaaatttaccagatttggccacaaaactgaagaggttgggaaggttacagcatttatacactcatctcatgaatcttatagattgacattgtttattttcaactgaattagtctctttcagaactccagtacactgataaggtagaaagttgattaatcagatctatcctgatgtctgtacgctaaaaatccaaagtgtagctcatagccatgaaaatgggaaaccacttttggaactgttactttgtttctaccagtacaataaatttctatatatttgctacgtttttatctgacaaagctgagtaactgacagtgcttccctgtctgctgtaggtagctaagaatcagcaaggagaaaaacacagcactccagataagtaaagcttttcctagcatttagctcttggaaatgacaaaaatttcgagacatgctgacgtacaacttgaatcactgcttgaattccttagtgcctagaacaacagaacagaggccagaaatcagcatgctctcaataaatatctggtgaattaattattgaaagaatggattaattaaatatataaacacaaaatagtaattagggagtgtgcaaaaattgaaactattctgtaatatggttagttatctgggtttctatttcaaattttaagattcatttcatgtttcaactataaaaaattcatcatcaataaaaatgagttatggaaggtgcagattcaaacatagatacctttgatttttttctgacaatgaggaatggcctcagagataaatgtctggaaaataaattgttcacaaaaatatattttagattaaacccatggtctgtgctttggtccaaacaatgtgaaggatttgtgtacttcaaggcagtataaaattgagagactcaggagcataggctcagaggacagacagtcctatgtctgaatgtgtgaactccaggaggtcaggggtaatgaggtcttgtttcccactatcactagactagccatctataaactttctgatcacacacctctgcctgagtgtgcatatttatgtatgtctaaattatacatacgtatatatctactaatatatttcatatttttatttgttgtattatagagtatacgcaaacatacacagtttaaaagttgagaaaaacacatattccaatatgctctttccatatctaatttttttttcttttttgagatggagtcttgctctgttgcacaggctggagtgcagtggcacaatcttggctcactgcaacctctgcccccggtttcaagcgattctcctgcctcagcctctcaagtagctgagattacaggcatgcaccaccatgctcagctaatttttgtatttttagtagagacgagatttccccatgttggtcagtctggtgtccaactcctgacctcaggtgatctgcccgcctccgcctcccaaagtgttgggattacaggtgtgagtcaccgcgcctggccgtccatatataattgtcttgcccattcctgaggctcatgcatcccgctttggagaacacttgtctagcatgtagtccatcataggtgctcaattaataacatttgttgaattattgaatgagtttaaatccaggtttttctacttactgtgtgaacctgagtaggttctgctatccatattctaggcctttgttttgtcatccataaaatggtataaataataatagctgtgttggggggttgttgtgaggcataaattaaataatatagcaaatgttaataataattgctgtgatattgatgatgatgataacaatggaaaaacatgtttaattctccacttcttagatgaaatgatttaggtcttgccctcatcacgtcattacttttgaccatggatacacctcatatattccagttgatacgatgcattccatacacaggattttgaagtaggatctgttcctgcaggacatctgttccagcctgtgaacataattttctggtaatgggcatagagaaaagcaaaaaaggaggaggtatttaccctctttaagcatatctccaaaagtagtgcctttcaatgatataagttgtgaaagaaagatgctagtggaaatgatataaaagcaagaccaagacacacttagaagagttgaagggtgacatcttatgtagtaactcccctatctaatcaactatgagacatagagttaccctccacctgcctccccaccctcatcagaacctgcctatgcctctgagcatggatcactttgaagtaaggcaggaatgaagccaggaaaagttctgcagggactcacatttctcatttctcttctgactccttagagcccagattctgctagtctggcgtatagtgcatgattatactgtgagttggcaatggggcaatagagggtgcagggaaagaaggaaggaaaaataacttcctcacctccttttctttcctcaccccactgtctccaccactttcaccaaggttgtcctaccaaggttgtcatcttctaatgacaaaagccagtggatatatacaatcctgaactaactcgacttctcaagagtgttttatttgaactctcaggaggcccttcttccttcctgaaactctctccttccttggtttgtgtgatatcactattttctactttgtcttttaccttttgtctggtcttccctagtctccttcactgcctcctcttcctctatcataaatgttagtgtttctcatggtttcatcctcagccttcttctaatcttgctctatgcattcttcctagagcagctcatccatctccacacccccgccatgactgtaaacaccatctctttgctcatcactacagaatctttatctctagaccaggtccctttcccatattccaggcttactacttttagattatcttcactgccttacccctacaggcatacctaacactgaatgtatgtgtatatgtgtgcgcattcacatgtatgcagcaaaacaattagttggcagagagtcaaaaaaaaaatggtatgtaggatgagctgtcactttttgagtgatgttgtgcacatttagtttcctcacctataaaaatgttaaaaaaatccatttcggtgatgggttcactagaagcccacccccccatttacaaatgtattacccatgtaacaaacaagcacatgtaccccctgaatctaaatttttaaagatgttaactaaagctgtcttttggaaagaaataaaattaaaatgtccctccattaatttgaattatttaaaactctgacagtttagcattgtaatatagctggaaataattattgctctaatagccaacaactgttttcacctaaccatagttatttaaatcacccatataattataaacctttatttatttaaaaaaatggggaaatgcgctccaggtttctaacaccgcaaccatcctgttgcccaatcagaagccctagaatactctttggaacctacctcctcttcccctccccattgcagtccataaccaacgtctgtagattgtatatccacagtggccctgtgttctgttgccttttctctagtcacagtgtcattgccttaattgaggctatcaacattgctcttgcacaattgacatgctctccgtagttctctctgcctctagtcttgtggctacaaccaccatactagtcttcatgctgcagccactgaaatctttctaaaatgccaatctgaccaagtctctcccttgcttaaaggcctagcatggttccccatggcataaaggattgtgtcaaatcctatcccgtgatccagggggtcacacataatctgactcctaacaccttccatcgttttatccctcatcctatctctggaaatctgtgctccagccattccaaactgcctgcatttctaaactgtgctagactgtcccaagcctgcatgtctttgtacttgtgaaatctgcctgcatttctaaactgtgctagactgtcccaagcctgtatgtctttgtacttgtgaactctgcctgcaattttctcagcccagcacattttcaccctcccaacaattgatttgactaatggccactggccttcaaaactcagctgcaaacacttgctctgagacaggctttcctgatcatccctgaggctagatttggtaggtaggcatgggtacccgcccccctgtgattttacaatgcctgtgccacatttctgtcattacacttatcaccttttaagataattatgtgtacgtgtgtgtgtgtgtgtgtgtgtgtgtgtgtgtgtgtgtgtgtgtgtgtattttggtctctcccccctgggactaaaagctcatttaggccagaggctttgtatgatttctctagagcagctactctcttcacctagttgcctcctgctcttccttcgtttctcagcttaatatcatcttctctgggatgctttccctgacttcaacctcccaacccccaaccaatggaaggttctgtgagatatccctcctctgtagcatagaacttctcctttgcattgaaagtgcctgtttattgtctgtctcttccagtaaacactgaactccttgaagaaagggactaggttttgttcacaattatgtttcccactgcaacctcctatagccaagcacagagagcagtacagattagacacttgttaaacatttgctgcttcacttttcttttggagattgtgattttgcctcttatttctttcattaaaattgctttcccatttttttaaaaaatatttttattgtggtaaggaagcatagcatgatatctactcttaaatttttaagtatacaatacaatattgttaactatgagcgcaatgttgtacagtggatttccgtttttaaaacactcctggttactttttggttacttttccaagcattatatagttttgtaagtttggactgctaccttgtcctctaggtggcgttgtttgaaaaagaaatggcaaagttgtatatgctttcaaataaatgagtactgtatttgtctgctagtactgacataacaaaataccacagattgagtggcttaaacaacacaaatggatttttctctcagttctggaggctagaagtccaaaatcaaggtactgttaggttggtttctggagaagcctctctttctggcttatagatggccacctcttgctatactcatatatagcctttcctctccatggaaagagattgagctctagtgtttcttcagcttatagggacaccagatctatcagattagagccctgccttatgggccctaatgtaaccttaattatctcccttaaggtcctgtcttcaaatacagtcacattgggggttagagctttagtatatgcatttgggggatgcaattcagttcataacaggtatgcatcccaagattatcaaaattttgtgcaattatatgaaacaatatatttaaatcaccttggagcaaaggagcagaattagttgtaaccaatgatcaaatgttctgagtgtcatttaccttatatctcaaaggagggggattatgctgctggagcagtgcagggactagtggaagtcccagagaacctttgggcttgagaaacggtatttgaattctctcccattccatcccttcaggttactattcctgaagcctagaatctcgttggcaggcagagaagctccattctctccaggtcaagcggacgtcttcaaggactttaattttaccatttccaaggtaccaggcctccaaaagctccctcaaagaacccttgcctagaagagaaccaaaaatactagaagcagtggagatggcctcatccttggaaactttatgacctcatcccgctctggccatctgatagatgggttgagaatacagtgccaactgagattaagacctttgagaggccatgaagaagggcctttctgagtgattctgtcagtcctggctaaagaggcctgtgcccaggagacatcagcctggcgtgcccttgaagtgtttttcactcaatgctattattaagggaccttagtagctactgtgggaaataaaggattctgaaggcaaattagtatgtttattccggagtttctcacataaaatagatttatttaccgtaggctttagttgaacctttagcaagccaaatacataatactaattaccaatagtttggtgtgctgtgcagtctttcacaaactcactgatcacaggaccttttcagtcagagaatcttgatcagattattattctccaagactctcttttaggaagggtaacaatgaagaaaatcatgaaaaaagcgattgctgtgagatgcactttgactcaaataattcctccaggcctaccctgctctctccctccctgagccacctacacattggcccccagtaatgccaaattcgtttggcctcctatcttggctgggctgccttctcctgttagcatgcctttttcttgactgacttagaatttccataggattctgttgtcagccttgtttccaggttccattctttctgatgagaattggtgggcacacagatcaggcccttgggagtgtcagaacctggtttgttcctaactctatcagggagcttagagtctgccctggttacgagggaaacagatgaaatcacttgatacctttcaaatagaggctttgcttacagcccagggtagagtgccctagggagatactaagggacttgcatactagccatcttacaaaaggctaatttgcctggccacactggccaaggaagaataataagaaggaaaccaccccactgcttactgtatgctgggcactgtgataagtgctttgcatacattattcgagttcttacaaccaacctatgagatagacagaatttttggatccactttacagagcaggaaactgagtttcaaaaatctgaggagacaagcccaatgaagcatagcttagcataagcagaagagcacaggactccagtctatgcccttgtggctctagggtccctgcttttcactacttttctctgttgcttccgggtgaatctagggaggtggtgaggtccatctgcattgtgttggtcaaatcaaagagtaccttagatagctatttgaaatagtctctttctgccccctcctgcaagagccaattacttttaggaaatagctctgtggtcaatagaactatttttttttttatagacaatgatctaggttctggtagggaacctacaactccagtcttcatcctcacaacgaggtgctaacttagatcctcatcactgtcacctgtgtctcttaagagagctccctatatcctatcttcctctttccccctcatattctccactctgcagcccaggtcacctttctgaatgtcatttgattcctttctggtgtaaaacctactcaccattgagataaatccaaactccttaaactggcttcctaaattattccctgcctatttcttcagtgtgtacctcccaaaccctctcctctgtgccaaatctcaccccttagtctgtggacatgccaaacaacttccagtttcagctgtgtcctgtttagtttcaggtaatttcacacttctaaatattctccctcaccaacctcatctgccttgggaacagctgttcaattttcaatgctcagttcaactatcacctgctgtgtgaagtttttctggttccctctcaccttctctgagtcttgccaggcctggtacagcctcagagccttatattctttaagatggcactgattgccttctgcaggtatctctcatctccagacaagctccttccccagcagggacttgggattatttattctcgtgtctcaaacacccagaacaggcctaatccataatgggaacccaggaaatgtttgctgaataaaagaatggaaaggaagttttcctgaaatagagtaagaatttgacattaattttgaaattggccaagagaatcttcaagataaatgaaatgaataaggattgtaatttgatttgttttgtccctattgtcgcgagatgctaacctggaaaaatctaaatatttaatttatctttccatgaaactcctgagaggaaaaagaaattgttgaagccggggttggtgccttgttgttgggaggattagcatgcaactgaaatacgttatttctccacaagggggtgctatgaacacatacgaggccattctcttattcttcctcagagagagagaggaactgcacaaaccaagtaacttttttattttccctgcattgtatacaattgtgcaagaatggaataactctccaccgttgccagaaaattatgtatgcctcggacaaggcttcctactaataagattcacactcacacacatacccctaactcctttaaaaggttcaggcatcaagtttaaagatgtatgatttgtggtatatctggaatttgttcattgacagatttagatgttatgtagtatgatgtcagaaacacaactgaacagaataaaagcatgcactatgctgcttttaactctcgtataggatagaccattttagaggaagactcatccaggtgtcagagatatcagtcagctcttgtcagtaataacacgtagatatagtagtaccagctgtgtacacttgtttagatttgtttcttatgaaaccatgatgggcagcacacataacacagtcaatatttgggaaagttgtactttgtgtaaccagtggcttaagcaaatcaaatcttgtcttcaacatctcatctccagtttctaccttcagcatattttgatggccttggattctgagtaatatttttgaactgtactcatgtatgtcttcccatttagactcgttcctttaacccctgggctctgtgtgtatgtgtgtgttttccatatttataactcctgcacatgacaaaggtcctgatacattgtaaggactcagttaatgtttgtggattgcttccttattgatctgttttcacaaaaatgctgccaaaaaatgtcaagcaggataatgatgaggttacaagagagacaagtgaatgggcaagaagagactaagggtaaagtaagaggactaacttccattgactgcttacgaaatgccacgcactgtgctgaggactttatataaatatctcatttaattcttataaaagcccaataaagaaataattatcaccccagtcccaccacctgtttttgcatgattgtggccatgatatcaaaataatcaaatagatggtatttggaggtatataatagtctttacctatgccttccatacatcagggcctcaatggtgcttgactaggatttgcactgtgggttagtatagttcatgggttgttatttgaagctgactcttgtgttcatgcaggagggcaggaatcttcctggctgttctgtctgcccctgttaccctcagtgaaaatgaaaggaagcacagtacatagtggttgacaggaatgaaggtttccaaccttctaactgtggttggagagcttcctgtgtggcatttcccctccttcctggaactctttagtattgtaggaaatgagtgacttgggcaattgcgatagacttcaagcaattggattcactgaagaacattttatggaggaggaggaggaggaacacaaaatcttgaaagctctgggttgagagaaaccatcaagggtatccacgttaaccactaagcaagcttttgaatcccctgatagtattccaaattgccatctctgtgaccttgaacaaaaaacttcacctctcttagtgagtttccacataggcaaaaacaaaaacaaaaatgaaaaaaactaaacaaaaccttctagggttgtcgtgaagatcagagagaacgtactcctggaatatattaggtacccagtacaagttttaaaaatagactttatttttagagcagttttaggttcatagcataactgatcataaggtacagagttgacatataccctgtgattccctggatggcctccccactagaaatatccacccactggagtggtacatttgttacaattgatgaacctatattgacatgcccttatcaccgaaagtccatagattacataagggcttgctcttggtgctgtacattgtctgggtttggacaaatgtataaaaggccattatagtatcatacagaggagtttcactgctgaaaaaatcctctgtgctcctctaattcatccctccttccccaccaacccctggcaaccactgatccttttactgcctccatagttttgccttttccagaatgtcatacagttggagtcacatggagtaaccttttcagattggcttctttcacttagtaatatgcacttaaagttctatgtattttcatggcttgatagctcatctcttttagccctcttttatgccattgtctcgatgtaccacagtttacttattcattcacctactgaaggacatcttggttgcttctaagttttggcaactatgaataaagctgctataaacattagcgtgcaggtttttgtgtggatattagatttcaactcatgggtactcagtattttttaaatgaaaaatatatctgtccttactcccataaattcctcctttccatcaattcttcccaaggtgagggatcagtgcatacaagaggcccaatttgcagcaaaatgctcattaattagccaagaggctgcggtggcacagcaagtaaacaacgtactacaaatctgtttacagcggcttctgcagacattttaaaacaattaaactgtcaagggggcctggagacaagagctttgcattttaataggaaatgattaaatctcaggcattattgccttcgatgtgtctaggctttaagaagagggcagagtattgattgaggcctccaggaaggcaggaagcttacttgtgctgcttgaccgcaatgcagtgaaagcttggagatctgtaactccttgggctggaattaaaggccagtagccaaaaatttaactggatttgtcaccttctgtttagttggactctgcctgtaggaacagatgatagatcatgacctccggggtattattcgtcaattggcagagagagagagagagagagagagagccccttgctgatggcatctattagaaaaggctgaatgacacagcgccatgtggtgacctcagtatttacactatctggattaaaaccattgtaaagcaagtgaaagccacccatgtagtcactgcctgagtcaactaatgcaaactgcactctaacctgtgaatatgtgtgtgccacagttatgacggacacgcagtctcaaacatctagtgtattcaccttctctattgatttcatctattcacaggtgctggtcagatcacatgtggttcttgccctctagctactcacagtccagtaaatgagggaacatgtaagcagctgggtacaatccaatacagtgatagatgttgttggctacagtgaggggaccaaggaggtcacattcaaattgagagatgtggaggggctggcagaaaattctttctagagaaggttctacttgaaagattagtaggcagacaaggggacaaggacacttcaaactgagggaagttcttgaacaaacctgtggaggtgtgaaaaagcctagtacattccaagaacccagtctggtagtgtggaacgtgagtcctctggtactttttaaaggatggggtgaccttagtcctcaggtttaaaaacttaatcaataaatgatgacgttattgaaatatatcaccacataatgctaaatagaacaggtgagcactaccattctctgtgcctttctattgcttaaaatccttccatttgtcatacttcttaaaagtatgccaattggagaacaagacacttgcttccaaaatgagaatacctttgtgaaaattgacaaatttgtgtgaattagcttaatcagattgctttcttccacaacacctgaccaagaccagccactctgatgacgaggagaatagggggatgtggaatgcaaaagaaggtaggagcatggggtactgagggtggagagggctcctcttgcagtggaattacaggcagctagggagcagcacaaaggccctgcatggctgagaattagtttaggggaaaggaaagagaggatagcagaaataaattttacctgacttgcaatttggctccatgtcggctctcattttgtttatttctgtgctgtctagacatcaacagattgagctgctcccatccctggggacccccttccccactacactgaccagtgcagccccctgcagggccattataagaagctatggcacagctgaaagactgagtctcttgattagacctgataagaccactcatattaagatgacttaattttgtcccttgagaaatgcctttttaagagctcccacattggccaagagagactgcctccatattaagcttttctatttttgtttgaaggaagttggcacctctcctgtgtaaagagtttgctgaagcctaaattcttccattagccattttggtttgcaaacagggatctgaatatatgcagctttttacctggtggcctgagcacttgctcagcttcccaaccagagaacaatggggaataccccatggccacattctgaatctgatcatctgtgcttctaagcatgattgactagttaaaataatggttttctgggaaacaggactggctacagaatttgcaggggttagtgcaaaacgaaaatgtagagatccttgttcaaaaaattgttagtttcaaaatggtgacagcaaatcattaaacccagtgcagggcccttctcagagcatggccctttgccgctgcataggtcatgtgtccaggaggtagccctaccaaagaacagctattttgcctttttgggttctaaaggctcctgttgttcaggtccctgggctgtggatggctattggggtataggggacggtgtttgatttcagggcagaacaaattttctccatcctctgcctactgctgaaatcccatcctcagagctaaagcaattttgttgaggctggatccctttgggaggggctaacatttgcagctgttgtctgttacacgcttagtgttggatggaaaagtggagggagagagcacaaggcaattttgattatgcagagaagcttatgaaaaaatatgtaagtttatggaatgcttttggatatacattatcttcctttccatatagcactgaatatgggtactggggcttaataaatatagctcctcgtgggtgttggtaattcttcaatattcattgatagtgacaatattcagaacttgagacagatttcctttctctctgactcgagggcagttttcccagagccacacagaaggagaatccagtctgttcaaaaggaaagactcatttgatcccagaataacttacatttccatttctatttgaatttttaacaaaaatagtgggtcttccataaagcaaaaataaaaagcatggcaattttgtttcagggtttgctttttcttaaaattttgattcctatattaacactattgagtgcttcagtaacgagtatggtgtaatgctaaaatagtctgtttcttgctctttgttataattagctaaaagccttttcataggctgctcatagattttctgaatttttaacaagggactttgatatgaaaatataattttgtggcacagaactaaaagttctggtagaatttcaacattttacgtgtaattgttacagaggattgagcaactataattcttacaaatgtctattttgcttgtagcgttttctattcatcaataattcaatttcaaaataaaagacacatttcaacatcccaaacactatcggggagactttcagattcctgactgtgggagaagtctaccaaataaggcagccagctccaaaaacttctctaatgtgctgagggatcctgttacagaccgtttttcataattctagaaggcaaaataaaattttatgcttggaaataataagtttaagcaaatagtataggcaaagcttatgtctgagtccaagcaatggtctgattactgccagaacaatactgctacatgatgaatcattaatgatctgggagagccataatggtctgtcactaatgcccattaatgatctctctatactgagagtatgggcttgatgtttctggccattaccttggagaatactttagatatgccttaaactttctctgatctcctctctctctgtgtctgctccaaatgtagacagcaattgtctgggtaggaccagcttataaagaagcatggctttgttaaggaagtcgtattcaggtaagatttatttctgcaatgtttttgatggacatagatttgaatgtttatcctggacattaatgcctttgtagaaattaacaaaattataccagggatctttctgctgagatatttttcgttctggatgggacaggggttcttgattccctttactccgggatgtttgacgttaagaatggattcttttggaaaaatgcatcatttttttttttctgggaggaatttaaaatattaattgttataggaaactgaatgtgtatttctgaccatttaaaactctatttacatttagaaaatggtggcactaactgattcaagagagatttcctacttctagatttgcatttattctatgcatacagcacaaaacattaattttaatttctaaagaaaaaagagaataagtaattataattggcttttaatgtatttttcttttagcttagtgaaagaaaggaaagaaagagaagatgacacttagctaagggaaggtggacacaatcacactttaattttgacaaacttattaggtgtatcttcagggaaatcacagaagataggcactctataatgtctcagcgaaactaggagagtatctgttcctccatggcggcaaggcagatgccgcagatagctgatggaaccaacgcccaagagcttccagctcacggagaaaaacaagctgagagaaggttgccggagcgaccagtttcaagtctctttgaaaagagcaggacagggattcttttggaggagtgaaatcactcctccagctacatttttaatgggaagtttttacatgtaactaataaaaaaatggttttgccaatcttcatattagctgaataaagcaacctcatgaagcaaacactttcattgaaaccctttgcacttgctttattgttgaacctgaaagaatcccagagaactcttaaccttgctaaatgttttattttgctagaacattttgtccagatgagtaattattcatggtgattttctgtttcctcaaaatccttctctctgtcctgaaactgctgagtagcatgtgtttattcatgtaattaactgggattaataggctttctcttctgagtacttcacaggatatcctcagctatttggagttctcctagagcatccccaaatggagatttggattgatctgtcatgttgcatgagcattgtttatctgattgtttttaattggtttccccataaaattgagagagaaaaaaagcttatttgaaagattagtacatcaagggcaatattagtgatgaaaatcgttacagaatttgtgagattagttcaacatttaattttctgattatttccacaattcatgtctctaagaaacccgttagagttttcaccttccaggtggtggacagcttataatcatcattaaaggcaggagctacagactatatgcctctttactcaggatacagtatatgtggctgaaacaagtacactcatcactctgcttgtaaagtatttgagtgaaacacacacactaattatttgctgagtaagatctgtgacacaggaaattctcaccaaacaattattttattgacatgtgagtctatgaattggagactgtcaaattgccatctaagctgtttggttagattcaagcacaaactaactttatgcttacaatagacttataggttgattgatgaaatgttataaatagacatgtccatttttaataaatgtatgtttgtgggaaactgagcccctttgcagaaatgaatgcaagctgtgggacagattggtagtgattgaaaatgctgcagttgctcctctgaaagaaatattaaaatatctgatatagcataggctctgagttcatggtagaacaatgcaatgcaaatgaaatcaggagaaaggatatgcagccaaagaatggcgagtcgcaagaaaggtcacatggtttatctcttagccttcatacgggaaaacacttcaacccttgtacacagatgagactgtcccagccaccgcatccacaagctctctaaagaactcatttcaaaagctctcaaggcaagaacatccatcctaagttctccatctccagttaagtctgctgcctctcatttgatcctcagggaagctaaagaatagacagcagctgtgctctgtgtaacccttcccagcccagaagctctcatgattatgcttatttaagttaaggaaccctagtttctttagtctaccctttcaatcttgtttttaacctaccttatttagctcacccatttacttctctaaatgtttttgtccttgttgtgttcccctctgcttgtccacaattacttcttcagctttttaaggtcctttcgtgttcttttctaagtaattatgagtttttctattcagtggctattcctacacctgcctagtactccatgtatcatattgacttagagtttctcaaacagcacatgaagacagattttcttctctcggggaagaaaacaatatatttacatatatatatttgtgtatatatataaaacagtatatttgttaatcatttccttagctgtagggacttaggaaacaatatgtttactaatttttttttatcaataatcccctgtccatttttcaggggttgcaaatgtgtactttcagctgttctatagatcactcattccaaacattgagtccattatcacctgggcagtgcctcaaagtgctttctcatgatatgcagttccaactgcctggccctgggcttgtgcttagtatatacttagtttttgttgagtaactgtatatgcccaaaatggctgtatagaccactagaaaatatttctttatattttctttgggaaaatgattaaacaatctagctgatcttataaaacaaagcataaatgaccatcttcaatttgggtttctagaatgtatagcggtagtctatatttgtcttttgccatttgccttagaaactggaagatttgaactgagaaaactattacaagtgaagacatccagggtggtagaaaaattcaccccagcagctaagctcttgagaaggaaggagagtattcaaaaggaagtgagtgcctcctgggtagaaggagttctgtaagtcccccttgggagtaccagtctcatgggagaaaaatgtgccataacttttattttcattccggcagggccactgggtatggcctaaaaatttaggcatatctcaattggcagtataagtgtctctcgttttataaaataaaattgtttccagaaaattatatgtaaatcaaatcccacgtgaaatccacatgggatatgcagtaaagaaaggagcctttttgtgagtgtttctataaagcgaagacttataatagacgtattaaaatgattactctttaatttatccatttgaaagtctgagttctaaaatgtcagaatgaaaacaagatatctgcattctattcagaagaaattatttgaccaaagcttgctaagcttatgtatgctttaatgtaataatgcctcatttgtgagtatgttaaaaatggttacatttaagtctgcttactttgctttggaagtttctgaagagcttattggtgtttcttactatttagcagctttatctgatatgacattatattattgccttctaaaatagaatttttaaaaacttcatccaaaggagccatgaataactggcatggccacttacttatgtaaatagggtatacacatatctcctggacccaaaactctaatctgttaccatgccaattccctatatttagttcaacatgccgctgaaatgtctaaatattggctgtttcccaatgtactccatcctttactctgttcttagagaatgaagagttatgatacaggaacttcgccttgtacaacagagtaggtgttatttaggcacattccaaggctccagagcagtcagccttggaggtgtttactaggactctttctgtggttggttagtgcatgcatctctgcgtaaatacaaaatataagtgttctttgtagtattcattgttccactaatgcttaactgcatagctgaatgagaagatatttttccagctctaatactagctaatatgataaaatctaaataaagtctctaaataccacattcattatgtcccttccttatatcaaaacttttactggcttcactttgaatgccaactagttggaggcagtgtttgatgttattctgtaagcaaagcctacagtagtctggctcaacatacctttctagtcttatctccttcctttcctacaagaactacttcagccaatccaattgcctcctagaggaatttgcccaattcattaatgtataatctatgcagtgctctctctgtgatgtgctagacaccaaggaaggtgccaagatgaaagaatcatggaccctgccttccaggaaggcacaggctggctgcccagctagcttctatcagacactctgtgatgaatgctataaccaaaataacacaaaagcagcagaggactagaactaggaaagatgctttctgctggctggatttgggatagcctcatcgaggaggtataaattaaccagggacttaaatgtatgtgaaaatttggtttgtgtcctctgagatacctttcctctcctgacaaccaaatgagatttcttcacctctagaactctcacagtacttactggctaaaccaatcatatgacactcatccaaaactttcttacattgtttttacctttgtgctcattttcccctctagattattatattcctaggaggcaaggcccatattcaacactttatttccctaactgatagcacagaactactaatgagagtaactacacatgtcatttatgtgaaaaaaaaacctgattgggttctgagaattccttgacttagttaaccactgctatacagtagaataccaagataataagacagatgacaaaatgactcaaatttactactactggctgggaacttcattccaaaccttaatatagtctcctgggaaactgcactggattgcatacaagctgtgaagattcctttgccttctttcattcactcaacaaatatgcagtgagaacctacaataatagtccaggcactgtgctagcttctaggtatgcagtactgaatagaacatggaatatatagtctagaagcagttcaaacagccttttggtccttttcccccaagtcacatcatgaccctgtcctatatagcttttctaaatttttttgtccccttgcgctgagcatctatcctatatatcttagtactccaaaggaaaacagtccaaagacaaaatgtcaggttttcattttttttttcctgtccatactatttcattctcagagtatgtgatctgcttgatccttgttaaacagtctcttggctcctcttcattaaataaagtagtcttaaataaccaccctactggttagactgtgtgatcaaaaaataaaaactaccgtttgttaagtgtcaactacagcccctttcccagcttgtacactgcacaggtgtaactcattcatacagtaactgcacaatgtagattattgttttcctcattttaatactgaggggaactgaggctcagagaggttacataacatgaccaagatttgtgattaatgaacactgaagccagtctttggttcatgtaatgccatcctatcccagatatagtagattttcagcaagttttggtttgttcattggttgattgttaccattctgattgaaagatctttatatattttagattacagtataagaggttgttagtctttggtagctattaatcccaggcatgtgtgtttatgttcctaatagcaattacatgaatgctttatgcttaatagaaacaaagctattattttgatgcttaaacattctttaaacatttttacatgaatacatattgataattcatgtataaataacacaaaaagatttagaatcccagttacagtttctgtaagatgcccagtttcaaagatccaactaaaaataagtgtcagctcattgcaataaaataaaataatctgattttatagacatatgaaagctgactcataacactcataactcatgaaaatatccaaaatcacattttgagcattagcttcaatgttgtctaactacattatttctatatgggaaaattctgtattctgggctgaaaattctgcagcccagctgttcccaaactttagtgtgtgccatcaatatcctctgtgaaactggctaaaattgaagatttcaagctgagttggttggaacccaaggatctacattttaataagcactccatgtgattctgatacaggaagaccatccacatctcacttctgtaagtattcttctgcaccagtgactcactagtcttcattgttgtcgtcccctcgcccatccatacacaagcagttgtgtattgcttttaaagtttttttttcaatttaagtgtaatttatataaaataaagtgctcagatgttaagtacttttatcagtttttcaaaatacacatactcgtgcaatttattcctctttcaagatctggaatattttcatcaccccaaaaaggttccacatgccttttcctagtcaacatttctctgccaccagaagaaaccacttaatttacttctatcaccataggttcgtttttcctattttagaacttcatagaaatggaagcattacattttgtgcttttttgtgtgtctggctactttcacccagaatactgtttgtgaaattcacctatttttctgtgtatatcagtaagtcactacatgttatggctgactagtatccattgcatgaatatgccagtttgtgtatctattctctcattcagagatatctggattgtttctagcttttagcttaaatgagtaaagctgctataaacattttttaccaatctttttgtggacaaatgtttttatttcttttggacaaaaacctagcagtgaaattattgggtcataaagttgatataagtttaactttttgagctactgcctaagaattttcccaaatggctgtaccattttatatccccacaagtgatgtatgagagttctggttgttctacataatcatcagcttttagggttgtcaattattttcattctattcattcttgcatgtatatggtagcattgcatcttggtaataatttgcatctgcctaatgactaatgatgttgagtgctttgtcatgtgtttattggtaatttgtacatattctttaaggaagtatttgttcaagtcttttgccaatctttattttcttatcttattgagttgttcacagtagctctttagtatctttttaatgtctgtagcatctctagtgatatctccacttctatttattatattaatgattcatttttttctctcttttcttggtctatcttgctagcggtttaaaattgtattaatcttttcaaagaaccaacttttggctttcgtgattatctccatttgttttctgtcactgatttcctttctcatttttattacttctttcttcctacttatttggggtttaattagtttttttcgtttcttaaggtggaaacataaatcatttattttataactttcttctgtttgagtgaaggcatttaaagctacaaattttcctataataacagctttacattaacttcattgttttgatatattgtactttatcattcaattcaacctattttctaaccttctttttgattttttttttttttactcatgacttatttagatatataatgtttgatttcttattgagggggtggtctatgtacattctggatgttaattccaagcttgatatttggcagtcagataacatactctgatttcttatgaatgtatttaaatttgggttatggctcagcttatggtttacttggtgaatatttcacgtgaattaatgtgttatttgctgttggtcagttctatacgtttatatcaggtcaaattgattgacagtgttgtacaattcttccatattctgactttgtatacaatttctgtcaatttttgaaagatgagtattgcaagttccaactatgattatggatttacctatgttttcttttagtgttatcaattttttgcttcaaatatgtagtgcctttgttagtaggtacacacacatataggaatttgtatattattgattaattgaccattttataattatgacatttcccccattatctctgataatatccttcaccatgaagtccaccttatctgatagttatacagccacaccatctttgttaggattagtgtttgcaatgtgtatgttttctatcttttgactgttattgtttatgtgcctttatgtttaatgtctgtttcttgtaagcaatatgtaattgagtctctcttcttctagctcccaaattctgacttttatttcgtttttcagtccattttattgtaattgttgatgtgtttggatataaatcttccattttagtatttgagttctatttgtcccatcttctctgtgtccctctgtttttcttttttaatgttttgggagtgaatcaaataacttttgtattacattatttttattatttttggcagtttctcaagattacaatatgcatctttaaattatctctgctactttcaaaacatattctattacttcacaaacaaggtaagacatttacaacattattcttccaattttcttacaaacttcatgattgttttctcatattttattctgtatgtgctataaacctctcattacaattttattatttttaatagcagtcaatactcattgatgtaatttctatatacatgcacacattattattatttttttattattatactttaagttctagggtacatgtgcacaacgtgcaggtttgttacataggtatacatgtgccatgttggtgtgctgcacccattagctcatgatttacattaggtatatctcctaatgctatcccttcccccctcctccaccccacgacaggcctggacatgcacacattgtttttaaaataaagatctttaatattttacaaatttatttactcttcgtgtttttcatttcttcctgcagaattggatttttatgtgatataattttccttcattataaagaacattttttgttcatttcttttagtgtttatctgctggagaaaaattctatgtttctttttttctgaaaacttatttattttaccttgatctttgaagaatatttttgctggatatgtaattcaagtttggcagattttatttttctttcagcactttaaagatgagatattccattgtcttctttccctcattgttttggtcagcagttatatatctctcttattgtagtcccactgtaggtagtgtttctgttttctctgccagcttccaagattttctcattatctttggtttttagcagtttgactatgatatgcttagatgttttttgtttgtttgtttgtttgtttgtttgttttattaggcttatttgatattctctgagattcttagatacataacatgttgtctttcattgattttgaacaattcttggccattatcccctcatatacttctgcttgattctctcttctcctgagactccaaattactcatgtgccagatggtttcctattgtcccacagatatcacacactgttccaattttttttgactgttttctttctttctgttgcatttggatactttgttttcaaatgtatccaagtcacaaattcctttctctactatattcagtcaactgattagctcttaaaaagaattcatctctgacattctacattttatttctagcttttcaattttttctctatttgtactttccatcgccatatgtaaataatacatttattcaagcatgtcatttgcttttctcactagaccttttaaaatatgtatcatagttattttatggtccctgtttgataatcccataatctgggccatctctgagactcagatctatcacttgagtatgtttcatatattcttcctttttttgtaagtcttttcttgttgtttatctaatttctacttgaaggcaagtcactatgtgtaaaagaacagaaactgaagtaaattatgtcaatgtccaaaaatgagaataccttttcttctattaggccattagtattttgtttgggatcaatctactcttatattgatctagatctgagctttagtgacattcagttcaccacagactttaccttatttaggagcaggatcaccatcttatctacagcaatgctttagctctgagtacctggatggtttgtctctgttctcttaacgccatacttctgcaagctctgtgttccataacacaggcaggagggtgttttctctcttatattttttacacttcacaacagtagagggtcaatgggtggtaatcagtgtactgaaggtactcaatgcccatggggtgtctctcagatgttattcctagccttcctgtactatgcacctaggactgggagaggaggtctctctcagccctccttcccctctcccaatagtagatggtcactatttcccactcattgtaaagcctagagtgtgggagggttttaactcatactttctgaaatttgtttactagcatatattagacttgtgcctgaggaccattatcgcagaagtatgtgaactcaatataatgtaaataaaatatccaccagccacctaatattccaaaactctgtgcatacttgagtaagcaataattacacacattgcctggttaaacccagtctccaatttggataccagagtttgttcttggtaaattttaaatgaaaatagtctttaaagtttcaaggggcaatggctcaagggatggagtatttgggaatgggagatactccccatttaaatgctagatgagagatggattccactctgaaactctggagaaccaggagttataacccacggagccaaaacaagaaagttgcaaaaattatatcacttagagtgaaatattatcaaataagccattccatgatggcttatggttcataaaaggctttgatctaatataaatgtgtttatattttactgcatgtaaggatcctcttcagagtattaattcacgcatttttctttagtttttgctaagtttgactttggaaaggataatataatatgaaaatattggatgaataaaagtcactgttaacatataagttttcccatctgtcttctttttcatatttattgttacaaccttttgaacttgggagacattttttgcacaaaattgaaatgagttacatgaaattaatgtccaaagatgaaagcatgaaattgcagaacatatatgtttttccatctctttattgttcatgttcactgtaatgctttggggagcattgtttatgggctatatattcaaacacctaatttaaagacaagaaaatattaatcattagcctagttccacgtttttcctaggtatattttcttagtagagtatgaagaatgtattagcttcacattgatatcctatgtatttctatggtaaatctagaactgttctcccatataattaaatagggtggatttgttccacagttattttctctatgcatctcattgtatttcatcgtgtagaaagtaatgtgattatgggctttagtcagaatgttattttgttcacttaagattcattctcaggaaggttgaacaaatttgaatttcatatgatagctttctttatgtgcttcagtaactctctccctttatataagagaaaatcttcttgttgaagagatctacagatctccccagtgcctggggggcctgaactagcagcagggggggcttcaatgaaggctactgcttcctgtgcctcattgataggggtgctatgcatatttcccagacagaatgttggtgttgcagttactaacccttctagatatttgatacagagtaaaatttgccttatttcctaaagcctctgagttaaaaaaaaaaaaatgaatcttattccttttcattatgtgatgtcgggcaagttagtctttctgagcatcactttccatatcagaaaaaaatgagatacacataatacctacttcgaaggattattgtaacgattacagatatggtttataatgagcttggtacttggtaggcacttaccaaatatgagctgtcattatggcagcagagcgaagtgttaaaagtagggactccagagccagactgtttgtgaccaaatcctgattctgatatgtactagctgccatttgggcaaattgtttaacctccctacctctcagttttatcatccaaaagttaggagtaataacagtacctacctcatcagtaggattaggttaattaatacatgtgtaagaccagtgtttggtgcatagaataagtgcaatataagtatttgctattattcttctccatttcacacagcccatagtagggcaagctgaggagatgggaggccattagaggtctcaactgagtatcagtcgtctcagttggtctacagtagataagagattatgactttttgtcaaaatgtatgtgcagataaagctgtctttaatagtgtatgtacatcaacaagaagaataacaaaaacagcaactacaatttattgagtctgtactacatgcgaagcacatgctaaactctttacaaatattaaccatttagttctcccaattaccctaggaggtagacactaaagttatttaaatttcacaatagaaaaaattgaagatcagagaggttaaatagcattctaaagtcacatatctaatgtgctactggatcaagattcgcaattaagtttcctagttataaagcccatgctcttaaccactctgccatatagtcctcttctgcactaagggggaagcttaccccagggcttcaggattcctgtgctgcatgatttttttttttcaatttgatgtagcaaatgaaaaccctcaaaactattgtctttttgattagtggtggactaactaaattcgaagaactttcatgtccataggccttggaggtcatgtaacttagatctgtcattttatcggtgtggaagtagatgcccagagtatagatggagctttcctgaagtttaagacgagttggcaggaaaactgatactcaaaccccaggatgttttttttccgacattccaccaagcctgtagtttgaaaaatggcaatgacaatgcaacttttatacaactcgatgctgtttctagttatgtgcaaacccataacaaatgttgccttattataatgcctagtccttacttttgcaaatgcaaagtcatgctttgttcattaccaataatataatatttttacaggagggttgtgggggggaggaacttcaagcttcctgagtacctataagtaaatatcagtagaaatacatgccaaataccgttaggaaaaaatccattatattatcaatactcattgccctaaatggcatttctctactgcaatcatgaacaccatctgcagccagcttccctgaagaagtacagacttgaaattcataatgtctggtgctggcactcttaatgctgaaaaatcttaccgtactgcttaggaagaacaagtgtgcagtttctgattgaatgagacataaaggaactgttcttgacccattttgacttctcgtgcactggctcttagatccagggagttttatcccctgggtaaataaccatatcatggccttcagtagtctttacttgttgcttttctattagcagtgacgaaggatgtgcatgcttctcctacagacctgttggtgcagtattattcgtgtactcaagatggtccccttaactccagaaattataaagttagagggaaaaaaagactgagtgaaaaataggccttattttacatacatcttttccagtcccataataccgcattacttatttccccatagttcgaattaagtagaaactctgttcagaccagatggttctctgaggtggtttccagatcaaggtaagaaatgaagtaaactgtaagttgtaaaacatattgaaccatagctcgcaaaatagataaattgaagccaactatgatgtgaaagacaaatgaaactccaaatatttttaataaacttataaaaatgttttgaataattttaagtttacagaaaagttgcaaatatagtacagagaattcatatatacccttcatctaggtttccctaaagttaacatactatggtacatctgtcaaaactaagaaatcaacactggtacattattatcaactaaaccccagactttatttggatttcaccaggttttccactaaggccctttttctgttccaggattcaatccaggatagcacagtgcatttagtcattatatctcctcaatctcctctggtttgtgagagtttctttgctttttattggtttttagctcagactgttttaatagtaattccacatggcttatgtgtcctaaagataagaccactgactattccagcaattcgcctagtttacaaattctaacctgcgttgttaagcactatacttaaaaacttctgtcctaaaatgaattacctttgactaaccccagccttgaaaaccctgtaagtactctttgctaactcctcctttttaacatagtactgagactctgtcaagggggactttctcttgcttagtgtgtttcacatacccagctttgtatgatcagcaggtttctctggtagtctttgtgtgagggctttgacaaaagggtctatgatgataccattcaatcatctactaaatgcaagaatcccttccacaacatctgattggtactggaataggtctgtgtgatcccatggcccttctatgaacattgccagtgacaagacattgattacctttcaagatagtccatgctacctatttttatacaatccctattgttggaaatgtcttcatcaaaatgagccctaatctatttccgtgcagcttctcttcctttgtcttatttctgtcttccagaaaatcaaaatattggatggaaagtaagctccgtgtacagttccactcaagtggtatgcaaggagtcggacacgattgggtggtcccagctttgttcacatagtgtcacttgctggttgtgtgaatttgggctaatgactcaacttctctgggccttaattttcttacctgataaaaacaaaacaaacataaaaacaccctacctcataggagtgttgtgaaaatgaaagaaataacatatgttgaagcacctagcacactgacaagctcagagaattctcttaacaaatgatagttaccttttggtcagatgatcaccccctgagtacccaagatgaaatgtaccatttatgttatattgcattattgtgttattagttctgcttcacagcagtgaattgtaacgttcccttcttgttaactaatttcttaaaaggtttaattttatttttctgttgacctttttttcccctcgagacttaattaagttgttactgaacagaattgaagtgttaaataacctaagatgatgggtttctagcattcatgaattccacgcatcgccaaccggtgagattagtcatggcagtggatgagagagcttggcagggattagcaaatactcctgttaatcagcagaatgcgcaaattaggccctggctcatggcattgatataaatctccatggcaacaccagggtgagctgtttacatgtgaagaagtgatttcaaagctgcaaaggatgatagaaattactgcaatgaccataaataggaaaaaactgaggaaaggagaagtattcccacttcttaaagaaattcatacaactttctataaatttagtggtagttttaccatctctgagcctctactactggaaagttaattgacagtgatataaacagaaagaaagtaagagggagtagaagagggtctgaaatcattcataaaatatacaatccatccctctgaccaaataactataaatcaggattatttgcatatctgtgtgtagcaggactgtctgagttagtatcctacttccaccatccattagctgtgtgaccttaggcaaaatttttaatctcgtcgtatcttttctcctcacctataacataaagctaataacagtacctacctcagaaggttgttatgagatttggataagttaacacatgtaaaacatttggaacaatggttggctcagagtaaatgcttgggaaaatgttagctgctattattattatcactgttattattattcctgttagttggccataattcttgaatatagactacctttctattttataccctgtaaagaaactacagagtgggaaaggttatatttttcattttctaattttgtttgtgctggaaaagagacttggaaatgtcagcactagagaggttttatagatattatcattttcaatttcagtacaacacttaagaaaatgatagctgtgatactagttgaagcataggatccaagtaaagccactttattatttaaactctcatcaaaacccgggagcaggtggatatctataaaatgtgatgtgatcaaaattgaattagattatctcagaaatagagctacctttttaaacatatatgtagctctgaaaattaaacccaggcccctgtcctctcatggaccaattttctctgtggtttcagctcatttcaccttacttgtgtctgttggttgattaggcttctaatccaagcaggataattgccgtaattcaagtttggattcaattttcagtgcttacatttgatgggagattattcaaatagatactgggctgtttgctttgtgaggtcaaaattgttgctacttttttattaatgccaacaaatctcttgccagtcaccacccagtggttcaaaagcttttggaggcagcctaatggagctgaaagggagtgagactaagagttagaaaccttggttggaaaccctgctggcctcctctaccatctgactcttggtcgttcactctcatgtttctttatttgtgtttcaattttattttcttgtgcacctttttgtaagccacttcaattcttctttggaatgaggtaggtcagcagtgacaataaccagagtaattcatattccagaaataaggcaatatgaaagaggctttaacataagtgcataagtgtgatcaaaatgttcagtaagataaaggaataaaactcttaagatatgatcagaacgttatgaaaaaatagacatattatcaaacaccaaacagaaattgtaaatatatatatgtatttaatatatgtgtgtatatatattttatatataacatttgtgtgtatagatatgattttgtatgccattcataaaatattattgtataatatatagtatttctaccaatgaaataaaaacaaaatcaacagataaatccagctaaagaggggatcagtgaagcacccagattttgcaaagaaagatacagagatggaactaggaaagagaagtaaggaatcatgagggagagactaaataaaatgaatattttatccgttatttctatgttttatggaagaataggtaggatgcacctaacagaagtttcagtagaacaacagagatttaaagagaggcaataagtaaagagttgatagctaaatttccagaattgaagcacagcaatagaaaaactgattaagcacaattgaagaggaatacagtgagcagggaaattttcaatatgttttcaatatattcaaataccaaccaaatcctagttgttcctctcctataggaatactgaaatctatatagatgaattactggcattacctggcttggacagtcttttcacacaatctttaatttgttaccttaaagttttatcatcataaaaattatttattgactgcccatgtgaaaaatctctggtctccaacctcacgccagttatatcaggagaatggctgacttaccatgacatacatgccaatgtaattttcatttttattggcatctttctaaagggattacttctactacaccctctgctgttgccagtcagaaatcagtaacaactgtatacttgaacatcaatgttgacaatatgtactgaatgcgatcagtaggaaaaagaagacgatctctttaaagcaaggaataaaaacttacaaatgttcatcagaatatccacatagcatagtcgatttctcccagtccccagtggttgatgttcaaagggtagtgatataaaaatctaaggttttgcaaattctttacctgagggaaagtaatatggcctagtaagaagaatatagtaccagtagtcagttgaaatccaggtttgaagtctggctttacctaatttcgttccccaacttctgagcttcttcccatcctcccacattcatcttcagtgacaggttttgttttctgaagctggattcaattcctgccctcctgccctcctgcccacggagttagctgcaccctctttgggctctgaaaacactggatatttagtatcattcttaaagtgcttaccacacttgtgttttagttaactatttacttctctttctcctccacttgaggccagggacagtcactggagaggcagtagagtcattttttaaaacatgaaatataaaggcagtatgcacaaatttaaattctgactccaccactccctacactaatgaatgcattagcctttcttcatctcagcttcttaatctgtaaaatggagataagttcataaggttattataagtattaaaagagtaaacaaagtacaataagtcctcgcttaaatgtcataaataagttcttggaaattgcaactttaagtgagatgacatacagcaggtcttcaaataatgtcatttctttcaatattgtttccttataatgttgatgagaaaaaaatttggtttcgttatgtcatttcgcttaaaattgcagttttcaagaacatatcaatgacataagtaatgatttattgtactttgaatagtgcccggagtagagttggtgctcaatacattagagctattagtatttttgcatccttcaggtcttagctcagtacttgtcaaacagttatcagtaaatgttgaatgaataaattaatgaatgaacaaatgaacaaatggcccaagccaaatgtattcaacttctcttgcctcagatctcttctctaaaatgaaatcattaggtaagcatcaaggcttctgttaggaaatcagtttctaaaattgcttgaggccttcagtggttgcacgaaaagttactaaataatttcagtctgttgactgtacttttaactgtttgtcagaagagaaaagttagagcaaattagctagaatagatattggagaagctcctaattgcaaaaggatagtcatgggcttccgagtatggaagtgaatacactgtgtataatatttttctctcttttggctgaactcaagcttcctgtagctaaaaacagatggcacaaaaaagcttacagtgtggaaagccagtttttcctgtacgaaaagaactgagtgtttggagtgctttaacttcttgtctctgctaagtagtgatggagagaaaggccgggaagtgtcctttgggtctcatagcattccaaagtcccagattacctgagtcaaaacaggttctagtgttaaactatttcttgggctaggaaacatagaataacattaagtagtgctttataatcctataattttcatgagaaagttagcaatgttttctttaaatattgctataagaagttattgagtgttatgaactgtgcttataactaggcatagatcatatgtattatttttatttcataattcacttttgttaaagaaaaaaaaactgattagaaaaatcatgctatatttcatctcgttcagtcccccaagccaaaacatagtcacatccaggcaccactgttgagcaacccaaattccagacccactgccaatgaggaaagaagtagtatttaaaggtctggccttgtatacataaatgtgctttttggctcaggatccttagcttaaatacttgcacttccacttatgtactagccaggaaaccagagtcatatcacttagtctttccaggcttcacttttctcacctttgcaatggcaataatgataatacctaccttacatgttgttgtaaggattaaagggattaaggttatagcacttaacaagttgcttgtccaactataaccatagtatttattgagtgttatcaccatttccaaccccagttttgggaaaaacaaatctaaagcagaagggagagcttaaaaatcatctagggcatctgcacagttctcaggtgggttatcaacctgtctttcatctcctccttagaatatggaggatagtattttctctgaatataccaggttcttctccccaaatcttggtcagtgtctgaaaagagatgtgttaagactcttaatcctgagggaacactaaagtattttcccattacctctctgttgctttaaaaaatataaattcttgataggaaattggagcaaacagtgccattggcaagtaggaaatccatccagtgttccttaatgctggttgtgaatcttgcctccatatgctaaataataacagacactagatcatttgcccacactgcattcctttcctcaaatactgagtttaggtcaccttccagtaactttatttcctgaattggcttaaatccagaaaaattaggttgtctgccattgcctcaaatcctccatcattttttcccctagcttttcatttaggttacctagttcactgggcaagaaatgaacccagtgttacagatattttgcctctgattcttgtacatttttagcctgccataaatgtctcaccatagaagcacctcacttaatgtttgttagccatcacttagttcataaaatagaaattgttccttcaagatcttcaaatattattgagtaaaacagaatcaaattcacttagagaacctgatgcttttcttggctctagacactctgtcaccactgaagcaacccatttgattaataatacatttattgtgtctacaaagtgttttctgcaagttggatgagagaaacttcaggaaatgaatgtgactgccttgatccacatgctccaagttcatccagtatgatcttccaaaggcaaaagcactaacaattagctttgtgttatggctcacacctgtaattcccagcacgttgggaggccaaggcgggaggatcacttgaagccaggagatagatagagacaagcctgggcaacaaagtgagaccttagccttagaaaaaaaaaatagttaaatgtggtggcacgtgcccgtagtcccagctacttggggactgagatgggacatggcttgagcccaggagttagaggttacagagagctgatcacgccactgcactcctgactgggtgacagagagaccagatctcaaaacaaaacaaaacaaaccaacaacaacaacaacaaaaacactagcaatccccatgccctatcagaggggacctttgccttctcataatggtgttactgcccctttccactctcctagtgattacttcttggtggcaggtcatggttatacaaatagtcgtgtagattttatgacagaatgatagtcttaatggaaaccaacccacatacctagctagatagaaaaggtttttgttgtattcataaaaggttttatagaagaaaaatcagcaatcaatcatagtatttaacaacgctcactgaaaagaatgttttccttgtacaaaacttaaatccccacatattaaagcttaagctcatttccttgtattctctcctcaagattaagggagaaacctccgccccagaaagctgctatttctctccaggttttcttgattaaatggccaagcaggtaatcagaggccttgaactctcgatgttgcagctgccatggctaattaaatggtgaagtgctgaattcacagacatgattaataccatcagggcgttttatggctttaatgttcataaattatgactgaacaatgaaatttgtatgtgggttataggatttttcttcttaaggatcagaattaatcagtgttttctcaattgattttaaatataaatcagaggtagcatcagtaaattctatagcttaagtatttagagaatgatctcagaaacaggacataatgaaaaccaagccaccatcctagtgtgatgcaagcctaaggtcttgtggattttcattctaaatgcaattcaggaaggccaatcagtttctaaaaggatggttctggagacctttgtttctgaagtataactcccctaaatgatctaatctttgccagctaatatatgtgtcagggtatgtaacagaatacagtagtcactctttctttacctggcattctagtgtgacactaacaagatttccttaaattgcatttttcttcctggagttaagtgtctatttcttttctttcttttttcttatttttcttttttttagaggcagggtcttactctgtcacccagggtggaatgcagtggcaggatcatagcttgctgcagcctggaactcctgggctcaagggatccttctgcctcagcttcccaaaatgctgggattacaggtgtgagccactgtgcctggctggctgaaaagagcctattctgttagcttttctctaaactcctcatttgtatttctatccagttgtttctctgagcctttgtacataattagaccacaaaaggtggtacttggctacctcatctcgtaaatactctctctgctgccttacttagtgaatggggagatcccagtgttactcgacgttggtgcatttgaatctgccaacatttcctttctttgagctcatcatcagtccttgaccaggtaacttcccactcagatattttggtgaactgttagtgtagaaggagaacaaactggcaagtgattctgagtgagcttatcttcacataggaagggtgtttgaaatttctcattttcagaatttcagaaagacagccaattcctttctgctcagaatggactgaggctgctcccgattaggctgtctgagttctctcatttttactcatcacagtcacatctgtttgggtttctgtctctctcctggagatgcctcttgagagcaggtcccctcagcttccttacagctcctctgaggcctgccaaaagagattggcagagaacgatcagcattctatgcccagataactcacataactctctctgaaaagaatgctaaaacctagttctcaagtgaacccacgaggagtggaatcaaagggacttttgcattttttccttggaatccaatttagaatttatgttctcatggggtgggaagagaacagagagatgggaagtatgaagaggggaagataaagaagtaggaacaggaacatatgggaaaaataatcataggctcccagagccaaaaggactttaaggaacatgtcatctggaggtttccaaacgttttgtttttagtaccagaatcttttcatttttattttttacgtaagaaatcatacaatgagctccactatataaaacagatgaaaagagaaagagaaataaacagttgaatgaaaacagttaaaatagatgaaatctactgttgaaacattggcgagggaacttttattacttttcattacttttagattgctgaagaatacaaagtgaaaactgccaatcttgtctaagtattactttaaagatgggaaaattgaggcctgtaatatggagaaatgacatactcaaggtcacacagccaattagtggcagagataggattaaaacatatgtttccagcctgccaggctagaactctttgggagttgagttagaaaaaaaagctaagaatgctttctttctgaacatggtcaaaaagagaggttggtggacaatgcaatgggagagcggacacgtgggagaaacaacggagaatagaccctaccttagaatagagcatagaagagtttgaaccaccagggataagcagagataactgaaatttacaaatatggaggagatccaggaagttccatagcaaggccacaatgtgaactgctaggaacaaatcaaaactggagaaaaagggatttggaaataggtgtcaaaagagaattctttattacttcccctacacaaatgtcgtactattggcccaggatggcagtgggacagcaaagacaagcaaaatatgcttctctaggattggctgcaattctttcattataccttctcaagatggatgtgactttggcatagtttcctgttggagatttgaaagtaatattcacattcgtctctgaaattttaagcacctgggaaatagacatgagagttaggaaaacgcgaacatatctgctttgtgtgtgtgtgtgtgcgcgcgcgtgtgtgcgtgtgtggagtttcgctcttatcgcccaggctggagtgtggtggcctgatcttggctcactgcaacctccgcctcccgggttcaagcgattctcatgcctcaggctcccaagaagctgggactacaggcaggcgccaccatgcctggctaattttgtatttttagtagagacagggtttcaccatgttggccaggctggtctcaaactcctgacctcaggtgatctgcttgcctcagcctcccaaaattctgggataacaggcgtgaggcactacgcctggccaatatctgcattattaatggttaagttcattgagcaatatgatttggacccaatttcaaaatggttttctttcactttctgccccagattgaatttaccctctggtcacaggcctttgtgagttctctttgtggaagagagaggagaatgaatgaggtccgtagacagacagatcacagagagatgcccccttctcaagtctcattaataatgtgccatgcattttcctgttcatgaaaacaaaagattcaagggggtcaggatataaaaagacagaaatatcttttgtgggttggcaggaacatgtgacagagggagagtctcgttccccctcccccatactcttcatttttcaatattatacaatttaatcagggagagaaggattagagcaagaaggacatctacaaacacgtgtagaatcacctggttatcagccttggcccagtggttccatgagcttatgtggatggtagacaggagttagaaacaaaaggatgtatttacagtttgtgtttgcaaatttgtaataaatgcccccgccattcttattatatattcctgaagtcttctctgagtctgtttacctctaatatgtaccacagagtgtccacaccaataattctacaggcgtcctgaaaataccttatgaatggtgtttgcagaagcaaacagtgagagctatctgagaggagaagtggaggaaaaacggtgtgggaaagcccttatgattttctcaataccatctcttcttctaaggtctatccccttcctgaatcagaacttcatccttctttagcttttgcatgcctgctctgggtcaggatcccaagagagaaatgagagtaggaacaaaaggcccttggggttggtgcttggcagaaggtaaaaacatgcagagaataagcagagaccttgtacctgttcatcacccaccccaaatatttgggcttgatcaaagcttctcctgacccctctttatgtaagatatttcccttcatggtatctggaatttaaacaacaatcacaaacattttgaactaggaaatagcctcctactcttcagaatcaatatcaatcagtcattcctcagggatttatttttccctatgaatcaaattttaaagaagtggatacttgaatagacttgaggtgttaaaactctcgtctaccttgtcctcccttttcatttgggaaagccaaaagcacaaaagagtaggtagaaaatgtcagaccctttggcatcattctcctgtaactatcagtctcaacccactgcaacctttaccccagtctgccttgcagacacacagtggtgcttctgatggagcaagagacatttcaagattgcagagaagtggaaggaggggtagcaacagcttcccctgtgaagcaatggaatctacagaagggtccggtgattcagctcttatgggctaagaagcctgaaagcatttcagtgttgctgagtccgagcttgtttgttgggtagtcaggcaaggaaaaaagggctagagtctgaagataagctgagcatctggttttgcatctacattagttctgaaaagaggtgatgggggtgccatgtaggagtccagtaaagacggtgtagggctgccaggtagtagagctgctctattttgcttcctagttggcctcagaaatcaagtaaaatagtcaaataattgtgtctgtttgaaggtagggatgtagacaggccatttctctttgctgcatttctggcctcaaaacctcttctttcttttcctccagaataaaatataacacagggagaggacagaacttgttaatagactgaggccagcaaaaagccagactggttcctgaattggagggaaggaggctgcctgactttggaggagcagaaaaaaataagttaggagattagagatgggccacagcttaaatagagaggttcgactctgcatttcccaaatacgtaatgcttacggtacacgacccaagctctctgcttgaatcccaaatctgagcggacagatgagggggcgcagaggaaaaacaggttttggaccctacaaattggcttgaaatgaaaagtcagcaaaaaccactgggtggcagcgtggtgtgcgggcgcagctctgcagtgtctgcttctgctgctaccgctggggctgaacccgtctggggactctggcctcctcccctgaatggctacaagtgtcgccaagcaaaatacctctgcgcgggtgggtgagggttctccgggttgttggtgcgtccaagcctgaggcagggatctggcgaacttctgaggggctccagcccgagcacaatctggtcagctcaaacactgaggaaacacccccaccactccatcccccaatgccgagcaaacccccgctccgtcagcccaactacctcatctcagttcctcctccatcactgtttcctcccgaagctcctttcgggaaaaggaggggagaaggatttggacgactggggcagtgcggaagcccctacaggtgttagccggaacgggcggccggggacttgggggggtgggggtgggggtgggggtgggaggggcggcctgcggctccgagcctacgggctcagccccgggagggaggggccgtcgcgggagggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcctgtgtgcgtgcgtgggaaggcgctggctttcttgcctccgtaacagtaacacgcttgctgcattgcaactgccctgggacaggcgcagagcctgggggcatactctgccctgggtggcttgccctcagcttcggacatgtcacatatgtgcatgcccggtgggctctgggcaggcgtgacccagacatggctgtgatatgtatggcgtggaaattgcaggcgcagagctgggcagacaccatcctcccgtccccaggagagcctggggaatccctctcttgcttttatctctgcctcagacccttcccctccagcttccacctccaagggatgtgggcttctgctgtctaggcattgcgtttctttgatgacttttaagctttttgggacagacttgacttgtggtgcagcttcgaaatgtttgctggggcggggggaggggggatttctagaaccttgttgcaaagagctgagagatttggttagacttagtgtaatcggttacatgctactaaaatgcggtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaac

SEQ ID NO: 5905 - DNA, 513925 bp, human; identical to SEQ ID NO: 5904

SEQ ID NO: 5906 - DNA, 346013 bp, human
acctccttccccccccccgccacccgacacctcctaatcctaaactccttatccaccccaaccctccgggaaggcaggagtttgcacccttcgacacgccgcgtgcaaaggtgagcaaccctggtgccctggcgccgcccgcgctgcgctttggcagcgcagcctcgccaagccccaggagaacaaaggctgatgtccccttgtcactagtgcccagcgtgagtgggcctccgcgggagggggcagtcctcttcctctgtttgctggggttcagccaccgcgcccggggcacccgaccactggtccccctggagtgcgcgcctctgcccagggcctcccatcggcgggttggggaggcgcagcaaagcggtgctcaggctggggagaactaaggcaaaggcaggggacgcccccccaccctttgccggttctagccgttgcctttctcaggaccgggattagctccagaatgtaaactggagacagcagccttggagaccggggtgcggagaggcacagagagggaatatggaagagcagtggggaacagcaggtgccttaggtgcaagtgtccgaatggccacggagcagacgctggagtgggctggactagccctgagggccccaagcacactggaccgcagcgacccacgccgagtccccactgcagaagtgaggttgcagcgcagggagtcccagcttttgttcatgggggccccagttccttcctgagccctcaggcccccttcactcccactcctttctctattccttgttctcctctcctccttctcgcctctccccatctctcagagctttctttcccgggagattctagggcagcaccagccctcccccgcggaaagttgtcaaagtcttcagctcaaggcctttatccttgtttctaagtggagccatttctcccccaaataggcgaaagggtgactgaaggttccggaagtttgtggaggggttagatccgttgtcatacgggtcattgttgcccccggtctggctcaaggctagcattcaatcccaagtgaaagagtaactttggaaagtagaacgacagctgtaggtttccagagctcccctaattgttgagtctcaaacaggcatttatatgataaaggaaaatgacttcagggtcattaaatcgttttgttttccactgagggcccagagaagtaaatgtaattaaagaatgtagcaccagattgatctaggcacgtcattcccctgttgaatctgggagtatttctcgtttgtttctggaactttggttcctgatttccatcaggtggttacttcaggtttatttcaggctaccgttgggagaccctgaaaccaaattcattcacagaaaatgagtttctgttctgtttataatttgcagttgtccagaatggattaacgcatctggaaacaggacaggtttctgtaattcaataatacaaatttgtactaggcatgtgtcataacattttcttgtgttgactcaccacatttgaaaccacatacctctgtaggaattgagtaattagcacttgaaattatggctgtaattagaataaattaattttacaaggcaacttttaagaagggagtttacttccccgagaagatgggaagcttttggctgctaagagcaagattgccatttcagcctttctgttcgttgttgaatttagagcattttcaaaatattaagtgtgtagtagccattagtattttcttctttcaagtatatgaaaagtcttatgtgaccaaattttaaagactactttttatattagagatgaaaggtacaaggtctacttatcttttaatcaatagagtttatatatgttgaccatatttctgaagagttttccttacttacaaatttcctatatataggtcatctttaatttttttaagctgaaaaactaattggcatattctttgtaacatagcaagatataggatcaagcatttcatagataccttgaatatacacacatttaattttgaacaatggtgtgacagatgattggatgaaatcaaataatttagtaacagtttgaatgaatttcataatctgttttcagagtctactgctcatttaaattcagcctcccacccccatcagttagggctcatacccacagtgtatcataactacatcaattattatagagtacagtgtttccagagcttttaaagcacaggtagtaggtttccagtaaattattttgtgctgctgaatgaaatatggccttaagagtacataaattgctgattgtctttttaaatgacattttcttcaactcactgaggttaagaccagtgatggacactgatctttttcataaccttttcaaaaatgtagccagacaagataggctgttctgtttggaaagggggcggggaccttgattctgtttgaaactattaaaaaggcctcttgtgcagccagtcgccttttgtgtatttatttatgctttgtataaactttaaaattggcagatgtgtatatagtttgagtcacgcggctcttggaccggaggatctgtttccatttcagggaagaagaaagcataatatttgtttgttcaagcagatattctcttagctttgactcactcttctctaccttgtcacataagatcttttcagcagtcttctgttggaaaagcactcagttaaggctgtttctggtttgttgcaacagttttcctgtggcatcggaaatcttgtaggctgctatagataaaaccaaatcttttttggattaagtaaaaatgctagctaattctcgctttcaaaactgtctttaggtttgtggctacatgtttggagttgggtgtgttcttttcaacaaccctttcctttgtgcttagcttaacagccaccatatccaggcaagtttcaaggctctgtgggctgtgggttctcttggtgagacagcactgttgtcaggctgggctcatgctggctgctggacaatggaggacaattccatgcatagcccaagaagccagccacttgtacagctgctgttgtaatgggtagtagtggccccatgcatttacaccacagttcgttttttgttcacttcctggccctttccaatagtctttctatcctatcctactgaagaaggacaggtcactgtggtcatgcagccagcatatctaggcttgagtcctgaatgccttccaaaagatcatcttgatcattgtggtttactataataggtttcatcaagtgtctttctcagacttgggccaggcaaaagcagatgtttagaggtattttaccgacaagaaattatgaggttggtgacctcttattaagaagtaacagtgatcatctgtctattactcatgtagggacttgtttttttcactctgacatcatggtcccatggttttacatacagtgtcataagccacacggtcttttctgtgctgaaggaggtgatcatagccttgctaaggaggtgtgaccagggagatctctaatcagaaatattggtctgttcttggggataggtggagaaaatgagtgcacattatacccaaatcctcttcataattatttgtagcagcgtgtagcttctttattgacaaaggctaaagctagaagggggagcaagttgaggcatgggttaggggtactgtatcttttctctagcttagtactgcttcctctaagcctcttttcagcacagttcaaataatttaaagggcttagtatgtgtcctaggtctggagatgtgggtgaggttggagtgggaatggatgttgaattggggcctgggtaagaagcagagggtgagctgtggggcgaaggaaggagttgaggtctatgcccacagcagggagattttatgggtggctttgaggacagggtcaggactggggagagaattggaatcagggagagaatttgaatcagaattggataagccagagggctgatttgtaaggcggtaagtaaggatatgaaacagcgttccaggtctctttgcagctgtgctgttttatgtccaaatcaacttcttattctgggaattacaatcaacatagaacaaccagaatgtgttgcagttcttcaaatatatccaataaaaaggctttctagtgtctgcttcagtatgacttatatttttggagttgagaaatttgaaaagaatggacaataattgtcaagattaagcaattgaaggaggggggaaaaaccatgtgcattagagtagatgaaggggatcctacatgtctattaccttgctcagctaaacattatctttgaaatgtgaagactaggcacataatatagttttagcaattagtacagaacacaaatgtctgcataactcattttctgcagtcactgatttatgtttccctatcaagaagacacatcatcaccatgatatatcagcacaggctgaagagtggatttcaggctcattgtcctgtgtaatgtgggtcatcttagttagttttcatcaacttgaaatgtaggttatctatttgtaatataccagctctacaaacttagttgaatcttatttctgacattttttaacatggcattttatcacttttttgaatgtcatatattgatgaaacatttcctaagagtgtgggtttcccggtaaatgcattaatttcctaaagaagtgaaataatatttagtagtcattatgaccaccactccaggccttagatccgatttctccttgaattggatggccatttttttcctttaaagcagtgttttccagagtattaattctgaaaatggtgggggaggggttattagaaaagaaataaattcttgattcttagggcacaatggatatatgaaggactattaagggatctgagttgtaataaatattaagtctaaattacaatgactgtttattgtgattactgtaaagcagttctcatggctgatcttgcctctgccctttgaaattacttttagcattgattttcaaatagaaatagtactagtgtcacgggctaatgaccttccccacaggcaaaggcttctgctggtgtagggttgtggttgacattctagggagtacagtagggctgtccagagctaagttgcttgcttggcctgcctgcagagacatcagatttggtctggacaatcactctttggcctaaaggaatccctagttgtatatgtctgtcctttattttgtggttcctgtaagtagggctgggaagaaagaaaagaatcttctggtgaaaggcaggccagtcaaaggccaaattagaaaagaaaaacagtaaaactcaatttcctttttttgtaattgaaatttacctgtagtaacatgtacagatcttaagtgtgcatctcaatgatttttgagaaatatttacatccgtaaaatcaacaccaaagtcaagatacagaacattcttgtcaccccagaaagttctttcatgcccttttctagtcattcccctcacctaaagacaactcttattttattctttttttttttttttttttttttttgaggtagggtctcaatctgtcacccagactggagtgcagtggcacaatctccgctcactgcaacctccgcctcccaggttcaagtgattctcctgccccagccttcctagtagctgggattacaggcacacgccaccaccgcccggccaattttttgtatttttagtagagatggggtttcaccatgttggccaagctggtcttgaactcctgacctcaaacgatccacccgcctcggcctcccaaagtgctgggattacaggcgtgagccactgcacctggcctcctatttttatttctatcatcatctattagtttttcctgtatgcactctttggtttctgacacacctagccacctccccatccaacactcttcatcccctgttgataacccttcttgtcttgtcctctggtttcttggaagactcccaccgtgccccacactggggcattcaatagaatcttagacatggttagtcttctaggagtagttgttgaatgacctgggaaagatagggaaatcctttaagcagaggtatgtttcattcatcctttaatagcaaataacaataatgaacattgctgtctttataatagtagcctctaaattattgagcagttactatttactaggcaaacattatttttacatatatctaatttaatcctgacagccaaatgaagtacagtagctcttagtacatacagactttagagatgagaaaattgaagttcatggagatcatgtagcttatatgaagtcacaccactagtggtttgcaaattactaacacggtgcttggccttgtagtaatcaataaatgatgaatgcatatgccatgcacctatgaaaactcatcggtcctatgccctgctcacttcctgttttgttgtcatatcagaaggcactgtgatagagaaagactttttcagagcctcctggtggcttaatctgacaaatacctagggatatttacattctatctaaagattgcctggggtagagctttcactcaaagaattcaatagttaatggttgactttccaacacctagatacgtggcagaaataattttgactggtgtcctaaaaatagtattttctgagcactgactataggccagggagttgacatgaaatatctcatgaaatcttcataacaatgtatggacattcaatgtatggagaatgaatatccacactagtcttcaatgtgacagatgaagaaacagaccgaggccatccttaggtcactcagctaacaagatggtgaagtgaggatttgaccagatttcattgactccaaatctacctcctaaccactaaccactatatcatactcccttcctaggcagcacagctgagtctttctaatgcaggtttgcacaaagacgaaattacttccattcaccaaattggacataattaggaggagtgtgcctatactaaatacatggttgctccagggctgtggtctttgttcagttaaacaaaatctgaacattttttgagtgacttttctctatcaggtgctgtgccggggtaccctttccttcttctctggcctgggacattctgactttaaactttccgatgtgcatctcacttcacttggccatcctcttgaaccactgctacaggacattggccaggtgactgtgtctttcattggccaggtgactttggctttcatattggtttaaaaacaatggtactttcttttgcaactgcatctgagaccttgtttcacctgtgtcttcaagattatacatcctcttaattcactgttgagtaaaaactccacttgtttattttagttttcattacatggtatatgctttcagtctgtctcccatcagaatcatatgtctcatttcccttctctttgtctctcaaccctaccccgttcttcctccgactctccttctttccctccctccttttcttgttaacaaatgtcagtggtttttattaaccgaatggggctcctcagggtgtgctgagctcattgaaagattttcatttctggattttttcctttgatagctatattaatcgtgatgaaagaaatccaccccccacaacaaagcgtagctccacagaagaggtttttcactacttacgtaactcattttaaatggaaaaataaaaaagtgcaagctttattttgtatactatttatgctgccttcagttagataatatttccaaaaatatatcttgttaacagagacacaacgccttgaacaagcatattaattacagttctcgaagttgggaatcatgtagtatttatctgtattgtagaactgttgctcaatggtaataattaacagtgatgggtctattgcatggctataggtaaatttaataacaaacatgaaacccagttctcaaaacttgctccaaataatgtaggtagcatttgttactgttctggagttgagggttagtaaatagctagggttcttaaaatatttatctagctcttaaaagtagaagtaaacaacctaaagaagacaggctgagtgcacttcttgaatatgcccatagatattttcagaaacttctttcaatggtgactttgaaagtattgagaattgacctgcttattttgcctttgattctctgtgtgtatgcttgcctctccccttggggggtttattgaacattaaggcttccaagagctcttgaatttgtgagtgattttcggagctctgggaacaatgtgagccattctcttggaaacaggacaaggtgctcctagatgctctcattccggggaacatttgtttttcggctagctgggaaccgacgatcgcgctgaaaggtctggtcaaccagcctccctcagttcctgtgtatctggcaggcaggtttattacaaaccttagtgtgctcattagcctcgtgatgtggcagctgcctaaaaaagaaacacggaaaagttgtgtcaccgaaggtgaaacttggcaaagagctgcccggcgccggctccgggcatgacaaagcgccttcctggcggcggcagcggcggtgggcagtgggggtttctgtttgcttgtcctcgatacccacggcccagtcgactcacggggaggcgtcgcaaagggaaccgcgggcccgggccagggctccgtggctggcggtgcgggtggtcgcagtccgggggaagatactgcgcgctccggtgcagcccgcggcctcgcagtctagaccgcgggcacgttgcagcctgtggggaagcagcgttaagatggtggcggtcagagcagcgctggtggtggccgggcggggctcagggaggcgcgccctcctcccttagcgacacctatcaaggctttcttgctttccgtacacctgacccacccactagacacctcaaaggcaggcatagaaggccaagagccttgaagtcagggcttgaccaacacaagagctttgctttctctgtcttcttgttaatgctaatttgactttagctgctcaaaaaccgaagatgcatcttgagcaggacgctcacaggcagatttgaatttatgtgtgtgtttttatattgcttatgttttattacattgatttttttcagattacaaaataatgcatgtttaccggagacaatttggaacatcataaaagcgtagagaagaaaatatcacccaaggttccactaccaagttaactttttgaggctttgcttctagtcctttttctctgcatattataatacatagacatggctaattatctttaagtgtgtatgtgggatcaggcacatacacgataacttcctttttttccctcaacgtcttagaatgttattttatgtcgttaaataatttgcaccatcattttcagtgtgtatactaggtgtggacttaggggtaaccaaggagagatggtgatttgtgcctggggtgtgaacatttttcctgcacctccttgagatccttctcactggacaccacaagcatgattagtattttgtaaaagtacatatatgaatatgtgcccatatggggctatgtatatgtgtgtataaatctgtaaataccaaattaaacacacatagacaactatgcacatatgtaaatagatacacaacaaatatgctaagaataaatcttgaaagaatatacaccaaaaggaatctctgggtggttggcttatagaaatttatagtgtttagtcatattttctatttttatctatagtggaaatacataattatattaatgatataataataaaaataatactaatgaaatattacttattgattgtcttcaaactgagttttctgctccctcattccttgatctaccgtgacctacttattatttttatattatatgatgcttcaagtccaagctaaatctccatcctccatgaagcctttcttccgccctcccagcaggcactgactgcttacttctgtacagggcttctatgtcacccatctggcaatctccatgggctactttgggtgtatctcatggttaacttctcatctgcttatgtcttatctctctgaatagactggaatgtcttcaaggatccttttcacaaagcaagtgctcactaaatgtgttacgtaatgacaatgcttatcatccatcgtaggtttctgtaaatgctcctttacctttgaaactctataccaaaagcccttagactgacagcaataatcctgctggatttaattttgctaatttaatttaggatacaattgctacttcataatgggctatctacgtagaatttggtcaatgatgatactgataatattactgaaatagtagtgattttcatattgatttttcaagttagaggactcttgatagagggtttcttggtggtagaaataaatctacagattcacacatgcattggacagtcataccccaacttaagtgatttcagttattttaatgcatgtgtaaattaattcatctgttaatttactcgataaatatgtattgaaccttctatgtgccatctgctttcttagacactgagaatacagcagtgagcggaacagataactatccctgccttcatggataatacaagcatattttgcaagttttcttagggaaacagactttcagtgcatgaagcactctgtttcatgttcgtggtatgtcaagcagtgagtgatctggtgcccatcatagccatcaggctctggccaagccaaattactaatgagtcaagctggatggagtcatacatgggttgcttatctgtggttcaggaaccaccgaagctgtggttcctggaccagcttgggcatcagcatcacgtctaaccacatatacccccgaccatgagaatttgattcagtatatctgggcatgagccttagaaagccacattttttattaagctcctcaagtggttctaatgcacagctggtttagggacctactgcctctgggcagtgtttctcaagcttgcctaaagaatcacctgtagggtttgtttgttttttctaaacaaaacaaaacaaaaaccctcccgctgacctactgaattagaattttaggaaaagagatggtaatctgacttgtaagcaggtgtcctggtgattcttatcatcaggctagttggggaaacattgtcctagagacaatcacaggactcccctagaaattatgtataaatgtcaatttttctggtgagcaggctccattgctttgaacagattctcaaaggagtcatccactccaaaaatattacatgaggtggagccctgatgtctaggaccagcattgttgtcaactgtatgttttgagttctcagtgtcctcatgggttgaattaagcaaccttaaagaccttctcggccctattcatcttccacatataaatgttctgcttggaagccttctttctctctttttgctgcttttttctatcttattgccagtcctgcctcaattgtttcccttgatggtctccctttaggagaaagtagggaagcaggagaatttcaaagcctcggctctcgcagagagggcggggctgggagggagcttcgggcatgccattcagagatggcaatcctagcacagctgttagaatagcagaggtcagtgtccaaatattttgacccttatgatagcttgaacctcagtggatcttaaactggtgggataagggggtgggagtgggacttccaagacatttctctgccagtctagagcagggtgacacagggtggacaaggtaattccgcttttccttggacataatttttctgcctgtatctggcagcaggtggtgatgggaggtggaagcaggagtgtgagtgttgggctgggcctaggtgcacccccaccccttctcatccttgaggcaccaagcagtgtctctgtaattggttcatgaccaatcaagtgcattgacctattactgctagttactttgagttataaatggtttttatttcctctgtggaattgggggttcaggctgtataggatgacctgatttgtatcacaagagcctttgggactttgacagatttcaccgtttaaaacacaccgagcttcctccctccaccccactggacataaaagcaacctttgaatttctggcacaaagagcatgtctttaaagggcagcatgcagaaaaagggaggaaaaagaagtaaggcagttcatcttcttttctgaggccattgtctccaaacaagtgacaaaactgaataccttgaaaaatcttgtattgatttttagtgcagaggcatctccccaggatctgaaaatcctggcagaagataataaacttatttccctgcctttgagccagagttgagttgcttgttttacatggctggaagaaatgagagtagttgctctgctgagagtgagatttggttcagagtgcatctctcttgaccatattgtatataggggagactcaatttataaaaactatatatacaaatctaactcaaatgccgaatgtggaggtagttacaatattgaaagagttattgttttatgaaaagtttttcttttaatagcatcatctttagtgtactcgcacgtttctttgggcatgaaggactacttgattaaaaagaaagaaatcaaaaccaagcctagaggcctcttgttgaggcatttgtttcctgctattctaattagaaactgttgctcagagtggctgtcttgcttctcggattattatcttttttattttaattattttaaatatgtttactgtggcaaaatatacaacataaaactgaccattttatagtcaattctatggtatccagttctatggtattaagtatattcacattgttctgcagccttaatcaccatgctccacagatccttaattacaggctataatggctggaagggaccttcatcatcatttggtctaaccttcccactacagagtagaagaattaggcccacagagaggcaatgacttgcccaaggtcatagaacaagttagtggcaggggcctagcccagtacatttccacattgacacagtaacagattcaggcaggtggcctctgttactctactgatagcagaatcaaggattgacataaatgtttagggtatttttctgttttttttttcttttatcaagcaagcaaccaattattatggtttagagccagaaggtccttcagacactgtctagttcaatttccttatttaaaataattggccgtatttgtgatttctaaatccaagttgaactacagaaagatgctaacattcttatttctaaaatacaggacaattcttccccagccttcctttcactgactccatggcattctttggttgaaaccaggtcctttgtgggtggctgttattaataagcttttcttgggatgtttacagtgactgctgtgacctaaataagtttgcttgtattgttttccccacaaaggcaagaacagcttttaaaactatgttcatccctctcatcacaatgtatttattcatgactaaaagaactgaagtattgcattttctcacatttggggcctttgtgtaccccaatcatgttttcttggagtagagcttcaggacaatacaccatgtaacattataacatgatccctcttgaaaattttatttttacttttaattgtggtaaaatacacataacataaaatttaccatcttaaccatttttatgtgtacagatcagtagtgttaagtatttaactgaagtatataatctgaagactgcttgtgcaaccagtcttcagaacgttatctcacaaaagtgaaaccgtgtacacattaaacaattccccatttccccattaccccagtcccttgcaacctccattctactttgtctctatgggtttgactactttagctaccttgtataagtggaactatagttatttgtcattttgtgactgactgatttcatttagcattgctataaagagacccctgagattgggtaatttataaggaaaagatgagccttgaggctcatccatgttgtagtgtgtgtgggaatttctttcctttttcaggctgaataatattacattgtatatatagaccacatttggcttatccattcgtccaaggagggaaacttgggttgctttcatcttctgactcttgtgaataatgctgctatgaacttgggtgtagatcttttttcaattgatgggataaattgttttaaaatactcaatttattttctcagtctttagtctaagattattaaaataacatggtgaataaaataaaggaagaatgcaaatttttagggtactggagaattgaggcatcaatccaaatgacttgcaagtttgagaaccatgagtagagtaaataggacttttttaggtcctcttgggtctattatgttacttttttatagtgattttgtgtgtgtgtgtgtgtgtgtgtgtggaaacaatgaacttcctctgtgatagcctctatgatccttcatccttgcatttttgccctttaccatttatttccattcctgtttatatgtgtcccccactatactgtaaacttgttgagtgcagggaccaagttattaatttctgaatagtacttaggacaaagcctggctcataaggcaaatgcaataaatgtttgaagagaaatttgactcactctgtcatttggaaaaatttaacttcacagttagccttggaataattcaacatttttatttgtttttatctgcttcttttatatttgaaacatagctcatgtttaggagcacaaattagttttaaatatgaagcaatcaagttttttttgttttcaactctttttgggcagtgggagaaacatttgttgaatacttggcatcaaatagaggaaatatccaggccttgactttagttttgatttgagtaagtccctctgaatttccactgtgaattctgtctcctccctgccacctctgaagtgctgtgtgtggctttgagttgtgcagctagtgctgtgagtgctgtttctgtatcagggcacagatttcccactccatgtattggctcctaagctttgttttcatgccccctaacttctcctgaactgtctccaacctctttataatgttccagaaatagaaatctcccaaagggattgtcatttgtaataaacgccctcaatccttaatatattatttcccattggtgggcagaaagcctgcagatatatttattttcaggtgatagacaatactttagagacacatgcttaagaatctggactccattcattcaaagagcatcaagcattatggcaggcccaggcactggtgaaacaccaatgaggaagagtctctattcttgctcttacagagctgatagtgggagaaataaaaaggaagcagtgccttgactgggaaacacagagaactaaggaagctcataggagagggagctgacatagttgggtggtggtagcaagtgcgatcgttaacttgacacctgaaggatgagtaagaatttgtcagttgatgaagaggaataagagtgtcctggaaagtggggacagcacatgtagaagctaggtgatgagcaagaacatggcttacttagagaacggaaggaagtacattattcctagagtagtgagtcaccttagttacgtggatagtcctggcatatcctgaattatgccactctcatttcagtggacagtcccattgattccaatttttaagcagaaatattgaaaatgcagtttttctgtgcattaacaaggaggttccctggtaggaagaaatgcatgaaaaacaagtaggctcaatggtaacttaatgcacttgatgaaatgctgattgtgaacaaaacttcaggatactatcattataaatgaatgaaacccattagattttaagtagaagacttattttttttctgctaagattagaggcctcagggttttgttaattgtggactccatgatcagaaatccatatatgtgtctgcagccatgatttttttattagtaacaagaaagagggataacttcttaactattcagaatatgcattatttagcagtaagacacaactattccagaaagtggcttaatcaactttattcatatgaaagtacatagttttatggctattattagtaggccatgaatttttattaagtcaaaaagaacattgatatttaacagataatgccattcttggcagtgtagggtgtaatcaggcagaacacaactcatttctgacttccaactatatcactcatgttgactttctgctttgtctccagcagttgcatgaaagtaaatgtactgccacagatacttcccagatgttgccacacagaaatttcaggatagttccattcataccatttattcattcaaggaacacgtattgggtgttggctctctgtcaagcttgattgtaggtgttggaaaaatgtgaccaagctacagagtgtccctgcccttgcagggctcacagtgtagtggggaagacagacaagcaaatagtcaatggagacaaatacagtgtgaccagtgctgtaatagcagatgccctggaaactgtgcaagctcagaggagggcagctaacacagccttgaaggaccagggaatgctccctgaggagagagatcggctgggatcagaaaagtgaattaggacctggcctggcaaagaggaggacaaagagaatttcaagcagagagaacagctcatttgaagacaaagaagtgagaagaatggcaggaaggaagggagagagagagggaagggtattgcaaatgtaaatgtaaaagggcataactgtatgacatgcattatggctagagaggcatgaggtgtacctgaataggtaggcaggggctggcacacaaaggcattgaggtgtacttttgtgtatgaggatgaagagtttggatttcatttcaaatgcattggaaagcctttggagagtttcctgatgggaagccctgtgatctgatgtacatttttaaaaactctgtctggctaggaaggcagtgagaaagctgatgcggtgggtccaggctgagacttggtagagtaagaatgaagatggacaatgtctaaagatttgagagcactatccaggaattggggtagattgggttttgtgcaaataataacatgagtggtacaatgatatctcatttacttaagcgggagacaggagtcatgaatgatgactcttatgtttctgggatccagtcccatctctagcacttacaactgtgtgattgagcagtatcacttattctttgcatcttctttttttcatctcttacattttcccactgtgattgcagcctgattttcagtggtgattcataatgatcctaatatcctttgcttctaaggtacatagcagaccatttataaatattgcccaaataaatgaactggcattatgcagctacattcttatgcaggtatacttcctggttaggtgcagattagcctatttagtctttcttatctgtagcttattactgggaataatctaaagtggaaatcaaaccatagattgtgtgtgatataatggtcccctgtactggactgggccttaagaactcacatttttcccccttactttgctgttatcttgcctttatttagtgcaacagaaaatcacttatgtgctttatatcagtattcccatttgtaaaatgtctatgataatgccagatcctgactttagttttggggtgatattattaacaagataatagcttttaagcataatcatttagtgtttataatagacctttcctctaagaacttcctgatgtttgtcattggaggtggtgtaaggcagagaacagaagcccctgaagagctttttcagagaatctaggtcctaactctaccccacaccagcttcagtgggggcccattggtggacatgcacggtggactccggctgttatggaccttccctgctctgcatagtcttgtagcaatatggtcttctcatgtttcagaacatcaaatgtaaaagccaaaactacaactggcaagaactcacttagcagtaaaggggaaatgtataggaattggaactgctattgacaaaagttagattatatgatcaacatttcaaaggcacagagatttgcaataattgcatggggtataggtgttttctgaacaatagaaacaaaagccagtattatatagtgggttaaaagagacacttattatgctcaagtatacaaagtaacatgaacttctagctagtagaattttatggatttcatgatttgccataatgaagaaataaaaatattttaaaattttcctattgtttttgaaagcagttattgtgagtgtggttggcaagtattactatgtactcagcacccccttttcccatggatagctaaacgaattctgcattgttgggtctgatttcatgagttttgttccagtgcaaaacaaacttaatacaagtactttccaggtctggtttcatctgtatgtgaactagaactaaatcgtttacatgtgaggctaaaatgagagtcctcccaataaagtgtcctggaatgtgcatttgagtgttttctctaaagaagaagacagccatgttaagtcagaaatgaatcagcaaaagaaggaatgaaaaagattgttcattctgaaataacactcatggcttgtatgggaaaattttatttcaactttgaaaataaagatttttcatttaacattaattcaacaaatatttattgaatacctactatgtgccaggcagtgttctaggtataagtgatatagcaatgaataaaacaaagatctttgccctcctgggcttacattcgtgtgtgtgtgtgtatgtgtgtatgtgtgtgtgtgtagggacatacaataagcaatatatatataggtaaaaaagatatgttatctgctgacaagtgctatggaggaaaataaatctgggaatgtgtatgtatggtagtggtggtggtaaatggctgtagttttgagtatgatgatgaggtatggacttactgagaagatgatatttgagtaaaattctgagagaaagccatgcaggtgtcttggggaagagggttaccaacttttgcatgttgcctgggtaaaataaaagtgcacaagtataaaaatgtattacccacaagtcaggcagttagaggtgttttttattgaacaagggtaaagccctttctgcattcctgtgtaaattctgcaaggcagaatttcaaatgtagtctctggttatttgaatcttaaaagttcatgaacagctttttaaattgtactctctgaaatttctgtatatgcatacagatagcatttacatgtactaagttggtatgaacccatggatatacctgctttggtgttgaagctacttgatgatttgcaaattcaagcataccatattttcatttatgcaaaagaaagtattaactgttctgatgtctgggaagaatgagcacctctcaggaacataggttctgcttgagctactttagaccatttgactcctgaaagtaggagaaattatcagttagatagatcagcctctccagaggacctgcaaagtgcaagcaagaacagtgtggagccacttgcattgagtagtatgtgagtcaaagtcatggagaggagtggttgttgttcagtatttgctgtggattactgttaggactagtagatccatattctccctatttcctggtgttggtcattttgcattgctataaaggaattcctgagactggaagatttatacagaaaagaggtttatttagctcatggttctgtgggctgtgcaacaagtgtagtaccagcatttgctgctggcaaggcctcgggaagtttacaattatggtggaaggcaaagggaaagctgccttatcacatgatgagagggagtaaaagagagagggaggaggtgccaggcccttctcacgtgaactcacatctcacgtgaactcacagagagagaactcactcattaccatggggatggcaccaaggcattcatggggcatctgcccacatgacccaaacacctcccactaggccctcctctaacactggaggtcgcgtttcaacgtgagatttgtaggggacacacatccaaatcatttcactctctgaacagtgctctgtgtaactcttgccacttctaggtggataaggtggtgaagacccactaggtctggaagggcagagttgattctgtattgaggaggtcacagacctaatgtgaaaaattattgctccagcctcccttgtacaaaatttggacatgtgatacttttgacatgtttttggcgtgtcctgccagccaatggtgtgcaagtagacagagcaggggagtgaatccatgccaggacaattagctgttgtagtaaggggctgcagatttgcccttcccctttgtcttcagtgaagtgcccatctgttatataaatatttgaatgtggtggtgaggagggagggaactgtgtgtatttgtggaaagaagacaggaactgggtgcccttgagtgagcctcttaatctcaatgggtcacagttttgtgaaacgctacagtgagaatagtaacattaagcacccactaagcttgttggagtataaaaaagacatgatatgtgaaagcatttggttagcattatacatgtaaatgtacttttttaatgaatggacttgcttttccctagaaggcctttactggtagaatattgttcagctatcaaaaaacacggccttttatcaggaatttttcctaaattagcattattcacaattgaaactacatacttggtttctaagttttcatggcccagattattttattttgctaccttccccaccccatcccgagggaatatgtgaacaatttactattgacagataaaagataatgtgttgtgaaagtgacaggcccgaatcagcaggagagcctgcagttctcctgccttgctgtcattcagtgatgaaaatattacagaacgtttaatactatatgaactagaacaatacgcaatttcagaagaagccaccttatgacacttcaatttatttaacataaaagactgatggtcctattgaagttcaaagcttggaaaattttcaggaaggacaatttatactatttaggaaatgctctccctgagctttactgtttcatatttaatccagggtactacctaagattgcttataaagtcccttttgctgtgtggaccttcaacatctcatagtaaagagagaatatggtgtagtggttaagcatgcagagcttgtgcctttgttttcccatctgtaaaatggggataagagtagtacctacctcactgggttgttgtgtgtattaaatcagttaatatatacaacacatataatagtgacagacacagagtaagctctatataagtgtttgctattattattattacttaagttcttattatgaagattatctgcctagagtgtctctgtctaaaacaatagtctgcataaagtctgggttgtgttggagagggagaagagggtggtgaaggaatttttttcagtaaagaaccagcaatatctgctgcaaaggttcttccccacctcatccaactggaaaagccccgccagtcccttcaagaccctgttcaagcatcaaccctctccaccttctccacccttctcccagtggataattcccactgttatctcagcactttatttctgaattatatcagtcagtttctgaattatagctgttatcatactgcattatattatctgtttatgggtctctccctcactaggctgtgggctccttgaaggcagggactagtgtaattcaagcatagtgtcatggtatgcagtaagccattgatgctcatggagtggcagactatagctgggcagatttctctttcagagttgcccttccttgtgttcatttccttccctgcaggtctagactagagtcagtctcaaccgccctcaatttgccacttggccaaaggcctggactctctgcagtggggagctaaacatctgaatgaagtagtcatcaaaaccaaggtgagctttggagattgctatggcagaagtgaagagaagaggcaactagagtgacagtacatctttgctagttggggtcagtgttgggcatagctgttccctataactcagtactccagctagactgagatcaagagcatggctgagatcaagaacatgccctgtgttaccccttttgtgaggtcttctgagatgcccccaggcacacctaactgctagtactcctgtgcttcactgcaatttgaacatctctattaaaggactagtgattttattgcacatctgcttctcaccagactgtgagtcacatgagggcaggaactgtgaggtttcggttctgtagagctgctttaggtaaatggttgatgaatgagcaaatgaatcggtttgtctttctgatactacttcagtgatctgtccaaatgccgttaagaggcatattttgttacttgtttatcagtcatcttttctgcttgtttcaaccttcagtaaactgtggaactgttctctttcatgtagtacctggcacgtaggaatagtgcagcagataactattgaactgaatggcacctgagagcaacacagatgtagggttcttttattttctggatgtatttggaggcagggatataggtcagcaacccatagtgcagttgtcctttggggagggggtcagtgtgccaacctgtacagtttagatcggggactgtgaccacacacagtcaccagttaaatcaggcagccctattgcgcacatcatcatctccatcttcagttgtgtgtacagccaattgtaattactgaggcatataaggtagccaaatcatgtttgtgagcctccacttgaaaagtaaaagaaatatatgttatatgttagaatgagggttttttttcatacagagagaaacagaactaagaaaaaaataatttgtaatatttcagaaaactcaatttttgaggactctggatgatagaattcttacagtagctacccagctcagagcaatttgtgcatggaatacctttagggtatgtaagttccagaagatcatcatttagcttagtgcccagtatgatgccagtcattgtagaaaatttgacagattgatgatgcatggcctttgcccccaaagaatttgcattctaattgatgatctcagatgttatatctgcagtggtggtgagcagcttggaagagtataaaatataaagctaagctgtctattttgtgcgtgtgggaggcattcagaggagacatgccaagggtggggtatgtcaaggaaggctttatgataaaagcagtaggtgagtggaaattaaagtcaaagtgggagggtagggggacctgggaatgaaagtaaaagtgaacctgaggtgttagtaatggtgtatcctcactggattattcattaattcatcagttgaaatttatgtaactgactaccttgggccagacactatgatggatactagggacacagagatacacaggacatggtccctgcttttggcatactatggggacacccaaggagtgccttcctttattgaccatacagttaaatgactgacgagtcattcatgccttcaacaaacatttattaagtgtctgttttgggtcttactcagcattggatgctggggatacagaaatgagtcagaccagtccaagatactctcatactccaggtagatgcatgtgttaaaacatacaatcagctatttgctatttgcaaagtgcttctctcatatgaggcaggtttaatcctcatagcaatcttgtgaggttgtttctgttatattccccatctcacataatttgtgagattatgaactaagagattatgaaagtgagattatgagtttagttgataaactaaggcatagagctgttaagcaatttctctacgctcatactgctaagaagtagctgagctgagaagtgaatccaattcctctgcatgttttttttttttaatgtcctggaatcacaagagtatttgactcatactgtaggagcagaaataaaatgaaataaaatgaaaactgattttttgcgaaaagagaggcatcttctaagaaaatgaaagaatgattcttcgaatgggaaaattgccatcaactcaggggaagttatgaaaagtttgaagacatgtaatgggagagtgaacaaagtactaaaataagaagggaccacattggggtgtgttgctttactagtccactgtgagatattaagttggtgcaaaattaattgcggttttgccattaaaagtaataggcagtatcatggaatattggccatagagttaaatgttctataaggtgaaactattgttaaaaagtcacttgtgttatggaatcaccttcatgtgttagttattgatcttgccggcttgcaatttataaatgtatttttaaaagcaagagtccattatgtagattttctttctctttccttctttcctttcactgagtcaataattttaagataagaaaagaaatatataaaagatctattatagaacactgatgtccagtttaatcccttattcttttctgcaatcaaaagataaagtaggaagataactggaatcagtttgtgacagagaggaaaaaagaaattgactgtgattacaaacctcacaccaaaattattattatagacctgactcccaaattatgcagattgagaccacatgaaacatatggtgtattgtttttctacgcataacttgtttgatgtttgtttaaagaccttagatgaagaactggctcttgagatatcttgtctctcataatcacaatctgaatctgccttaccctcacttgaggtttacatggagagtttcaaactgaaataatgcaaaaattccttatgtgacatggtgatgtggagtgtgggctttggctctaagtttgtgatgggattggtgtagtgttcgcatggaaataatcatatacttggcagcattttctctgaggctattagacctgaatggacagaaatactgatgtttgcaaattccctctggcagtatggtgcaagtgatatcattcatatcctttctttccattttctatcttcctacactcagtgacctcagagatcatctggccattctttctacagttgatgaactcagtcctggagagtgtaaaggacctgctcaaggttttttggcatagccaagtatagcttctagaagtaatttccattgatcttattgcttgctcttcagaactatctaatgaggtggctggcaagatggccgaataggaacagctccagtctgcagctcccagcgagatcaacgcagaaggcaggtgatttctgcatttccaactgaggtacccagctcatctcattgggcctggttagagtgtgtgtgcagcccatgcagggcgagctgaagcagggtgggacgtcacctcacctgggaagcacaaggagctggggaagtccctccccatgagggactgtgctgtgaggaacagtgcattccggaccagatactatgcttttcccatggtctttgcaacccgcagaccaggagattcccttgggtgcctaaacaaccagggccctgggtttgaagcacaaaaatggctggccgtttgggccaacacatagctagctgcaggagttctttttcataccccagtggcaactggaatgcaagagagagagaaatgttcactcccctggaaaagggctgaagccagggagctaggtggtctagctgcccggatcccacccccatggagccccgcaagctaagatccactggcttgaaattcttgctgccagcaccaggcctgccttacaagagctcctgaaggaagcactaaacatggaaaggaataaccggtaccagccactgcaaaaacataccaaattgtaaagaccatcaacactgtgctgaaactgcatcaacaaacagacagaataaccagttagtatcataaggacaggatcaaattcacacataacaatattaaccttaaatgtaaatgggctaaatgccccaattaaaagacacagactggcaaattggataaagagtcaagacccatcagtgtgctgtattcaggggacccatctcatgtgcaaagacacacagaggctcaaagtgaagggatggaggaatatttatcaagcaaagagaaagcaaaaaaaaaaaaaaaaaaagcaggggttgcaatcctagtctctgataaatcagagtttaaacgaacaaagatcaaaaaagacaaagaagggcattacataatggtaaagggatcaacacaacaagaagagctaactatcctaaatatatatgcacccaatacaggaacacccagattcataaagaaaattcttagagatccacaaagagacttagactcccacacaataatactgggagactttaacacctcactgtcaatattagacagctcaatcagacagaaaattcacaaggatattcaggactcaaactcagctctggacgaagcagacctaatagacatctacagaactctccaccccaaatgaacagaagatatattcttcaaagcaacacatcgcacttattctaaaatcgatcacataattggaagtaaaacactcctcagcaaatgcaaaagaatggaaatcacaacaaacagtctctcagaccacagtgcaaagaactcaggattaagaaactcactcaaaactgcacaactacatggaaactgaacaacctgctcctgaatgactagtgggtaaataacaaaatgaaggcagaaataaataagttctttgaaaccaacgagaacaaagacacaatgcagcagaatctctgggacatagctaaagcagtgtttagagggaaatttatagcaataaatgcccacaggagaaactgggaaagatctaaaatagacaccctaacattacaattaaaagaactagagaagcaagagcaaacaaattcaaaagccaggagaagacagaagacaagaagtgaataggatcagagcagaactgaaggagatagagacaaaaaaaaaaaaaaaacccttcaaaaaatcagtgaatccaggagctgattttttgaaaagattaacaagatagatagaccactagccagattaaagaagaagaaaagagagaagaatcaaatagacacaataaaaaatgataaacgggatatcaccactgatcccacagaaacataaactaccataagagaatactataaacacctctatacaaataaactagaaaatctagaagaaagggataaattcctgtacacataaacattcccaagactaaacctagaagcagctgattccctgaatagaccaatgacaagttctgaaatcgaggcagtaattaatagcctaccaaccaaaagaagcccaggaccagacagattcacagcctaattctaccattggtacaaagaggagctggtaccattccttctgaaactattccaaacaatagaaaaagagggactcctccctaactaattttatgaggtcagcatcatcctgctaccaaaacctggcagagacacaacaacaacaaaaaaatttcaggccaatatccatgatgaacatagatgcaaaaatcctcaataaaatactagtaaactggatctagcagcacatcaaaaaacttatccactacaatcaagtgggcttcatccctgggatgcaaggctggtttaacatacacaaatcaataaacataatctatcacataaacagaaccagtgacaaaaaccacatgattatctcaatagattcagaaaagggcttcagtaatattcaacactctttcatgctaaaaactctctataaactaggtttgatggaacctatctcaaaataataagagctatttatgacaaacccacagccaatatcatactgaatgggcaaaagctggaagcattccctttgaaaactggcacaagacaatatgctctctctcagaactcttattcaacattgtattggaagttctggccagggcaatcaggcaagaaaaagaaataaagcatatttaaatagaaagagaggaagtcaaattgtctctgtatgcagatgacatgactgtatatttagattagacaaccccatcctttcagccccaaatctccttaagctgataagcaaatttagcaaagtctcaggatacaaaatcaatgtacaaaaatcacaagcattcctatacaccaataatagacaaacagagagccaagtcatgagtgaactcccattcacaattgctacaaagagaataaaatacctaggaatccaacttacaagggatgtgaaggacctcttcaaggagaactacaaaccactgctcaaggaaataagagaggacacaaacaaatggaaaaacattccatgctcctggataggaagaaacaatatcatgaatatggccatactgcccatagtaatttatagattcaatgctatccctatcaagctaccactgactttcttcacagaattagaaaaaactactttaaatttcatatggaatcaaaaaagagcctgtatagccaagtcaatcctaagccaaaagaacaaagctggaggcatcacactacctgacttcaaactatactacaaggctacagtaagcaaaacagcatggtgctggtaccaaaacagagttatagaccaatggaacagaacagaggcctcagaaataaagccacacatctacaaccttctgatctttgacaaacctgacaaaaacaagcaatggggaaaggattccctatttaataaatggtgttgggtaaactggctagccatatgcagaaaactgaaactggaccccttccttacatcttatacaaaaattaactcaagatggattaaacgttaagacctaaaaccatgaacaccctagaagaaaacctaggcaataccattcaggacataggcatgggcaaagatgtcatgactaaaataccaaaagcaatggcaacaaaagcgaaaattgacaaatgggatctaattcaactaaagagcttctgaacagcaaaagaaactatcatcaggttgaacaggcaacctacagaatgggagaaaatttttgcattctatccatctgacaaagagctaacatccagaatctacaaggaacttaaataaatttacaagatgaaaacaaacaactccatcaaaaagtgggcaaaggatatgaacagacacttctcaagagaagacatttatgtggccaacaaacatatgaaagaaagttcatcatcactggtcattggagaaatgcaaatcaaaaccacaatgagataccatctcatgccagttagaatggcaatcattaaaaagtcaggaaacaacagatgctgcagaggatgtggagaaataggaatgcttttacactgttggtgggactgtaaactagttcaaccattgtggaagacagtgtggtgattcctcaaggatctagaaccagaaataccatttgacccaccaatcccattgctgggtatatacccaatggcttataaatcgttctgctataaagacacatgcacacggatgtttatttcagcactattcacaataacaagacttggaaccaacccaaatgcccatcaatgatagactggataaagaaaatgtggcacatatacaccatggaattctatgcagccataaaaaaggatgagtttatggcctttgcagggatatgaatgaagctggaaaccatcattcttagcaaacttacacaggaacagaaaaccagacactgcatgttctcactcataagtgggagttgaacaatgagaacacatggacacagcaagggtaacatcacacactggggcctgtcaggggatgggggactaggggacggatagcattaggagaaatacctaatgtagatgacgggttgatgggtgcagctaaccaccatggcacgtatatacccgtgtaacaaacctgcacgttctgcccatgtatcccagaacttaaagtataattttaaaaacatttacatatatatatatattatatttatattcatatattttaaaaaaagagctatctgatgagacaggtgaggcaggttgttttgtatcaatttctagaagagacagtttagagccagggaggttaaaatgctggttaatggcccaagacgtagccagcagctcagctgggactaaagtccagatcttctgatttcttgtagcacaccatattgcctctgaattcttttctttcaaaacagatatttctgtccttttgggtttgtcaaggaatcacttcctatgttattcttttgacactggtattcgttggcacttgcaaattgccttagattggtaattaacttttaaaatttgtagatattttgtttctctaactatattataatctctctgaggattgagggccagccaggttttatactgcctttgaatcttccttagtacctagcttgtaatatatgcttgacaaatatttgtttagtgtctgatagtggaagtcagctggaggttggtgtatgtctaatataaatctggaaattaaagtctcttttggttcttggctcaggatataaaaagcatcatgggtaataaaatttacaagttttctagcctaatcaggtattatgtaaaatttgtatcctgatttgagaaaatctgtatctgccagtgtgttctgactgttggaacatgaatataaagattaatttgagattgcagagttctgccatagggtttggtgaaatactacctaaactgtcctcagagctttctgatatctatcaatagtggaaagttgatcttgtttctcctttaaagatttttgtctttagagctttgtgcaaaggttgaccagaacctcggaatcctaggatggatcgaatacctggtgtgtgctaagagctaggaaagtggaagctggattatgcacgggtagaaaatgaagagagggcaagaggaaggaagaaatggaaagtgtaagccaatgtgagtaggagtttggacgcaagccccatatttgaatcaggaaacaaggctgttggcagggctgattgtcatctccccagatgacctgctggccagaaagagttaactggccttacaacctgctgcaggaatagctcaagagctatcaaattcatcacatgtaacttttcactcagattggttttgggtcctgatatttacgagttaaaacatcttaacatcatttcaaatatttgtgaaagtatatgggaattttatggagcagcggggaatttaatgcaaataaagtagaaatatagagtcatatttgagtttttatgttgaaatcatatcttgatgaagttagttttaaacaactatatttactgaggacccactggggacaaaacacattcaaggtatttttttcagtttttaaaatttttgcaggaaagaaagaaccagtcacatcgaagcaacttgaatgtttataaaggaaaatcatagaagaatggacatcctttactcttgaaaagtttatgaataagctgcatgtcaaagcaatatcataatcacaaagtagagaagataatccattgttttcttgtataaagtcattagcattctaacttattcattcatttgtaaatcacacattgaaaagaaaacaattagcacactctttcacatatctgtgataagtcctcaggcctactcaggaagctgttgaaaatgggcatgctgatttgttattaatgcttatatattttagaaaaagcatccaatttagaaattaaattgatttttttttctttttacaaaatgaaagtcattactacaggaggtagggagacaagcaggcagacaaacaagacagcagggcagagccctgactggggcataggatctgttcacatcccatttctgttgaaggaagattatagcctaagagcatacagtagagggttggattagaacctcccatcagaagccatcaagaggtattctctttcccctgttctcttgcacttgtttctttcacaagttttttcagcatttttgggtactctgttgtacaacctaaaataaattaggcatctaataatagttttcttaaggaggcaaaaggaaaaaaaagtagaatttgtatttctcatgtttctaatacggattcttcttttaaaagtagccccaagaatgcatccttattctttcagcataagaatatgctgtcagctctggggacactaagatgaatagggcacaaccttacttgctaggttctcataatccagttggctgctcaggataagtcaagcataaagacattatcaaggccctgtgggaattcagaagggaggaaatttattcctgctaagggactcagggaaggcttcctggaagaggacaatcagagctggactttggcagataggtaggatctgcacatgaagagatgggaggagatggaggcagctgtcacatagttgagaaatcatgtgatgtgttggctaacagaacgcacttttttcttggagtctgaggcttgggaagggaaatgacgggaggtcaggttagcaatataagttgaagctagattggtagggacagccttgaatgtcaggccaatgtctttgggactttataggtagtgctaagacatatccagagaattagctaggcagtgtcacgaacagatatttatagcatattgtggcaagaaacatgagtgcaggatggttggaggccttgaggagggagccgctaagctgccaaggtgtgaaagctggagcatcgtcaaggaagcttgcatgaaagtgatgacattttgctgaaccttgaaggatggatatgaattccccagggaataggttgggaaaggacatttcaggcagaaagaatagcacctgcaaagtcccagtggtctatgagggaatgttatgctgaagaatggcaattactgtgatgtagagaatgcaggtatctgggaattgggtagcaagagaccaagctaggaagagggcaaagaccagatcccagcagaactagtaggcctggctgggtggtttcaacttcaagggctgtatgcaggaaacaattgtgatgtgtgcttttagaaatatcatgctagcagtggtgaggaggatgcattagcataaatgagaaaggcttagcttgctgagtggtagggtggcaatggaactaaaatacgtaaagaaacagtgtttggggcttagagagagtctgggcaagacagagggtggactgaaaggatttagggggaatggtttttatactttaattaatgctgtggttttcacaataggtctctttgtttcaaaggaaatcttacgcaaactccatgaaagataagggccaagctgcatggagttcaggtgggaattgggcttggatccaagcctgcttgttcccttgaaatcctgcaatttcgtgatggctcctgaggtacctctttgaaccctttgtagttcagcaaatgcagtttgaaagccactgccctgaaaagattcatgtgctccaccaaaaacccaggcctttgccctccatgctgctgggagagggaaactggcctcttgctgtcatggttgggcaccgaaaaaggcaggcttatctagggacaatgaacttgatctcttttagaggctctcactgatcctggtggctcactgatgaggcatctggagtattctttgatacctagggacattgtagttcccaaggcattttgaacaatcgtttgtagtccaatcaggccgaattcatgaaaggaatttctgggttctaggtagaaagcagggccagacgcagtggcttatgcctgtaatcctagctctttgggaggctgaggcaggaggatcccttgagaccaggagttcaagctgtgattgcacctctgtaccccagcttgggcaacagagcaagatcctgtctctttaaaaaatacaagcaagcaagcaggggataaaagaggtgcctaggccagagataagcaaggggagctggagacagggccattgtacagggatgtctggccctcggggtcagtgaggctgatattcagacagtgcttttggcagctgatgaggagctgcactcttccagagggattacctttttctaattcatagaaaggcaccttatgctctagcattggatatttgggaagatagcatgaagaggtggtgaagagcaagagataaatggggagttggggttggaatcaaatgtctgctcaacccttatgaggtgtgtgaccttgcacaacttccctaatctcttggatcatcagcttcattctccatgaaacatgaatgatactagtacctcctgttgtgggcttttatgaagattaaagaagataatttgtgtaaagtgcttaacacagtgcctggtacatagtaagtgttggataaattttggctgttaatattctttatttgtaatcagaacactgtctactccattacagcagtaacttcagacttcatatcttgatacatttctctttactaagaaagaatgcctctcagttcaacaacatgggcatgagcatcttatattttcagttatgtcctataaaagaaatacaaggaatgactactagcatggattttaaaaattactagatgtatttcagatacaaaattggatgctatggtgaataatccagggggtactcatggacccaccacttagcttagtaaaacattactgatgcagttaaagctccttgtgtatccctcactgatattcccttccttcttgcctggaggggaccaagtttctgaatttggcgtgaataactttcatgaatgttttaatattgctattacatttgtagctatctgtaaagaatgtataatttgtgttttaattattttagctttatgtagaagaccttttactgtattttttcttcaacagccctctttttccccctcaacatttacctaacataaacatatacttgttgctatacataaggtagggaagtaataaaaattgttatttattatggagaagagtgtcagctttttgttgtaaaataaaaaaatgatatatttaaaaatactaaatgtatttcaaattgactttctgaaagatctaggtagaaagagagttaggttttggaattttatctgatatacctacaggccactcataattatagggtacccaaacctgcaccttattaaaccttgatcgaatggttgtattgatgaaacatccacaattctgtttacataacacttgcttggatttggagacttggcatcttgactattaagtatgaaactgtcttgaaaaatcactgggttcatgaaaggttttaaatgaaatagcatgcatctataaaccattctctcatatttatccatttgagtgtgaagtagtatcctagttttcattttgaactccagagtcttatatttgtgaaatatgatgtcttctctttaactacaattgtatgatttttgaaagaatagatattggcatttatattctggtaaagttgcattgttatagtttgcaaattattaatccacagcacttatactttactgtttgaaaggagtcctatgcttttttcttttaaagcagaatgtggcatatacattaacacattgtcccacatttttgctaagtggaatgtgtctgactttgtgggctgatgaatgatgccatatttatttctgaatcaatcttatggcttatcagtgcagttatcacttatgtgatctgagacttttagctgggactccagagacattgatgatctttatcattctgtatcactcataaaggatcagggtcagttgaggttttgacacctggccatgtatttaatgttttggctttgttggatgtaactcatctggcacaatgttattaccacatcactgagtgagatgtcctcattttcagatgttgccaacattaatatctcagatttcaggaataaaaagttacctagggtgagttgagatgagtgacattgacatgtgtgtgtacctacatacatgtatttgctgacttgacttttgcttatctttatctctgtaattagaatatatcttctcttgattaaattaaacctgtcattttcccataatcatttatcaaatgttcctatacgccagctactatgccaagtacagggtatatacaagttactcttgaagagctcacagtccaataagggagacagtatactttgtcaggtgcttccgttgacttatgcacaatgtattagaggaacagaaaaggaaggagatattcatttatataaaataattgctcaagggaggcttctcagagcaggtgatatttgatgtgagtcttactgggtgaataggagtttgccaaattgaaatgcagagggtatatcatttgcaaaggcacagaagcataaaagaggacgatgagtttgggaagcatatgtgagggtaagagggaggctggaaattgagattgggccagatcatgaagggtctcatgtatcatgataaggagcttgggtgttatcttttaaggggaattgaaggagtgtttcatatggaaaagtgaaattttcatatggaaaaggttttagggaggctgtcttagtctattttgtgtgattataacaaaatatcagagactgagtgatttataaaggaaagaagtttatttagctaatggttctagaggctaggaagtccagtggcatggtgtctggcatctgtaaggccctcatgacctaaatacctccaattaggcctcacttcccaacactgttgcattgagaattaaatgtcaacatgagttttgggtgggggtattcaaaccacagaattctgcccctggatacccccaaatcatgtcctttttacatacaaaagacattcattccatccaaatagccttaaagccttaatttatttcagcactatattagtccattctcacactgctaataaagacatactgggtaatttataaaggaaagagatttaattgactcacagctcagtatggctggggaagactcaggaatcttacaatcatggcagaaagggtagcaaatacgtccttcttcacatggcagctagagagagaaaaacgagaaccaagcaaagggggaaaccccttataaaacaatcagatcctgtgaaaacttactatcacgagaatagcataggggtaactgcccccatgattcaattacctcccagtgggtccctcacatgacacgtggggattatgggaactacaagatgagatttgggtggggacacagccaaaccatatcattctgtgaccttcccctaccaaatctcatgtcctcacattttaaaacacaatcatgcccttccaacagtcctccagagtcttagctcattccagcattaacccaaaagtccaactccaaagttttatctgagacaaggcaagtcccttcttcctatgagactgtaaaatcaaaagcaagttagttacttcctagatacaatggaggtacaggcattgggtaaatacacccattccaaatgggagaaaatggccaaaacaaaggggcccaggctgtttgatacttcttttgaaatctaagtggagactatcataccctcatacccccacagttcttgcattctttgggcctgcaggattagtaccatgtggatgtagccaagcttaatggcttgtaacttccagagtgggagattgaggcacaccttgggccgcttgaaatccagctggggcaaactaggggacaaagctccagaacgtggggagcagtatcctgaggttgcacagggcagtgaacttttggaggccacccaggcctgttcccccaaaccattctgcccttgagagctctgggcccctgatggaaggggcagagtaaaaaatatccaaagtgctttcgggatttttctcccattgttctgatggctagcacctggctcccttctagccctaccaatctctttaacaaatggtcacttggccacactcttgcaagctttttcagtttttatgtggcaggctgcagattttccaaatctttctgttccgctactctcttttaattatgaatttcatctttaagtcatttctttccttttgcatctcactttatgtggttaaaagtagccaatcatcatcctgaatgctatgcttcttagatatttcttctgccagatatcctagttcatcattttctgcattccataaaatcctaggacatggacacaattctgccaagttcgttgcaactgtgtaacaaggatgccatttactacagtttccaataagttgtttctcatttccatctgagagtttgtcagaatggactttaacgtccatatttctaccagcattgtgatcacaaccacttaagtaatccctaagaagttccagactttctctagtcttcttttcttctgagccctccccagagtctcccttagtgccctattcacagcaatctagggtttttaaacttgctcctataaattcttttttttttcagtttggcaaccattcttattttatttaaagtacagataagagaaaataatattaagtagttcatttactattgtgatgattaactttatttatcaatgtggctaagctataagtaaacagttcttcaaacatcagtccaaatgttgctgtgaatgtattttttaatagaattctccattcatttatttatttatttatttatttatttatttatttgagacaaggtctcactctatcacccaggttggagtgcagtggtgcattttggctcagtgcagcctcagcctcctgggcttaagcaatccttccacctcggcttcctgagtagctaggactacaggcacatctcatgacgcccggcaaaatttgttattttgtagtgacaaggccttgctatgttgcccaagctgctctcgaactcctgggcttaagtgatccacccgcctgggctctaaaagtgcagagattacaggcgtgagccactgcacctggctagtggtacttttagatgtgatttgacatttaaatcagtagaccttaagaaaaaaagattaatctccataatgtacatggccctcatccaatcagttggaaaccttattagcaaaaactgaggttccccgacatagaaggaattatccacagaactaccacatgaaaacccattgggagatatacctaatgctagatgacgaattagtgggtgcagcgcaccagcatgtcacatgtatacatatgtaactgacctgcacattgtgcacatgtaccctaaaacttaaagtataataataataataaaaaaaaaaaaaaagaaaactcagcctgaatttccagcctgcaagcctgccctgcaaatttcagagctgtcagcccccaccttaacgttgtcataaatacttcggttttggttgttcacaaaatatgattccttatttggaatatttggggggaatattctagaggaaaaaagcataccaaataagcatgctgtgctcagttattccaacttaaattcatgatgctgcttgaacatactgtttttggatctctaatgcacagcatccttagactggattttcctaagaaaacttcaggaaaattttagagttgttgaattcatttgatagaaacagacattaacccaaataataatagaaataataatggtggtggtgatagtagtggtggcagtaataatagtagtagtagtagttattataatattgatttgcatacctgaaaggagtaaaagtagacctggcttcaaagctgaatgacctccaacaatgtgaccaggactccctcactatccttgagtttgatttctccagtgtacaacttcttcttcttcttcttttaaattattatgcttaaagttctgggatacatgggcagaacatgcaggtttgttacacaggtatacacgtgccatggtggtttgctgcacccatcaacctgtcatctacattaggtatttctcctaatgctatccctcccctaggcccccaccccctgacaggccccagtgtgtgatgttccccttcctgtgtccatgtgttctcagtgttcaactcccacttatgagtgagagaatgcagtgtttggttttctgttcctgtgttagtttgctgagaatgatggtttccagcttcattcatatccctgcaaaggacataaactcatccttttttatggctgcatagtataccatggtgtatatgtgccacattttctttatccagtctatcattgatgggcatttgggttggttccaagactttgctattgtgaatagtgctgcaataaacatacgtgtgcatgtgtctttatagtagcatgatttatgatcctttgggtatatacccagtaatgggattggtgggtcaaatggtatttctggttctagacccttgaggaatcaccacactgtcttccacaatggttgaattaatttacactcccaccaacagtgtaaaagcattcctatttctccacatcctctgtagcatctgttgtttcctgactttttaatgatcgccattctaactggcatgagatggtatctcattgtggttttgatttgcatttctccaatgaccagtgatgatgaactttttttcatatgtttgttggtcacataaatgtcttcttttgagaagtgtctgttcatatcttttgcccactttttgatggagttgtttgtttttatcttgtaaatttatttaagttccttgtagattctggatgttagctctttgtcagatggatagaatgcaaaaattttctccaattctgtagggtacctgttcactctgatgatagtttcttttgctgttcagaagctctttagttgaattagatcccatttgtcaattttggcttttgttgccattgcttttggtatttcagtcgtgacatctttgcccgtgcctatgtcctgaacggtattgcctaggttttcttctagggtgttcatggttttaggtcttaacgtttaatccatcttgagttaatttttgtataagatgtaaggaaggggtccagtttcagttttctgcatatggctagccagttttcccaacaccatttattgaatagagaatcctttccccattgcttgtttttgtcaggtttgtcaaagatcagaaggttgtagatgtgtggctttatttctgaggctgtgttctgttccattggtctttatatctgtttttgtaccagcaccatgctgttttgcttactgtagccttgtagtgtagtttgaagtcaggtagcgtgatgcctccagctttgttctttttgcttaggattgtcttgcctatacaggctctttttgtggttctatatgaaatttaaagtagttttttctaattgtgtgaagaaagtcaatggtagcttgatgggaatagcattgaatctataaattactatgggcagtatggccattttcatggtattgattcttcctatccatgagcatggaatgtttttccattcgtgtcctctcttatttccttgagcagtggtttgtagttctccttgaagaggtccttcacatccctttaagttgtattcctagctattttattctctttgtagcaattgtgaatgggagttcactcatgacttggctctctgtttgtctattattggtgtataggaatgcttgtgatttttgcgctcattgattttgtatcctgagactttgctgaagttgcttatcagcttaaggagattttggcctgaggcaatgggattgtctaaatttacaatcatgtcatgtgcatacagagacaatttgacttcctctcttcctatttaaatacactttatttctttctcttgcctgagtgccgtggccagacttcccatactttattgaataggagggctaagagagagtatattgtcttgtggccagacttcccatactttattgaataggagtgctaagagagagtatattgtcttgtgccagttttcaaagggaatgcttccagcttttgcccattcattatgatattgactgtgggtttgtcataagtagctcttattattttgagatatgttccatcaatacctagtttattgagggtttttagcatgaaggagtgttgaatattattgaagcccttttctgcatctattgagataatgtggtttttgtcattggttctgtttatgtgatagattatgtttattgatttgtgtatgttaaaccagccttgcatcccagggatgaagcccacttgatcgtggtggataagctttttaatgtgctgctagattcattttgccagtattttattgaggatttttgcatctatgttcatcatggatattggcctgaaatttttttgttgttgttgtgtctctgccaggttttggtagcaggatgatgctggcctcataaaatgagttagggaggagtccctctttttccgttgtttggaatagtttcagaaggaatggtaccagctcctctttgtaccaatggtagaattcagctgtgaatccatctggtcctgggtttttttggttggtaggctattaattactgcctcgatttcagaacttgtcattggtctattcagggaattgacttcttcctggtttagtcttgggagggtgcatgtgtccaggaatttaaccatttcttctagattttctagtttatttgcatagaggtgtttatagtattctctgatggtagtttgtgtttctgtgggatcagtggtgatatcccgtttatcattttttattgtgtctatttgattcttctctcttttcttctttattcgtcagtctgactagcagtctatctattttgttaatcttttccaaaaatcagctcctggattccttgatttttttaacggtcttttcatgtctctatctccttcagttctgctctgatcttagttatttcttgccctctgctagcttttgaattcatttgctcttgcttctctagttctttcaattgtgatttcagggtgtcaattttagatctttcccactttctcctgtgggcattcagtgctataaatttccctctaaacactgctttagctgtgtcctacagattgtgttacgttgtgtctttgttctcattggtttcaaagaagttatttatttctgccttcatttcgttatttacccactagtcattcaggagcaggttgttcagtttccatgtggttgtgcggttttgagtgagtttcttaatcctgagttttaatttgattgcactgtggtctgagagactgtttgttatgatttccattcttttgcatttgctgaggagtgttttacttccaattatgtggtcgattttagaataagtgtgatgtggtgctaagaagaatgtatcttctgttgatttggggtggagagttctgtagatgtctcttaggtctgcttggtccagagctgagttcaagtcgtgaatatccttgttaattttctgtgtcattgatctgtctgatattgacagtgaggtgttaaagtctcccagtattattgtgtgggagtctaattctctttgtaggtctctaagggcttgctttatgaatctgggtgctccttaattgggtgcatatatatttaggatagttagctcttcttgttgtgttgatccctttacgattatgtaatgcccttctttgtcttttttgatctttgttggtttaaactctgttttatcagagactaggattataacccacactgtttttttttttttttttgctttctctttgcttggtaaatattcctccatcccttcactttgagcctctgtgcgtctttgcacgtgagatgagtctcctgaatacagcacactgatgggtcttgactctttatccaatttgccagtctgtgtcttgtaatttgggcatttagcctatttacatttaaggttaatactgttatgtgtgaatttgatcctgtcattatgatgctaactggttattttgcccatttgttgatgctgtttcttcatagtgttgatggtctttacaatttggtatgtttttgcagtggctggtaccagtttttcctttccatatttagtgcttccttcaggaactcttgtaaggcagacctgctggtgacaaaatctctcagcatttggctgtctgtaaagtattttatttctccttcacttatgaagcttagtttggctgcatatgaaattctgggtcgaaaattcttttctttaagaatgttgaatattggcccccactctcttctggcttgtagggtttctgcagagagatctgctgttagcctgatgggcttccctttgtgggtaacccaacctttctctctggctgcccttaacattttttccttcgtttcaaccttagtgaatctgatgattatgtgtcttggggttgctcttctcgaggagtatctttatggtgttctctgtatttcctgaatttgaatgttggcctgtcttgctaggttagggaagttctcctggataatatcctgaagagtatttttccaacttgcttccattctccccatcactttcaggtacaccagtcaaatgtaggtttggtcttttcacatagtcccatatttcttggaggctttgtttgttccttttcattcttgtttcaataatcttctcttcatgctttatttcattaagttgatcttcaatctctgatatcctttcttttgcttgactgatttggctactgatacctctgtctgcttcacaaagttcttacgctgtgtttttcacctccatcaggtcatttatgttattctttaaactggttattctagttagcaattactttctttcagagatgccctgcccagagaggaggaatctagagaggcagtctggctacagagccattctgtacctggctccgcccagtttgaacttcttggcagctttctttacactgtgaggggaaacctgcctactcaagcctcagtaatgtatgatgcccctccccccaccaagctggagtgtcccaggtctacttcagtctgctttcctggcagcaagaatttcaagccattgaattttagcttgctgggctcaatgggggtgggctctgctgagctagaccacttggctccctggctgcacccccctttccaggggagtgaacggttttctctctctggtgttccaggcaccactgggatatcaaaaaaaaaaaatgctgcagctagctaggtgtctgcccaaatggccgcaccgttttgtgcttgaaacccagggccctggtggtgttggcacctgagagaatctgctagtctgtgggctgtgaataccatgggaagggcatagtatctgggctggaatgcaccattccgcatggcacattccttcagggcttccattggctaggggagggagtttcccgcccccttgcacttcctgggtgaggcaacgccccaccctgcttcagcttgccctccatgggctgcacccactgtctaaccagtcccattgagatgagctgggtacctcagttggaaatgcataaatcacatgccttctgcattgatctcactgggagctgcagaccacagctgttcctattcggccaccccgacagccacatcctgtaacttcttccagcccctacccatcatccagttctaaggctgcttccacattttcagatatttgttgtggcaacaacaccactttctggtactaattttctttctttgttttctattgctaaaacagaataccacagactgggtaatttataaaacaaagatgttaatttaactcatggttctggaggctgggaagttaaaaaccattacacctgcatggggtgaaggccttcttgctgcatcacaacatggtgaagggcatcacatgttaagaagggaagaacaagagagctagagagagcttgcttttataacaaagccactcctgagataacaaactcactcctgatagtgacattaatccctttatgagggtagaagtattaagtttccaacacatgaacttttggaggatacatttaaaccatagcagaggtctctcagatagcagtttggagtaaatttaaacaagatagaagtggaaggtggggctcattataatctgatctagtacaaagtgcctgggtctaaatcagaaatacctgggtttgagtccttgctttgccacttattagtcgtgtgacctttggcaaatgatatagcttccgagtttagtttgcttatcagtgaaataaggatgacaattcctacattacagggctatggtaaggaaataataataataatgataataatcagacttacagcatatttcacgtggctggcatatggtagatgctcagcaaatgtcactttcctttccattctcttcttatattggcagtttgcccttctaatggttcctggaatagtgtgttgtgctcctagattttctcagcggcctcttgtttggttcttgttttcctcagatgactttctgatgtttacttagtttccttagcgttttacttctcatttcaatttgacataaagcaatgacgtaaggaccaggtacatttttctcaccttcatttattgtggcccataaagcttaaacatgttggcttgtggactgcagtgtactttttctcaccttagatgttaagtatgtgccccatggtagagttactgaataaaaatttctgggagtgggctctgattttgttaagaatggtagaatatgttagaataaatactatcataagctcccttgattattcttgtgcatactgaagttggagaacgacttaagcctgtgggctttaaggttgagcgcctcggtttctaactggctgttggccagagaccacactcagtttcttgccacatgggccttaccaataagactccttgcttattcaaagccagtaagggagtcacttagcaatataagggttacattttgatgcattgtaatcatgtacacataatcaaattcgtcttatcaccttggcaatgtcctgttggttagaagcaagtcaggatcaaagggaggagtttatacaggggcgtgaataccaggaagcagagatcatgggggccaccttaaagcctgtccccatagaatgtgaggggagaggggaggtagtaagttcagttgtctgcatgtgacatttaaaaaacttgtgggcaaaagtgggtttataatgaatctaaagaagttttgggtgatttattttctctcacaggagaagactctgctgaccagggctcaaccctgacaaaacaattttatgttcatcattttgtattccattcctaaaaagagtctctgaaattgtataaacttgaagcctcaccaaacattgactttccctgcctgtgggaaagcttcctgggtctggagaatattctgctgcccagggctcaccctgaaaaacagccccgagctgtggcttgcatatccctggcctagcagcttttaccaggaggtggccattagcaatggaaatccctaaaccatgatcccaagcactttctgaagagtggggaggacaagttccagaagactgcttttgtatcaggtctattgttctttgggagctcatgttaagcagaggagaaaaattgacttctcagacaagcatttccctactcttctgcacccaccgtcagttcactaggcatctgcatctccagggcaaacatgcctctgaagactgctggagctagtctcctgtgttgtggccagtaagaacttttgcacatttctgcctttcttcctgtccccagaaacttacagtccctaccctagaatggtgagtcaaagtagtccacggttagctgcagtgtcctgaagataactcatggagacaaactaaaaagtcaaagaagttgtatccctccacctgtcatctgagtgttgggggatttctttgcttaagtgggtgacttgggagactttctttctagtagatacttgttggccagcactgacctggaagggcctatagagagacagagctggattaggctctaaagcgtcttcagtgctgggtctcatgttattgcatgtaaattagagatccccaatatcaaaatgtagctattacatgacaattccttttcattaagaagcaattgcttttcattaagaagaggcttcaagacacaggagccatgcaccctgagggtatgggggtgtcattaatgcttaaggtactaaatatgcacacctagttttagctatagactaaatgattaatatggcctgtatatgtgctcctgtttttcacaagtatatgcatactcttgtgatggcaggataagtaataagctctggaaccagactgcatggtttgagattctccatctagaacatacaagctttgtatgtatgtataatgatgctagacaaattgcttaacttctctgagcctcaacatccttgtctgggaaatgaatataataatagcatgtacctcaaaacgttgttgtctaccttatattaaatatttttttaaaaatccttagaacagtccctggtacaaagtaagtgctgtatatattaacctttattactactaatatacaaattaaaagaactacccaagacatggtagctgcttgcagtttgttgttttctcaatcaaaatatattgaaagcacaactgctgctgtgttccttaaatgagcgcagagccagggacagggcctagggctcctgactacacttgccgcatcatttttactattgcagattgcgtgttttgtctctttgcttaatgaaaagcaatcacaccttttgttgttattaagggcttattgtcatttaatggctacattttgctattggagacttttctaatttacaagcggtaattgttctggacacgtgactctcatttagtatctgctgaagagcccttgttcataattattgcttccgtggttatgttatgtatttatccagccctttctttagacaattgatatgttgtcctggatacctccctgttgctgatttggagttggtcaatccatcgcttcatcagtgctcttaaaataatgagttatggcatgctttgtgatcagcacataatgttctgagtggaaaaaactcatggcgactctcaggagtgctattttttgtccccttgcccactcctgcacacatgcttgcttctgtttagccagaacctcatcttgctaatagtggtcataggaaattttctcaccaatgggacctatgtgtgcatatacaagggggtagtcatggggtgttagatttcaggtaaaatcagaagacttttttgtgtttggtcttttctcaagatggtatctgtgtttatttcctagaattgttgtaacagatgactacaaatttgattccttgaaacaacagaaaatcattgtctcatagttctggaggctagaagtctgaaatccaagtattagtaggactctaggggagagtgcttccttgcctcttctagcttctgctggttgctaacaatctttgacattccagtctctgcctctgtcttctcaaggccttttcccatgtgtgtgcatgtatttcccctttctctatgtccaaattttcctctacttataacgataacagtcattggattagggcccaattaacctagtccactatgacatcatcttaccttgattatatctgtagagactttatttccaaataaagtcacattcacaggtacttgggagttaggatttaaacgtatctttttgggggacataatttaactcacaacagtggcttttccttgtctctcttatttttcctagtttttaaattttaaagaagggaaaactcccttccacccagtggcacaggaatgagttgatttatatggattaaaagtcatagatgttagaagaggaggaaagtcctagaagaaattgtagcccatttctttcaccaactgaggtctaggggagagggggctatttggctaaggtcagaaatctgataagggatagagccagtcgtcagacttcatttcctgattctgagattaggataggacttttttttttttttcattatctcttcataaaggtactggcaatagtggttgaaaaaccatgtggcaacagacattgaggcaaatttctataaaaccagaaatagctgggaaagcggaagccaggttggacctgccaatagttggaattcttggctgtctgtagagggtgaattgacagccaaaagccctaccaaggtccaaatctctcttccacccatttcagttcaatctgatcaatactttttattgagctaataaccagaagtaggccctgaggattcactgatcacaagggtagagattatccctgcctttacggagctcacagtacagtgagcacctaaacagtgctagactccaattgcctacttatttttctgagtgcagtaagagaaggacatagtaggggcatccattttgaccttgggggaagggaggtaggagtgggggaaggtcaaagagctgagatcccaaaacatgagtaagagttacccagtaaaggagcagtacaaaaggctgcaggtgaaggagtattcctgacaaagggaaggctttgtgtgagggcttggcggtgagagagagagaaacacatggtggaaaaacagcacgaaattcagtttgcctgaagcacagggtctggggggcatcaagaagagctttgtaaactttgaagagatttgatttttttcccctgggcagtgggaagtcatttcaggtttctgggcatggagtaggcattcagactggggatcccaagtcccatatgatatttaacggagctttattctaaacaaataaggcttcagggatctccattctgggtagatccacctttccaacctttccccccacatatttgttgattcacaattagccacagtgcttgatcgggctctagaaccagagtcccttttataatgttttcaggttttagtctgtggttgaaggccactgttcagtatgtatatttgtgcacctgtgtgctgggcccacatcggaggcccagtacatactggcctcgtcgtttttttttttgtttttttttttaacttaatcacatcggtaatcgccccggggcctcctccgttttttttttatgacagttcgctctgaatttaatgtttgtctggatctgcttttacctttcctgcacatgatttgagctatggtttgctcttctcttgtcgatctgatcccatgtgttttccatcttcagggaattcctcaaattctagtacacagaggcaccctcctgttacccagtctctgttaatggtgttacagttagctctcattcaggcaatggagattagcttatcttaatgtttctcaaggctttttatttttcattattgctcccctaaggagcctttctggacatttttcctaattgtaggacattttaataccatgacattttaataccagagatatactatttatgtgttgtacctatatctgtcctttatatagaacaaggataagtataaggcctacttactctttttataacatgaaggattaagaatgactaacgtttgcagttaacaattaagttaaaaattaaaaagctattaacaattaactttgtgtgtatttgctgagtacattttaatttaatttatttacttaaaaattccagtgtatcaactacatataaaaattaacaatttatataaatttgtaatatttaatagcaaggtgcttcaatgtttaaaaaattcatccaaatctgctctttttccggcgaaagtaaagtaattgaaaaaattaaattagcttcttaaaaaattttactgaacttaacatttaactactgcttgatatgggaaaataacttctaatttaactagctgctagacagtcattcagatcttgctaacagtttttctttatatttgacataattaataatgggctgaataatgttattagaattaaatgataacatataaactgaagatcaaatataaaccacattgacaaggcagccagtggcagccacctctgccatttaacttttagaatgggcgatcaatggagagaaagtttccaatcacagtcatctattcaccgtagttttctagtactgatctggcacacattttgtatgtctactatgaagtcaaggtcagtgttactagtatgatacccaagaaaacacaacaggagaaattaaataacaagctgtaagattttgttgggtaaggttgagctctcgagagccaaaaaccattgtaatatgtaagttttttttttttcttccctcccaaagaaccaacttcaaccctttggagactgtattgaccctttgagaatgcgtggcttatctgattgtgtcctcttaggagtcttaacttcctaacatacggggcccaggagagctaagtattaaaaggatatggacagagtatgagaaaagattcagtcatgagacattgctgtgggtgtagcaccctttgtgggccgctgaaacaagtggcctaggctactagcatgaggttactacagtaatggagtcaaagcagaattaggggctgctccttggagttcttgtatctcttaggttcactgcatctcagtgcttatcatacaatgagtagttggtattttataagttgtctggtctatcagctctgtgcaggcattggctgtttctatcttgttcctattgccagttatctagcacagtgcctggcacatagaaagggctcagtaaatatttgttgataggatagagagaaggcactgcaggtggactcagcctacttcacaggctagatgagggctagatacaataacaggaaaaagaagattcactatttgaaaagaatcccaagccaccacctccaaacaaagccttctctttaacaccacctcatctctttgagcaccagggagggagtcattgtggataggtgggtttgaccatttgccatttagatagcaaagcagttttaatttgaaaagttttagtagtgtctttttaaaatgtgttagtcactactttggttttttaaagcaaatactgctgaatatattttatcttttgttggcaacctagaatcttcctaataagtatcagttcttgaggtacggggatcactttatcctgcaacaaatggtctgagaccaagaactttttgagttcttgggctggagtttctgagtttttctgtcttcttccctggcaggctagcagctatcactttgagttgttgttagaggcctactggtagcacttgctcactgtcctccctctcatttggtagttctaggatattcagatggagagaattagccaaccctgtaaaaactttgtgtaaagtaggagaatggaagttcctagtgaggagttgaggagttctcctgtaaataacaatttctgaaactttgtgtgtaggtgtgggtgtgggtgtgtgcaattgtgcacctctacagaatctgttttgcccttcttcccattatcacctgagttctggatgggtgacatgcactgataggttttgtgctggataagcaagtgattagtatcatattttctcagaagagtttatggagagtatgtacatgaagtttatttttgtcttaatggactgtccaagattcctttaatgggggctcacctttaaataagagaccacagatttccaattaatagaaaaagtaacctatggggatctaggttgttttgtacattgtggactggtacctgctcaaataatcttattcagtagcactatccaacagtgttatcaagaagtgctaattaacttttggttggggaaatgtaattacttgaatgggaattttgacccagatacttacctgttattctcaggacattctaaacttaaacacagttttctttcaccaaacacactttagtaagagataatatcagtagctcttataagtgtgaacagtaccaattttcagcatatgtgaagattaggttcctatgtacatttaacaaagtatttccaatgtaacatggcatgtggcctccctttgatgtcaattccatatttctgattttaaatccttaatctaatgtattgcaatagtacatattatgtgcacaggtctagaaatggaaaacctttgaaatggtgcaaattaatgatgtgttaagtatcacaatttgaataaagcagtgtgaatatcttgaaagaataaagggagagtaaagaatagaagaaaaacagggagggaaaaggaattctcaagggaaataatagggttgtgtaaatacttcaccaaatcgccaagactgacagcagaaaaggtcaaggtcattttaaaattgcaggagactcagttcaagttgcctttgagaagtaatgatgttttgagcaactcaaaactgaatttaagatttggtattgggggcaaaaggggatcacagaaggactccaggcctgctacctcattgtctgacaaattcctatgttctgggtctggggtcaggaccctgcccatcctgcccccattattgtcaccatatttcccaggcatccaagcctctgtgagctggtagggtttgttatgcacttacagcaaaactgacattaggagcacactcagtacagctaacagatcaagtgcaggttcctaaatgtgggcttgttgaacatccctggcctttcagtgttaaagatggacatagaatatttacttgtatctgttttttcatgaaggcttttgatactttgccatgatatttcatgtttttccttttttttttttttttttttaaaccaatggctgctacctggcattagaaagccaaatcacattatagcattttggatcagagctagttgtgaaggcatttttagagtagtttttttcagtcattctttcccttttattcattttaaaaagctggcctttatgatttattatgtaggctgcacacaacaaacattccctcactgggatattctatactcatcactgagaaattttagcaataaattatattccctaagtgtaaggaagcaattcctgggtagtgtatgaagttctactctgaataggcaggtgtgtgttctgtatggcactgcccatgtgggtgtggagtgaggaaacaggaaaaaatgaaggcagagcagtcacgggaggagggcaatggctgagaaggaaaacagttatcatccacttctgtctctcattttccttccagttgctcctacttggttggtaagtgtctaagtacaaagccctccataagcccaggttatcctcctgggaaaggggcctctgctactcttctacctttgtagaaagaaaggaggatgttcacatgagcctgtcacttactgtgtaccttcacacatgctctgtatactgtgctgagtggtgatacatccaccaaaattcatgtctacccagaatttcagaatgttgccttatttggaatagggtttttgtttgtttgtttgtttttgtttttgtttttgcagatgcattaccttcaatggcaaaaaaaaaaaacccagagttacttttgcaagaacctagtaatcaaattaatacaaggtcatacttaattaggatcaaccctaaatccaatcagtggtgtctttataaggagaaagagatttggagacgcacggagacataccaggccatatgaagacgagggcagagattgaaatgatgcagctactagccaaggaagcatgtctctgttgacaacttgatttcagacttctagcctccagatctgtgagggaatgcattcctgttgttttcagacatccagtttgcgattttgttatggcagccctaggaaaataatacactctgttgataaggacttatggcaaccctgacaggtggatactcttagatgccttttatgtctgaaggtcttactgaggaagctgagtcttactgaggaagtcctgcttcccttgcagcacaggtatgtggtaagaacctgtgatgggcttggtgctttaaggattataggtggcttaagtgtaggccttgctatcagcaagctccctgcagatgtgtgtggtggggagatggaacacggaggaaatcgacttttccaataggccctgtagcactaggctgcttgccctaggctgtcttcatctgctcatagacttttggatccctttttttttttttaacttgtttttaaattttttatttccatagatttttgggaaacaggtggtatttagttacacaagtaagttctttatttttattatattttattattattatactttaagttctagggtacatgtgcacaatgtgcaggtttgttacatatgtatacatgtgccatgttgatgtgctatacccattaacttgtcatttacattaggtatatctcctaatgctatccctcctccctcccccaccccacgacaggccccggtgtgtgatgttccccaccgtgtgtccaagtgttcttattgttcaattcccacctatgagtgagaacatgcggtgtttagttttctgtccttgagatagtttgctcagaatgatggtttccagcttcatccatgtccctacaaaggacatgaactcatccttttttatggctgcatagtattccatggggtatatgtgccacattttcttaatccagtctatcattggtggacatttgggttggttccaagtctttgctattgtgagtagtgccgctataaacatacatgtgtatgtgtatttatagcagcatgatttatagtcctttgggtatatgcccagtaatgggattgcagggtcaagtggtatttctagttctagatccttgaggaattgccacactgtcttccacaatggttaactagtttacagtcccaccaacagtgtaaaagtgttcctatttctccacatcctctccagcacctgctgtttcctgactttttaatgatcgccatgctaactggtgtgagatggtatctcattgtggttttgatttgcatttctctgatggccggtgatgatgagcattttttcatgtgtcttttggctgcataaatgtcttcttttgagaagtgtctgttcatatcctttgtccactttttgatggggttgtttgattttttcttgtaaatttgtttaagttctttgtagattctggatattagccctttgtcagatgggtagattgcaaaaattttctcccattctgtaggttgcctgttcactctgatggtagtttcttttgctgtgcagaagctctttagtttaattagatctcatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaaaggttggatcccttttttagtgtcttttcttgattcaaagaagattaacaggagacaagtcaatctgaggaaattcagatagaaatgtgcccccgctgctctcacctgattccttcctgacccactaaagttgaagaaacaatagcttaattttcctggaagagggtgttgggatctaggaaagctttttagggatgatgacatttgaggtagattttgaggaatttatccagttggagaggagggaaggtggagagtggaggcattggtggggaaaggattttaggtagaggaagggatgagaggaaaggtgcagaaagggaccggtgctggtgggtctggggcaccactgttagtaacacacagttggagtgtaagttttatggcttgaaggggagtagaggcagagggggaagaaagggaggttgacgtcatgatgaacagcatttttgaagcttttttctcctatttttaaatagctttattgaactaattgacatatgacaaatagcatatacttaaaatatacaattttataagttttgacatatgtatataccatgaaaccatcaccacaatcaaggtaatgaaaacatccatcactctcaaaagtatacttgttcgtttttgctatccctctctcccagcctctctgatttgatgcccatttgatttgatgctgatttgattcctcctcactagagtccctttgagggggtctgcaaaatcctgcctcttctaattacatatctgtgtaatactggagtttcttcatgtacctcagctaaaacaaactaccataacaaatcagatgcagaaacaaacataagaatccagctgtcctccattaacccagacattaaagagatttgcaaaaatacaaaaccgtgttgttttgacctacatttttggttgttttgaaaaatatggttatgtttcataaaactttagttatttttcttaaaaatatgttacttatgttaccatgtaattatattatttatatgaacatgttgttggtttattattgtgaatttcaagggaattgatacctgaatatttaaaaattttttgtttttatttataattcaatatatattgacagatgtagctcacaaaatataaggtctttggagtactgtttttttcccccaagaaatcaccctttttttctctgccacatctcaattatttttaagattctgagatcgaaaagcttgatgatcgttgctctagaggctttggtaacatgctaacatttgtggaatttctttccttaactaatggggacctgttgaagatcttttcagcagaggaatgaggggatctgacttgcttttagaaggaggactttggcagtataaggatgggggaagactgggcagggagaccaggaaggagaccattgcaggagtccaggcaaggcagaatgagtgcctgactgcagtgcatgtcaggggggtcttctggagaaagtgatatggcttgaggaataatcaggacaggaggtacaatctcagggctttgtttctcataggatgtgaatgtgaactggcttccccaaaaggggagtgtctcaggcagtggttaagagagaagcaacttcttgtctccagggtttctggcttgggttgtggtagaacaccatcagagtagaggaaaagggttggcaagggctgggctgaacttaaggtcagagttcttttcacacaggccaggagggggttcaggcttccctgctcaatgggcactcaatgcatagagtgagactgtggtgagggttacagctcagtgagtacgccatcccaggcctgaggctagcagtgccagtgagaacaggaagggagagaaggaggggagtgctgcaccctgccagggctacctttccttggctttggtgtgtgtgggcttcagcttgcatgttggtggtctgcagagctggccactgggaagggaagtgaactaacagaaatttgggggtggcaggtgcatattagggtagcaagaagagaaaggcagtcatttgggcctggaaccatactagaaggcagttaggagactggagagtttgatttatgtgatcagctagtatgtaggtccactgtgcatggaagtcccttgggactagattttgatgcatccccaatctgtgctcaaaggctccagcaatgccctagtggagtctggttggagcccaccttggagggaagcagtcttcatcacctaaaacagcagcgccttatttaggttagtttgtcttcaagtccagagaacattttgggggacaagcaggtccaaaatgggatgaatgggggacatcttccctaattgaacagtgagagcgcatccacagcgtggggaagacagacaacacagagtgtactgaagtacttccttttgaactttgttaaacctccgctaatttgaatactagtaatccaaataatgtccattcggataaaaccagggctataatatttacttttgtaattatgttatatatttgttaacatttaacatttagtcaggcctgtgttgcggttgctgtgtggaagcttatcagtttttgcaaagtgtggaacacctgtaaatgatgataggcaccttgttgatgactgtgaagcactggggctcttccagactactaggactattaccataggcatgagtaatatggaatcagtaacccagattaccacataaatatccaaacacaaatgagcttagagacttctggctcccctttcaacatctttatagcctgattttcagaggcaggatatttcccactggtttttattctcatgagtaccttgcattgcttatcctggttatcaaacttagggcatatatagtgttcacagtgctaagccctatctttgacagtgtgctgttataacattttattttgtatggccttagatgattctccaaatgctgagtcttttcattaaaaagtctatcaggacctctacttgcaaatatttctttttgtgatatgtggatgatgacatatcaaccatccaagatggtgctggatttgaacctttttctaatagcagtgggaagtcattaaaggattttaagcctagggtaacatgattcaattttcagttacatgcgatatgtggatgatgacaaccaccaccaccacaatgaaagtaagaaaaaactgatcagtgctttttctgttcttttcttatgttattgcatttaattctcacaacaacttttgagacaggcattaattttactcttctacagatgaggaggaaaccaaggctccaagaaataacaccacttgccaaagtcatatggcttgaaagtgaccaagccaggaattgaattcaggcaggctggtggcctttcttaaccattacattgtacccagaaattgaaaaccactttttcccccaaactgttaagaattagagagatttggtactctgccagtactacttactggcagattttgaaaagccgtgtacttaattaaagttttcctgaagagagtactttgctattctctgaaagtttacaccttccctatttttattgtctgtgatgatgccatttatgtttttatgtggtggtatttttatctttttctttctgttagctgtcatttttacctatagaacctgtggccaattatctgtgccattttctcacttgacaactaaaatattgacaataaacatcagtcattgcttgcagcttagaaaaaaatgcagtgagacacatttatcataactgagttttggaaactagctgtctttatattcaggtgacagacacacttgtaaacaactgatgtttacagcaccaacttagatctcacaggaggaatggggtttttttcacttgcctatgtattcttcaggcagaatgtgtaccttaagtgtttgagcccggcaatgtcttcagtctgcctgagctccaaggttctctttttcggcttcttaggctaatcagtgtgtgggtcctagggcacacaaaacccatgacattactactttcatagatgttaatgtgatctgagctgtattataaggcacttgcccttagcagttagttaagaaatattcactgagtacctattatgtgcctactggaaaccagagtattgaatagaatatatatggtctccatgttaatggtttattcagagaaacagaacattgaagaactaaatatacataagttaataagagaagtaggaagaaactgcaaaggagatgtacaaacctgacggacttttccaggaaattgacttttcagctgggatggaagaatgtggaggggtcattatatgatgagaagggaggagagctttgcggttagagggaccagcatgtgtgaaggcttatcagtagaataaacaataccatgatagagaaacagagaaattcagcagggctggagcagacagagtgagtggagggtggataagacggtgctggatttgaacctttttctaacagcagtgggaagtcattaaaggattttaaacctagggtgacatgattcaattttcagttacattttgaaaaggtcaatgcagttactattcatttcacaggtaattattgaacatttactacattccaggcattgtcctcggctctgagggataagccaaataataaaatagacagtgaattccttgcttttgtggattttatattctagtggagtggagtttggagatagtaaagaaaccaacaagtagaacatatcacatggtgaggagtgctatgaaagcagcaaaggtccaagagtgtgcccttggggaaagggtgccaattgtgtgtgtgtgtgtgtgtgtgtgtgtgtgtacactcttatctatctatctatctatctatctatctatctatctatctatctatcatctatctagtggtgaggaaagacctcgaggaaaagctggcatttcagcaaaggcctggtggaagtgagagattgaccatgaaggaaaagagctttacaggcagagagaagagcagacacaaggcccttaggagaaaggagaattggcgtattcaaggcccagcaacaaggccaatgtgacagaaatggagtgagcaaggaaatgcggtggaagatgacatctctgagatagtagggacccagatcatggagagcattgttagccagtgtaaggattttagttttcatgttgagtgagatgggaagacattgggggaatgataaaatgcacatgaagtgttaaaaggattgatctgattgctgccccatctcccctcccccatactgcctggatgctccgttgaaatagaccctaagggacaaagtggaagcaaggaaatgatgacttggaccaggggcttcttgtaaaggtggtaagatggaatgacttactacagaacacatttgaaggagggtgagaatagaagcagggagcagcctgttgcagtagatacattaggagactggaagaaagctgatggtgttctggaaatgaatatgggcctggagatggagaggtgtgggaatatcagatagttagttagaacacagagctgacccacaggactttgccgatgggtagcatgtcaggaatgagggtgagggaggagtcaaggatgacttctgggtgtctggctggagcactggggtgatgtcatttattgggaccactaggcacatactagtttggtggtgaggtgagtgaatgactccactttgaactgggtttgatttggaaattcctatgaaatgtgaaaggggagaaacagagtagatcattggatatatgagtctggatttcagatgtttgacccaggctggagatgtagatttaaaggttaatgaggaggaagatatgaatgggaaatgaagtcctggattatggatgatcttgttgaagagtagagtgagaggagaaaaagatatgaactaagttgagtaacacctcttttaaaggttgagaggagtagaatcagtaagagacatagaaacagaatatttaaagacatagaaggaaaatcaagagggcatgcttcagacaagccatgtatagggtgtttcaaatagtaattgtcaatagcaatcaccatactctcttgcctctgtgcctttgtacgcatttttctcagtacctagacttcccttctacccttctctgtgtttttctcttacggtatgctttatttttcctttcatgcctagcaactagtatattgcttagcatgtagttctaagtaggtatttgttgagtaaatgaatggatgaatctataatggacccataaagatgacaggtcttactacatttaggttacctttttctttaaggtatatttgaatcattttaagataagtagaacaaataaattttccccgctttcaatccatcaccattgtgcaatcctgaaagcttgaacattcttggtacctttaactggatgccttcctttgtgtagtctcctttttaagcctgtaaggaatttaacactttgtttaatagacttctttaaaaatatgctcatgttttgttggactttgagtgatctgttaattcccaggtaagcatttctgtgtgcacatgaagatgcataactcatacctatttttgtggactcttgggcatttcatacagttctctgcagatagtaaggcactcaatacgtctttgcctaactagcttagcagtgtagtgatgggtttatattaattaataacaggtcgggcatggtggctcgtgcctctattcccagcactttgggagactgaggcaggcagatcgtttgaggtcaggagttcgagaccagcctgaccaacatggtgaaaccacgtctttagtaaaaatacaaaaaaattagccagtcatggtggtgcccacctgcaatctcagttactttgggaggctgaggcaggagaatagcttggatccgggagaaggaggttgcagtgagccgacattgcaccactgcactccagcctaggcaacagagtgagactcttatctcaaaaaaaaaaaaaaaaaaaagataaataacaagtgtgagctggtatagacaaactggtttagaatcaaaagacctgggtcagagtccacgctgtgtctcgtacagattgtgtgatattggcaagtcattggacatccttgaacctcagtttcctcaaatcagaagtgagaatcattttaaaaaggttgccaggaggatcagatatgaaagtgctttgtaaactggaaatccttcctctgtggtagggaagcttgccattgaaaacccatccaagcattctgaggcctggggtacatgatctgtacccagtctatgctgttgtttcccctgtactgtgtgtctgtaagatatgggtgtattattaagtgagctctggtggctgccttaagccctctgtgtacttgggtctctgtggatggagttgttcatgtgaaaataactgatgggctgtaggtcacagacctgctctttgagcctagtgtggacctgcaatgagcagactttttgtccttggtgcagaaatagcctctgacttgggagagaggggcagagtggccaaatcctgctgtcttacttcttcaattggtttctataatagcttctctaaggtagggagtgctatggttaagaacttgggctttgtagtaaagcagaagtgggtttgaatcccactgctagcacatatttggtgtttgggcttgagaaagttacttggttcctctaaccttccgttttaccatctgtaatttggggataataagaatatctacctcacagggctattttgaggaataaatgagtgaagcatgtaatatgcttagcatagttcctggtgtacccagtaagtgcttcataaatggtgtgtactattgttattattgtttatgatgattccagtgggtcctttcaactttgcattgacaaaggatagtccctagtcaatcataggatatgggaacaacggaaattccactttttaaccattactctggactctgtctgcaaagatgatgattggatcttgttcatttctgcattctcagggctgaggctagtgcattggccagtgagcaggcactgaatacagggcagagaacttgaactggccgtgtgaccattgcttcacggtgatctaaaatgctttccctaaacatacacacaacacctaactcattagatgagttgttgaagtgggtttagcctgctgttgcagtctcaaaactccatcagtgggtgccagagttgacacaatcaaaatatttcttgaggaaagaataattagcaaaagtgagtgttcctcaattagggcctgagggttctggtgctttgattatttccaactactcatcactaggctggatcccaagtggaatacttgggtgggcttctgtgtgcttagccctaatgagtgtggcagtacatctggtacatgcctgagttctaagtggtgaagaagtctgtaacttagcaattgcacagttaagtagctgcctctggagagtggatggaatcaagaaaagggcccagaaatctctgcataaggtactgcaagaatgcctcttgagaacttttggaaatttggttggtatgtgttctacaagttcagttgcttgtttgtgtgtttgcctaaccatgcagtttctgctgccttgttttacttatatgctgcttatataatccccctgaataggcaattgtggtaaagtgtaaaaggcgtgagatctagattaggcagctaaaatatcaaatcatagccctgtttaattgactgtgattctgggcatgttgtttagcctctctgagcttgtttctgtctgttaacaattagaataataatgcttatgttccagtgtgattgtgaaaagtcatgggataacataggtgaatgacctatctaaatgtctggcagtctcaggcttaatactaggtgtaatggattgtgcagaaaagagttagcagagtaggcctgactgctatctgttgacatggttgggccttggctggcatctgggaattcgtctttcaggagggtttccaccattctttaattgataaagtgtctcttggtgcctaagccatttgtacaaacactgtcatttttaccaaacacctgctttcctctggggtttttgacattttggtatgtgcttggcagaaagtgtctacatgaccaactctctccaaaaacccttggcactgagtctaatgagcttccctagtagatgacatttcccatgtgttgtcacaacttgttgctgtgagaatttagcatgttttacgtgactttactgggagaggactcttggaggctctcacctggttcttcctggactttacctcatgtgctttttccctaggctggttttgctttgtatccttttgttgtaataaattatagttgtgagtgcaacaatttgttaaatccactgagtcttcctagcagattattgaacctgggcttgatcttgagaacctaacacattgatacagatttaaatgtagaacacatgtgttgcccttcagaacactcacactttactgcaaaggcatacagagtcatataatggactttagagactcagaacggggagggtgggggggcagggataaataactatacattagttacagtgtacactactcaggtgacaggtgcactaatatctcagaattcaccactatagaattcatccacgtaaccaaaagccacgtgtacaccaaaagctatttaaataaaaaaatatattgaaaaaacaacactcatacttcagatagaaagcccaacatgtaagcatataattacaatacaatgagtgatgttagtgcagagggcaagggtagccctgaagagtagccctggggatctgggagaggtttttggaagagttaacacttgttaaatcttgaaaggtaattagaagttaactatctgaagtgggaagaaaagagattatatacctttaaagtataacatgctcttctaaataattttagatttaactcaccgctttcttttttttagcattatttaattttattttgaaattttgacatgatgaaggacgtgataggactgatgaagacgtacagagacagaacccccatagggtggcagttgagtggatcactgtgcagatatgaaagtggaagtaaaaacaattctttgagcccccaaatattaggaattggcagtgatgcttttagcacctccatatactatcagtcattttaaacatctaagactcccattgcagaaacatggcacatagagtcaggaaactaaggttgtatagatatttgcaatctgtaactgtcctagtgtcaagcacaagaaattcagtaggtgcctcacataaccaagcactgatcattgataccaagaccagatatgtgatctaaattagcaaagacacactccatgctgctttgaaaagaattaccatagatattatgcttttacatgatcatctctttcagcaacaccaaattgctctatcacccttcaattcagatctccgcagtaaaatgtttttaaagcaatttgcagcatttcactttctgtggaccacaccctgcctggacagtcacttttacaatcatcactttcttatggagctaaacaggtgaggatcagccccaggatactagaatcttgaacaaatggatatatagccactctaaaattgcaggtaggctctttcactcccactaatacctacaagacattgcaaatagaaaggacagcaggactggccaaatctatctttggctttctaaagtcagtctcactgtgcactgctctctaccagagtaagactcaaggataaatgattttagtgaattaaagagtttttaaaaataaagtaatgaattaacaatttaaaaagaatgaatgagcagttttttttttctgccattcatctgagctcctgtgaaatagttccaatcaaggttctgcccagttaaaaggaggaagagacctcagaagttgtcttgacaggccggttgcagtggcttacacgtgtaatcccagtactttgggaggctgaggtgggaggatcacctgagatcaggagtttgagaccagccgggacaacatggcaaagccccatctctacaacaatacaaaaattagccaggcatgaggatgggtgcctgtaatcccagctactggggaggctgaggcaggagaactgtttgaacccgggaggcagaggttgcaactcactgctttctttacaagggtttaatgactctatgtttaatcattcatcaaacacgggttgagaactatgccttaaactactctacgttgtgtatcgggctccaataatgaacaggaatggtccctgctttcaaggagagtctggcagtttatgggttgacatggttggattttgaggaaaccatgatgcaaggtgatgcaagggacggggtgtaaggtaaagcattctgtgagagatgctatctaggcttaaggggaggtaactttctaccagcacaggagaaaggcgttccatgaagaggaaacagcatgtgcaaagtcccactggcaagagagacctgatttcttctgagaataataaatagttatgtggatctgcagaatggcagatgaaggggatttaaacaggtgctatattttgacaggtagtaaaatcaagcttgaggaaacagatgaaaggattaaatgagctgtattgaggaatgggaaagaaattggattaggacacatagtattagtacacaataatgttgttgagcatggttgaagacccaagtgaggttggacaatataactagtagtgccaggccatatgattccatgacatatgttctgccatgttgatctggagttagggggttgccaggtgggaaaaatggaaagaagaggcaaagttgttaagaatattcgtaaaataattattgaagtcagggaccatggtatccaagatggaagacaagtgtggcctgatcgatagacttaatggagacttcatagcctcctgactcttctagtttctaagttccagaagagtgagaataaaaggccgaggaaactagtgctcagaaagtaggctgcttcaatttaagatttcagagttgaactgttccaggtgagaacaaactctagtggtcaaagtgggtatgtaaaggtaaatatctttggagatgaagagagcaaggaactcagaggccggaagttggatatgttgtccacatgtgtgttgaagtcacctggggtgaaggtggggcttgtggccaagaggaaacttgggagtcaggtaccacagcccccagtgaatatgagaaggtgcctgtgaggcctaaggtgacagtgatgaggagagagagagagcactataattgcatagttgtgaacctcaaaggagaaaagatacatttcttacaatatgaagccattcttcttcctttgctatgttaagtggagtttgacttgggacagtctatgctttggcctttggatgtataccctttgaaatctgtacaacaaccaccaggacattcctctcactcctttcccctcatcttgggcgtttctcaccagtcttctggtgagaatttttttttttttttttttcacgtggtcccagcttgagtttactgagcctcctccaggctcagatatgtgcttgcctggagaaactgcttccaaaggccaagcagccctgcctttggagagctgcttttgttacttacaatagtgtttcccagagtgcattccatgaaaatattagtctttcaacatgctgaacaatgaaagaatccatggtcaaatcctgagaacatatgtccctcttttagagattcataaggtacattagtatataaagaacctaagagattttgcagtaagaaatcctttgtgtaacctagcattacccaaatgtattttaccactgaagccttttttcccacttactctccatcaatacccagtggatatacattggaaagtgctggtcaattataagaaaagaagtatgtggattttatttcccttgacctatggccatagaagaggtacatattgcaacactggtgtattttcactctactaaaatgagatcttactatgttcctgagtttaaatagcaagaattactacatttggttagaattaacacattaaaatagtttgtttagtctgtcattcttatgtttaagtggcaatattaggaaattaactaagagcatttcattttcctttggaagaattcccatagtcaagattagaatcttaaaatgaaaatatacatttttcaaagtcctcttgctcttattttaattaaaaatgacagcatagatttcaaactaatcacattatttgctcttaaggtagtgataagatttcttcacagatgtgtgcatatcattcataaaaatgacatacttggacttagatacatactttgtaaatgttaaaagacaaaagtactaagaaagcattttgtgaaactacaataaaatgagaaaaaattaagggaaattaccaacatgctctcttacataacaccttgattttgatagaagtgcagatcctaataacctagacattttaaaaagcaaaacaagcataaatatgaacataacaaaatagtgttgtatgttgccaaagtggtgcttggaggaagatacattactctagatgtttatgtcttaaagaaaggaaggccaaatataatgaattaagcttgcacctagatgctttctaataggaagaatgtcagaagccagaaatggtgggcagaggaagtagtaaacgtaaaaccagaaataaactagagaaaaagctattaaatactacatcttgtctttgaaaaaaatgaacaactgtttagctaactaaaaaaagagaaaacacaaattcattacattagtactgagacaggagatcagatgatgaatgtgaaagatttagaaatttgcagagaaacaataaccttctgtatgtgctaataaatcagatgaaccagagcagaaatgaatgacctcctgcaaaattatataaaactcgtgcaagcttaaacagaaaacatgaatagactggtagcaaaggaaggaataagaaaaataattaaagtcctatcataaaatccacacaaaccatgggtttttggctccaatagattaatagaaagaattcagacttctagagcaacgttgatcttttttatttttattttttgagacagggtcatgctctgtcacccaggctggagtgcactggcatgattatggctcaccgcagtcttgatctcctgggctcaaacagtcctcctacttcagcctcctgagtagctgggaatacaggcatatgccaccatgctcagctaatttttaaaattttctgtagagacagggtctccctatattgccccagttggtcttgaactcctggtctcaagagatcctccaatctcggcctcccgaagtgtgtgagccactgcacctagctctgttcatcatttttgactgcctactgtaaatttaatcctttgcacacacacacacacacacacacacacacacacacacacacccctctatattctaatccatacaacaattatatatgggtaccattagtaaaaccagtttacagctgatctaataggctcagaaaggttaaatggcttgcctgaatccctcagcaaataagtgatagagtggggatttgaacccagatttatctggctacaaagtttattatcttttcctatgctatactttctaccagaataaaaaaattctctcataaactgtttttaaatgttgaattgacactagtttacccaattcctaatttacattttgaggaaacatgatttcaatcctcaaattgggaaaaagtacaaaaaaaaagaaaattataggccaaccttatttatggatattcattcttcattaagaattataaatagaaaaatcattccacttacaaatttatctttaagtggcatttaatctaggagcacaggatacgatgataaaacaaaaattatgataatcatattaatacgaaaacgtaattaaaataatatttttaaatagatgttgaaaaagcatccaataaatgaaacaactattcttggataatttatttggcaacccaaaaacgagtatgattttcatatattttggtataaaatctaacactatttcatggggaaaagagaaagtccctatgaaaatagaaaaaattacagatgacaaaaataggactaaggctctaccattttttaacagtatagtagaaatttgagccataggcattaataaggaaaaagtaatgccatcagcaaagaaagccaaacctttcttaataggtctagcacctaccgtatgccaggcattgtgataggtactggggatacactccagaaagactgtgcatgtctaggacacagaagactatcaaatattagttggtataaatgagctcagcaatgtcatgtaattcaaagcaaattaacacatgtttttagttgcaaacaattgaagaatatagtgagtaagataattcatttgcaatggagacagaatacattaaatactttggcattaatttaatttgggacatgagatttatttaaataaaattatacaatcataatgggaagaataaaagacattaaataaatgaatggagagatgccttgttccagatgaaaagacaaaatataagaaagatgcaatattccctgagttaatatatagtgtcactacatgccaattaaagtcccagtgggttattttataagatgtgacaaattgctagcaaaatttgtatagaagaataaggaggcagaaatactaaatagtttaaaaattgttcatttgaagttatacttctgtcacatatttgttcaatcttttgttagttccttgttccctattcattcagttcttactactgtccccgcttcataaaaggtactccataaatattggttgaaagcagaaaggaatccttattgaaggactttgaaaatgggcttgagacggacaagtggctttctccgaaatgtcagagaatcgataaggtggaacatcagggacttgccctcattttaaacaaataaggcaggagtggtcacagtgagaaaggaagagactgttcctgggtctagtagtgtgtctgctgacattttcaagcaaataaaggatctgcctcctagccctctgcctggactttttctcagcatgtgtttgtgttacagatagggccatcatgacacttgggagctcgaactcatcattatcttcataaagaaatgtgagaattttgaacttgggccccagtctggtatctcctagctttcttttgctgctttgggtcttttcagacgcaagagatctgtcatcttttggggcctgtctctaatatgcaatctttctcaagtgccccttacaaaaaatgcctcttcctcctctgcacttatgcatgcagtagtttatttgttctacaaagggcctaaagaaggccatgctaacaagggtgggatttaggctgtcttctccctgttctccactgcatcagtttctgagctgggctggttatcagaatcacttgaggagccttaaaatacacatattcttgaccctggtgattcagatttagtagaactgaaagtgtaatatgtgatgaatatatcatatgatattataaattacattatattaaatatttcattatattattacatattatattaattacataaattacacacacacacatgtgtgtgtgtgtgtgtgtgtgtgtgtatgtgtgtatgtatgtgtatgtgtgtgtgtatatttccctgattattttgctgaagaaccaggtttgggaagaatgcctccatagcatcagccagagtagctgcacagaggagctcccccctcccccaccaccacatttattgaatgaagggattaaattaggaacaatgttcagactgattatagtgttgctatgccaaccgttgttgcaggtgctgaaatagactgcagaaggtctagtaaacacttaaaatgaaatggtccctgaccagcattgtcattattataactaatatttatagataattatttactagtttccattagaatgttaataccagagagcaccactctatctcctattgactgattagcacagtgcctcacacatagtaggcactcaaccatttatttaatgaacgaatgcaacgttttcattaattttcacaatgacattataaggtgggcaattttcatattatcatttcataaatgaggaagtcgaagcagactgacttgttcaaggtcatacagctagtgagcagttgacctgcagttttactccatgtctttgtcatgctaaagcagaggctatataggagaaagagcctttggactccattgactaggcagaggccagaccaggaagggcatggatgtagacagcaggcaccccagacaggatggcacaagcactggggagaacaattagcctcaaggtcttggaaaaaattcagagtatgagatccagagaaccaagtgggcctaggggattgtggtagtatataatgattggtgtcgtagttactgccgagagtatgcattctaggcctttagagattaggaaagaataagataggtatccaggcctttaggaactgggaaacagacagctttggacacagaaacaaaacaagaaacaagttactgggtttggaagatgaggcagggatctcactctaaggaagaaggataatcccggtaatgagaactagagtccaggaccagggcagcacctgcatccctggtcctgagcgtgatcctggtactgatgctgtttcttaagctcttgagtttcttaagcttctgggcaaattgttttccccatttgagcatagtccaggattcaggcttaggtagaataatgcctatgagtcctggctaaggaacatcagaagtggaaagagaggcagactcatgcagtgaaccaagaacctcccttaaactcaaaggagggtgaggttctaaagcgacatcagcctgttttcctagtgatgggatgtggttttgactcctggtatgccaggggttggtgggataatgattataagtatactcttaacccttgtattggcttacttgcccctgaaaggtggtcatatgtcaaagttaccaacatctgctcaagcacaatttcctaagtatgtgctgaaaaataagttaaggggtatttggcatgtcattctccttagcccttgtgactgccaagagtgctggccctgagttgcctgtggtggccagcagcctcagctgtttcccccagcatgccatgtacgattggcatgctgtactaagtgccatacatgaaaaaagttgggaaacattactggagccccattccttgttggcctcttcattactacactacaatgtcctcttccatttgtacaacaccagagtggtggttgtcaacccctttcctgcctcagacctttgagacacactaatccgccacaggtaaagatacctcacccagctctcattctcaagaggtgaagaccttgttctagatcttcccagggctggatatagttggagaaagtactccaggtggctctgaaaaaccttcttgtggaagggggtcatgctcctatctattgagaatcacacatcttagatggaagaacattttcactcctatgatcgcctcccttcctctgaccaggtggtgatatcatctccaaattgtgaataaggaaggtgaggcctaagttgctcaaggttctcacagtaagaaagtggaggaacctgtagtaacacctgggtatggtgctttttttctgcggcactgcaccctccattcctagtactaagattaatacctaagaagaaaatgatcaagtgaaaagccaaggtccatagccatgctagtagatggtgagtgaagtagtacctaagacacattggttgtggtgtcgcgagttggggattggccaaagttgggtgtggtgagctgaaatgaaggaggtaagccctttggacaggcaagaggacccagtggactgggatgtggctcagacaacagacccctggtgaagccattctcagagctgacatttgagtggagaaagatttggaaatagcttttgggcttgaggcttgcagggatgaaactgcccagcaggagcaggttgtactctcctgctgactttcttcagccacacctgtctactggagcacagctccctctagaggtcattattcttgccgacgggacatgactgtgacctcatctaagtgccaaggggattattgaatgctgactttgtgtgacattaaaaatacaggccagccaagcctgttcattgaagcaggatttatttggtaccattttccaggccatgccctgtgttctgggtactcagaatccacagatgaatgagccatcccacagagaagtcactgtcttgggtttcagacagatatttccagcccagtgtgattcgtactttgataggggcaggaactgagtgcaaagtggaggtggagaggaagggttagattcccgatttctttggagcactgacagggcaaaaggtctgggaaggtttcctaaaggaggggactcttgagctgaatttttaaaaatgagtaaggcttagccaagtagaaacaaaaggggaggacgttctatgggaagggtcagtgaacattttctgtaaagggccaaatagtaaatatgttaggctttgtgggccatacagtctctgttacaatgactcaactcggccttgtagtgcaaaaaccacaacagacaatatataaatacatgacctttactgttgtagccatggctgactgctgtcatgtaaagtataggtacatttatcatccctatttgactgtgaagaaatggagtctcacagcggtgaagtgacttgctgaaggccaaccagttgattgtgtgttaagcacctcatctgaacagatgaaacccaggcactggtagcaggggttgagggtgtacatgggatatggcatgtaggtgagctgcagtagatgggcatggactgagctgtgagaatctagaatggtcctagcactctggatctattttcaccctctatccttgtccgttccacctaccagactatccctttctaaggccttggctctgctgtagctgtgtgcttgtcagccatgaatcttcattcttactgtccccctaacacagggccaggcactgagcagatgcccagaccacgtctgcttaactgatttacctagcattcagttaagggctatgggtcctttaaataactctttttaatataactggtatcagattcttttgatatttccatttgttttaattgctgcaacttaatgttcataaaaactaagacatacaactttatggaactgcatcacaaccataggaactgcatcacaacaatgggaactcttccagattatactggagcttccccaaagagaaaaaaaatagttttcattcttaactaattatttttaagtgaatggcaggtggaacactacaacatccataattttgcaagctgagaaagagctgaacgtctttttattgccaaaaaaattgctggtgttagtgacaacagtttttttctggatctgattgaagacatttatgaaaaatcagtcctaaatatgaatattcccataaggaaactgcttctaaggagacttaaaaatactcctgaagtcagatgtgtatcaatttctatttttgtgacttccccccttaacttccataattgattttaattgattgggtccttgttccatgtcgtgaacatttgggactcataattttgaaaaaaaattaaaagattttcttttggtttcatggacagaagcaaaaaacatatattatgtgattttggtaattggactcctgttttggaggctgagaatgtttgctgtctatgcagctgggatgggagttagcagtcgcaccctcttcctaggggaaccatgtgagagagctcccatttggaagcctaggctggttgtactcatcctcaggccaccctcagcctgctttcttccccaaatcctggtttacttctgtggaacatttgtctttcttacttgattatgttaataatagcaactgctcattgagtaccaactctggactgcactccatagagatgcttttgattgagcctcacaaaaaccttacggggaacttattgttatttccacttttccagatgaggaaactgaggtgaggtaacctgtctaggttgactcagagtggaagctagagagctttgatcagaccccagaattgtctaattccaggatctgctgttttcatttcagtggtcagcccacatgtggagagaagttcctatgctcacttgtaggccctgtgttgcaaggcgggtatgatctggacatcaaaagtagtgtatgaggatggagagggtctgggagtcaagacctgtgagggcactgaagggactggatgatgtttatcctgaagaagaaaagacttagagggaagtgagagctaaattcccatatctgatgggccttagttgtgaaaagatttctacgttcattcatacaatgtcttacttgcctcctattatcccgttgttgagggagagattcatgtcatggggttatgtggatggctgaacacatgacgtctgtcactgaacagacaagactgacagcagtttattagccacatatactcacatcccagggacgagggcactacatttcatgcaaggacacatgggggttcactggtgaacaaagagaaactcctgaagaaattgaagcagcagggtctgtgggaggcaggctttgtagtgtcaagagagtggggttccccgttccctgggaagatgtgattggtcggtttgaataactccacactctggcagggaactgaaactccctactcgtatataggcaacaattgtgcctcgtccccttgttaaggaggattgtttggctaggggaccttatctacaagagtagagtgggaaagagaacttgtggttatggcattcaaggccctcctaattttaccacctgcgaaggcagcacataatactgggccttaatttaggacttagatcacatatattcaacacattgttattcaacacattgttattcaacacctgctgtgtgcttagtaccattcttagtggggaggatacagtggtgaacaagacaaagtgcctgccttcatggagctgacattctaatacagaagacacacaataaacaagtatataataccaagttgtgataagtgctttaaaagaaaaaaagaagggaatagtgcctagagtgctgttttagttatggaagtcctctccaaggaggtgacatttaaactgagacctagatatggtgagtgagccattgaacaactggacaagagcatgcctgggagagagaagagtaagtacaaagcatctgtgctcaagatctgcttgttgtacctgaggaccagcaaggaggccatcatggcgggagtgagggggaaggtggcaggagacaaggtttaagagataggcagaggccagatcttgtagggtcttgtaagccatggtaagaacgcgagcatttttaaaaaaatacaataagaagcttttagaaggttttgagccaggaagtgacatgatttgacttatgtttttaaaggatcagtcgatgttcttttgagaataaacttgtgggaggcagaggtgggaacaggaacactgtcctactccaggggaaagctggtggtggcttggacttgggtggaggtggtgagaagttattactttagggcagtggttctcaacgggggtgattttgctcccgccaccctggaacatttggcaatatctggaggcattttttattgtcataatgtgggtgcagggttgctacaggtgtctagtgggtgtaggtcagcgatgttgctaaacattctacagtgcacaggacggcctctcacaacaaagaattatgtggctcaaaatatcaatagtgcctaagttagacaaacctaccctagagatacacacatattttgatgatagagtttgcaagatttgctgatggattggatgcaggtgtgggagtaaggaggagtcaagaatggtcccaaaaagtttggtctgagggactgagtaaatgccagtccttttactaagatgaagaagtcttaggggaaaggtttggatgggagtaatcaagaattcaatgttgaattttgagaagcctgttatatatctaaagattccttagaggagaataagaaggagtagccaaggaggaagaatgtgaatcaaaagagtgctggttacagaagccatgtatagaaaagatttcacgtgtcaaatgccacagaaaggttgaataagatgagtgagaattgcctattggatttggcaatgtggagatcattggtaatcatggtaagtatggtgccagtggagtggtagagatgaaaacctgcttggagcaggttcttgaatgagaatccacctccttatgatttctgtctaacagctttacttctatgtgttctggaatagcacagagaaacttgcacttacaaatatgatatttactcctcaaaataacttcacaccatgattaccatccccaattatagagaagggaattgaggtcttgtattaatcctgtcttttattttctgtattctgatgctttggcatcttggggccttactgaccctgaagggaccacccctcctggtgttagccacttgttagagatggaaaacaattcagtttgagtgtcttttcttatgcaaaccaagcaatacaaagcctataccccagctgccttcattatcagaatctcatggtctgtgtcactatcttcttgcctaatcactgcagggctaggtaccagataactagggacagactttttaccccagagtccacaaaattattcaaactagccgatcctaagcttgcttaccttgccttacccgtgtcttcctgcagaaaccacaataaatgctcttgctcacattttctctcacatcctctgtctcctgactggccttggtgcttccccacatggccctatgtggtgtggtgtgcctcctgcttctagggacctttgagtagtatactaaacccctttcttctgacagtcatttccatgtctgtatacccgattaaatacctgattaaaacaagtcctcagtttggggtggtgactcatatctataatcctagcactttggtaggccaagacgggaggatcacttgcacccaggagtttgagaccagcctaagcaaaatagccccatctctataaaaaagaaaaaaaatagccaggcatggtggcacatgcctgttgtcccagctactcaggaagctggcaggaagagagtttgagcacaggagttggaggctgcagtgagccatgatcttgccactgtgctccagcctggatgacagagttagaccctaaatcaaatatttggtaccattaaacatgactagaaggatgactactttgctcacgatcgtataggtagtgatggagcaacttctgaaatccaaatctccaaaattaagatgcatgctctttcttttaccctgtaaaatttgcttattttacaaatggtgtggagatacaggtctcaagaaaacactataaacatttaaatcctgtctgatcttttcataaagaatgagaattgctaacattttgtgacaagctctattgaggaatagaaagaaatgtaataaattataatgatgtcagaatcataacattggaagcccttaggggaaatgtaaacaacaataaatgattataggcttctccccataccactttctactatattaagtggtcctattgcatgcagagagtcatccttacttgtcagcagagtgccacctgaaattattcgcgagtgaggtcataattgtacgtttatggtttaagaatgagtaacatgcttgttattttctctgcctcctctgccttcattattcatctgtatttcaatagtgaatctggttgtcactttaggcctgacttcagtctgcggctaaggaggcagggacttaagtcctctggctggcccacagcccacagtgcctgaaggcgtaggaagcccaggctctgaagctatccatgggacatgtcccaaactaattgaggtcagttcccatatagacctggggggaaacctgttgggggcctttagcagtgtggcttgaaaatacttttccttgggctcaaacctactgtttctggtgggtggtttaataatggacccagcttgggaggccccagacagcttatcactggttaggggtcatagtgtagaggttaagaccactgaccgtggagccagactgagtggattccaatcctagctcctcttccttttggctttgggacctcgggcaagttatttaacatctctgagcctcagtttcctcagctataaaaatagaaattatggtacctaccccatggggttgatgcatggattaagtgagttagtatacaagaggtaatacaatacagtgattaggaagacaagggacagcatgggagcaacattgcttaagttcataaactggctcaaccactaactagttgttattagtctgtttcacactgctataaagatactacttgagactgggtaatttacaaaggaaagaagtttaattgactcagagttccccatggctggggaggcctcgagaaacttacagtcttggcagaaggctatggggaagcaaggcatgtcttacatggcagcaggagagacagcgagtgagctcaggggaaatggcagacacttatcaaacaaccagatctcctgagaactccctcaatatcatgagaacggcatgggggaaactgcccccatgatccgatcatctcccaccaggtctcttcctctgggaattacaatttgagatgagatttgggtggggacacagagccaaaccatatcactagttgtgggacctttgtcaagtgccttcacctctttgtgctccacttgcctcatctgtaaaatggggatgatgatgataatagggatgttgctaggattaaataagttaacctatgttaagcaattaaaagagtgcctgctttatggaaggactatttaaagtctgctgtcattactattaatttatatcattaacaaaggtaacatggaccacaagagttacagaccctgtgtatttcagagttcagagaaacaagggagctcagagagctgggaactcaagagaggcatcacagagcaggcaggccctaggaaccttgcatagcatgatggaaagcccttagccatgagcctacaagaactaagtttgaataccggctcagccacttgttagctgagtgaccttggacaacttatgtcacttcgctgtgcctctttctctgactacaaaatggagaggatgatagcacgtccttgggaggattatgtaaagtaatacagacaaagggcctagaatagtgcctggcacatggttagtactcagtaaatgaagatgttattcacgaattactactaagcctcatagttgtaatgaatacaaggagtaactctcattattattggcggactgcaagctcccagtgcgaaaggtaaataaggatttgggtaaataaggacttgggaggagaggtttaattcattaattaattaaagacagagtcttgctctgttgtccagacgggagtgcagtggcacaatcatagctcactacaaccttgaacctctgagctcctcccacctctgcctccagagtagctgggactacaggtgcatgccagcatgctcagctaattttttatttttattttttgtagagatggggttttgtgttggtggtctctatgttttgtaaagatggggtctctgtgttgcccagggtagtcttgaacttctggcttcaagggatcctcctgacttggcctcccacagcaccgggattacaggcatgagccagcacacctagctatttttttatttttatttttgtagaggtggggtctccatatgttgcccaggctggttttgaacttgtagccttaagtgattcttctcgcctagcctcccaaagctgagagggagaggtttagatactggcaaaggcaggaaggtgaaaagctctcagggagttctggtggtgatgaacagaccagtttgtatcctttaacaggtttctgaggagggagatttggtttaaggtagggagtgaagggcattggattccaaggtagggaatttattttttaatttctctagtgatagcctataaaccattgagtagaaggcataaagggttacagtaaggttctgttgttttgcttaaatgtcaaaagctataaaactacgatggatctggggcctccttttctgtctgtttcctcttttgtggagtctcctcatttcctaattcagagagttcctaacttatgatggtttgacttacaatttttcaactttataatggtgtgaaagcaatacgcatttagtaagctccttaacttatgatgaggttacgtctgcataaacccatagtaagttgaaaatattataacttgaaaaagcacttttgacttacaatattttcgacttatgttgactttattgggctgtaaccccattgtaagtagaggagaatctgtatgtacatttctataaaggggcaatctgctacttgcttttggccatggagaatgcctgctaccttttctatgaagtgttctctcatcatttaaactgccatatgtactcctcttctcctgtgttcccctataggactgtgcgaactgcagagattcttatcacagcatacctggtggaaaattcattcattacccactccatcccctaccagccttggagtccctagtggacctggactgtgccttgttcttgagatctccttatcccctacgcctagccccagcttagtgccttgtaccaaggagataatatgaagaggatagaatatgtgaggaagcatgaaagaggatccttcattgagcaaacaagtgggtagtgattgaggaaggacaggggactcactgtatgagtcctgagcaacagggaggtattaccccaggcatctgtgagatgtaatgtgtatgtggggagtggggtggtgaggtggatgatctcctctcttgtttagatagctgtgcttctcatttaaaactaatgatagtaacaggaattaacaggagagtgtgatatgtatttctggatagtagtgggtttcttggaaaatggaaggaacacctgcatcagttcctctgagaatacctggggactggagcagtgattttcacacttttaatgtagcaggaccctttaagtgaaattttaagctaagcccaatagatgcctacatgcatggatggatagatagataaaaagataggtccaatatatagatgacagatagataagaatgaccttggataagacacacatccctggaccttgatctcctctgtaccataaagtatagagcttaattgagatttctgaactgctgatattttggatttgttaatttttttgctgtgtaggaccgtcatgtgcattgtaagatggttagcagtaatcctggcctctaccaactctacaccagcagcacctccctttccagttgtgacaaataaaaatgcctccagatattgcccatatgttttctgttgggaggtacaaaattacccccagttgagaaccactgggttaagtggtctctggtgccttccttttttttacttgagtgattactcctaaaaggcctttagcacagtgtctggcacatcttaagttctcagttaatggtagttgataatactgttatatgcttcccttcagtagtattgatagcttggctattcctcatgtcatactgtgactgatatttttaatgttcaacttggtagcacagcgcatcttagaaagccaagtgggctgctttactttcttgttagcagtccccagggaagtatagtcatcagtaatcaggtggttgctatggcggagatgggaacatggtcaccctgtaccattctccctcctgctgtatgttcttcaatttggcctttccttccctcactaatattccccctggtgttcttttctctttttctggtgaacatgacacagtgctaaatggatttttttccccccgctctcctttttcttttcttcaccaacttgaaggagcaggattcaaccttcagcacaacttccagagtgtttccatggaaagacaattaaaatgagcttttaggtttgcaatgagaagggatatttgcttttttcatattaatattcatattttctcaagattcaaaaaatgccaaaacaatattcatgggaagaattcaactactagaaaagacaaagctataatagaattattatagtctgtaatatgttaattacccaaaacaagttggtctttgggataaattagaaatatttgctcctgcatttctttttgacttagaaggaaaaataccaatggaaataaagtatgccagaaatgagcaaaataaattaagaatactaaacctgatgtcataaaatgaacatcccactatgttggaatttatacatttttaatgaaaattagcaatgatcactcattgtatatttcttggtaagatttaaaagtagcccacaataagggtcgggttgcttttagttttctattgaaatcaagacataggttttgtatgacatgcttgaactgaacatttgggaacacttccctttagtctcctgcatagagtctggcgcctagtaggtgctcaataaaatttgttgaactgtattcacagaagtgatcctggagatctatgtatttactcattgagctaaagagcccttcatgattccaaaaacgggagtggcctggtgtacccattatatatcaggtattatccaagacatttgaatcactcatgtgaaaatatttattaagcttctattatgtgccaggcacatgctacaagatggtgaaccaaacatacagtctctgtagtcatggagttcacgtttctagttgagaagacaaacaacggaacaatagaacactgaaagaaaatgaacaattattgaaagctgttgagaaatgtatgaagaaaataaatatttgacctgagaatttgtatcagaaagtcattcaactctagataacagaaatctttcgaagtagtagcttaaatatgtttccttcaagtgaaagatgtctggaggtgagcattccagggtagatatggtagttccaggatatcaggacacaggctccttctggctttctgttttccagagttggaatggggctctcatccttaaagtcactttttggtccaagatgcctgctggccttccagtcaggaaggaggaggatggcgatgtggacgcaaaatggcttgcttaccatataattcagtccttttgaagagcaatccttggaagcctcacctagtgattgtcttttacatatcagttagaaaagaggataggacatgctatctgttagccagatatgtagtcacactgaataaaatgggagctttgttagtaagaaagaaggcagatatggatgttggataatcaactagcagatttgaaacagactggaaggatataaagagtaggactgcatggtaacatttactgagatggggaaggctgggaggaatgggtttagaggaacggcaagagttccatttaggacacattaattttaagatggctgtgagacttccagttgagttttcaggttgacataccactaccttacttctcctgtcaaccccaggttttcataaaagaaggacttatgattgaaagggagagctcagagacttaacatgaaaatgtatctgtataatacatacacttttatcttaaattgtattttaggtatttctaaaaatctcaaagttttctatagtttcttctttcttccagaactgtctaataagcatttagtataagtaaagcactgttataggttttggggatatatatttagaacaaaataaagatctctttcctgatgtagagcattctagtgaggcagacagacaagaaataattaacataaaaataaatagattagttaagtcatcatttatataatattgagaaaacatcatgagcactaactatcattatggatttttattgtgctcagtttcttcactgatgtccttattgaactctcatatcagtcctatgaggcagacttttttttcctcgttgaacagatgaggaaacaggctcagagaagttggataagtccaatgccttgcccatgtgttatctcctccaggaaagcttcctgtttaagtgtttcttccactcacaagccagtgagatcttcatgggcagctactgattgtactgagtttgatagtcctatcccctgacctggaacctggcatatagtcaatgctcagtaaatgtccaattgttgaacacaactggcctacctagtttacacacctagcgtttatttgtcagagccaggatttgagtctatccgtgtgtttgaacagttgcctcctgattcatgtattttgtacatctagattttaggtaattgtattttcagaagcagaaccagttctcttttttgcataatggagcttgcttactttaaggcaaaataactcagatcctccaaggcaaatcattctaaacaaagggcattttttcatgagcttgaattttcccattccctttagcaagccagcttccggttaaccaggccctgaggccttagaaggagacctgagctctctgttttactcagagtagctcatgatgaagtcacttgatgacttgccatcgaaggctgtaaagacattaattattgaaattaagtgggtgttaagagaatccgaagtcacttttgctttgcctagagacaccggagaatctgagaatattggagccagaatctgagaatattggagccagaagggcgcttagtcatccttgtttcagtcttcctcattttccggaagaggaagtagagattcagagtggcaacaggcacttggccaagtcaagcatttagtggcctcaccatctgcctcccactccagtgctctttctattctatcatgctaccacttattcaacaattaaaaggtattctcatcatgtataaggaattgtgaacggacttttactaaagggtaaagaggtgatttgttaaaatgtaaccacgtattttaagtgataagccaagtataatccacccccaacctggtttgaaataacaacatttgtgattgaatattgaatgattattttttagtagtgtttttctatctttgtgttacctgctaccattgcagaatacacaaagagggagtatacttttctttttaattcctgaagaaacattaataattctagcaaggtgggaatgtgctgtagccaagaggtcataggctttggtgtcaggtggcctgtttttaagtcatggcttcacagtctactagccttgtgagcctttggtaagaaccttcttggagctgttggagaacctggcaggtgtaggtacatacacttgaagaatatgagaaggggtggtggagagacagatgatgggttgatctggagctcttgaatgcgactgaatcccacgaggtctctgtggctgaatctagacagggattttgataatttggagcactgttgatagacacagcctccagttggcattggttgtgaacatttacccttttgttttcatgacttagtgtcttggcactactcaaaaagccactttaattttattttctggaatagaacctggtctaaatgaaaacacacacacacacacacacacacacacacacacacacacacacacactacataatcaagtaattaattcactaaataaatattgtgcttactatgtatgaggcactgttccaggtcctggagatgcattctaatggaatgatgtgaaacacaggtaaagaaaaggaagaggaaaataagcagaatgtatgaagaggaggatagcaatgaagatgcttgccatttatctggtgctccctatgggccagacattagccggtactgtgtatacattgtgtcactggattcttacaactggcctataaggcaggtattattatcatctccctcttacagtgcagaaactgagagctggtaaagcgaagcagcttgccaagggttatgtagctagtaagttgtagagcttggatttgagcccagttgtgactggatccagggcctaaggtcttggcaacattttatggggattaaaaaggactgctaatgggtgcaagcttttgtttctgggagacaataatatcttaaggttagactgtggtgatggtttcccagctgtgattttttatttaatatgaaaaatcattgaattgcatattttaaatgagtcaattgtatagtatatgaatggtatctcaatgttgttattacaaaaaaagcagggtaacttgatggttaatgattatggagagcctactatatgttgggcactgtgctaagagttttacaaatactattttatttcatctcacagcagccctgtgaagtaagtgtatcataacccccattttacggatgaggaaataaggactcagaaagattgagagacttgcccaggatcatgtacatagtaagtgtgggagccaggactcaatcccatgtttgtttgactttaaagattatgctttttctgtctttgtaaaataggaaagtgattgattttctttttggtatcaaataaatatggccctggtttttattggtcttagaatttatgaccatttctactactaaatggtcatggaataaaactttgcaatgtttctgccacatcactacccacatgttttatttttccacatagaaacagcccaggctgggggaggaggttgttcatccagcaatttaatgattaagttttaatctattaggcaaaaactaaggaataaaaaatgcttcatgtataaggaatttagaatagggaaaatatattaggtattcgttgtgctcattttccggcagtacagaagcattttattttaaatgtactgttcattttgggtgttatgttttgtttctcttatgtaaactttccccgtttatgagaagcagcagcgtgtgttttttctagaaatagatagcattcataaactgaaacagtttcattggggacattttctgtggcactgcaacagaactgtcttggcagaaatactggaatcctataaaatagagttaatattgatatgctttaatcaaaaatttctgtttagaagcaataaagttattcagtattaggcagcctcggttctatctttatccttactgctaaaacatcttcatctttagagtatgttgctataactatatatctccagattttctttccccagttctaaaagagaactcttaggagttgtgatgctactgaggatctcccagctttgcctcatcggggtggtatgcaattatatcccgtcctcttccatgtctgataacatgatcacgaagttcattttggtgcatcagttcctattgaacacctttgccagacgtgctgtgattggccagaggccgcttctcctcatggtcgcctgaaagtatgctgcatatacctgatctggctgttcccaccagctgggatgcatttactctccctccactctatctctgccttttgagatcttagccatctgtagcagtcaacattcatctgtaggtaccataagctaaaataggtattttagtgctgttaattaggtacttacaaaatctatggggtgggtggaagtgggggctttaggctgtgtctccaggaatgaaacctagaccaccaccacaaaactggccctccaaagggagctgcagctgcttttacgtgcagagaggtggggagttgggaagccaccactggaacgctagatttcaggacgcatagctgatgccgcagtccaaggggaagaagccaccaccactgctactgcaattgtctctcaacacctcaaaaataagtcactggatgctcaaatattgctgtgaatactccatgtctccacaactttgcttaccaggagtaaaaagctaaacagctggagacgtgggaagataatctttgccttactcttgtttataaaatatataggcacatgtattagtccattttcatgctgctgataaagacatacccgggtctgggaagaaaaataggtttaatgaactcacagttccacgtggctgggaaggcctcacaatcatggcagaaggcaaaaggcacttcttacatggcagcagcaagagagaatgagggagaagcaaagtggaaaccgcttataaaaccgtcagatctcgtgagacttattcactaccacaagagcagtatgaggggaaaccgcccccgtgattcaattatcttccaccgggtccctcggtgggaattattggagtacacgtgggaattattggagtacaattcaagatgacatttgggtggggacacagccaaaccatatcagcatataaaaatgaaagatatatatatctttttatgttttatatatatacattttatatacatttatatatacattatatgtacataagatgcatgtacacatctatttatagtatacgaatataaaatacataaatatttgaaatataaatatatttacataaaaacaaaaatatatgtagcttattatgttccaggcagtggtctacaaaattgttcccattttttagatgaggaaactgaggcacagagaaattaagtaacctgcacagattgtaagcatcttcttctatgagacacattttattccatccagcagtgttttgcccagatgctcagtaagtatttggtgaattaattgaaaataggtgtgtgccattggtaaatgatcttttcctcttcgaggctgggtcttcctttgagaaatgaagggcttggactcaatgatctctaaattctttccagtttatatccctaaggtctccttaggttgatttgtatagggcaccctaaagaagagctactgttatggttctctaattatgtgccaggctctgttctaagcatttaacatgcattgtttcacttgagcctctcaacagccaggtgaagaagttttggtcattattcactactgtttcagatgtgaagaaatgggtgctcagaaaaaagtgatggctggtctgtggtcgctccgctggtgagtggctgagctcaaatgccaaatcgtgtctgcctgactttaagcccatactcttaatagccgagaaagccctagttttctcaaagagaatgacatctagggcatgcatttgtcttcccttccttttctcctgccatgtcttctttttcattttcgtcatcatccaaaaacatactgcagatactttggcatacattttatgattctcatcccctttgctggtaataaagtgcttactccacatgtgacatgtgttgacatctgagagcattttttgttgctgagttggttgttaataaacactaatgagttggtcgcatctcccagagcaaggacagataccacaggaacaggttttaatacctgtcaagagaatacaaagtagaaaactttattgtggtgccctcaccatattgtcctggttcttccttgcattcattatttaatactttttattttataaaacttgcttatttttgtgataaaatattctcactctttaaacaacataactatatgtcattgctgttttaaaaatccatgtgtactttgcagccataaaaaggaacgagagcatgtcctttgcaggtacatggatggagctggaagccattatcctcagcaaagtagcacaggaacagaaaatcaaacatcgcatgtgctcacttataagtgggagcggaacaatgagaacacatggacacagggaggggaacaacacacactggggcctgttggggggtggggttgggggagggagagcatttggaaaaatagctagtgcatgctgggcttaatataataccttggtgatgggttgatctgtgcagcaaaccaccatggcacacatttacgtatgtaacaaacctacacatcctgctcatgtaccccagaacttaaaataaaagttaaaattaaaaaaaatatatatataaaaatccatgcatacaacacagaatgagaacttcgaatacacactagagggtattaaccatggttgtctataggtagtacagctacgacatattttagttgattttattttctcatgtatattctgagatttttctgtcatgggcttgtatgacttttgtaagaatgataaagtaaaatgttgaccatggtcttaattggtatcttcttatagctgagtctcttacgttttttcctctgtgcctctgcctcccagtcaatcagacacagcactcttctatgtcagctgcccgggcagagctggggtttcgagacattagggttgcatcagatgcctgactaaggcatttataagactgcccatagcttagaacttccagtgatctggaccctctaaatttgggactgttgacctttggaatatattttcttacataggtttctgtgtcttatttgatgtggaaacaacaagaaatccgtaccttactgagatctataactcacgagggacttcaaaactgcattatgtcaaaggcaaacagtgttccatcattgaaaatacaattatgaaaaatgataactaacttctgagtggtactttttagagtttacatgggctcttcacttccatcatctcatttggtcttcacagtcttcctggtgggtaggataggattatttcattttaaaggtgagaaaactgaagcctgatatggacagctagggagtggcagagccaagacttgaatccacattttttttttctttttttacttttgctgcttcactacagtattttcatgaattaattgaaataatcctagatatccaataaaaccatcactaccgccactgctgcctctcctctcctcttccttctcatcattgtgatcatcaccatcatcttttccttctgttcaatatccttctgtcagttaatattttatattttgagggtctgaatatccgatcatgaactagtctcataatccaagaggggtcaaagtcatccctcttgcatcttcttctctccctttcctccctctctcctttccctcctttcctccatatttctctcattcttcagttactttcataaatatttattttgaactgttcttcacaatattcacttagccctggcagatggcctgagaggtcagctttcataacctgatccttctcttttcagcaatgaaggatgaatatttcaggatcagcatattttatcaatgacctaaggctttctgattactttccatctgtggggtctacttcattttgttgcctgggctatttaaaaggtttcttgcatgtagtgtattcatgataaataaccagttgcttttgtttcagggaaagccatcttaaaggagcaagtcacaatatgcttctactctcacaaccataattttaggcattaacttactctataagcattattaccaggggccaggtgcctcttataatagtggctagcatgttgccactcttcatcacacgttatcatacttgtcaatttacttgttcacacccctcctccctactttattgtgtactccttaaggacaggactgtgtcttaatcacttttatatccccagggtctcatacatattaaaagtatgaaacaatgaaaaaaaaatagcatagctttggcacaaaggataattacaagcttctgaagccttccggagatatccggaggctcgctttcctcatctgttcagtgggggtaatagtggccttacagagatgctgatcagacactcttgctttcttccccctagtttcttagaatcttcttggtctcctctctggccctcatggcactggttgcataggcaaatctagactcttacacacttggctatgaagagtttaaaacccctttgtaaagaatgtcaaaactacatttgaactttatgtagtattttcattggtacatttggaatcctaactagatcttagaagtcactgtctttgctcacatattctctgagcttaagcacaagaaaatgattcattaaaatatttaaatcagctactagaaacaataatgaggataaacatctcggaggcccaaatccattattctgtgctcccattccatctgtgaaggctggtactctatccagcactaaaaatttataaatgcagggtcagtaagaccatagtcagcaggaaattgcaaaactctgggctcctgcaagcaaagcccaacttttcttcagaaattcatgacattggaatggaacaaaactatgcagaaggtatagtgacaagagtaacactgaactttaaacgccaactctgtggctgcccagctggatggccttgggtaagtcacccaacttttctgtggctctgttgagtcatttgacaaatgagcataatcaatcttgactgcctctgtggagttgccaggaggcttaagggcgcctctgtgtgtggaatgtgctctgtcagctggaagatgcctgtcatgtacatgggagggactcattttaggatggctactcagagatttttgcattagaagcacaggtttgctttagcctcagtttgcaaatgtacaggattagcattcccatgcagtgtcactctatctctggaatgctgctattgccaacagaagtcaaccaaatgcctctccacaatctgtatcaagcataccatatgtttttacacaatggaagtgatcttaaagaattgaataatattttcttgagggaagtttactttttgcaggaaacctgtgatgaattatttggtaagagaaaaaagccctattgtaatctcttctaatctatcaattctaaaagtttaggttcttttatgtaattttttctagacatgccagccaggaatgcattctaaagtattgtagtgttaacataatgtattctaaaaagatgatgatgtcatttagatatctactaaataaatagtgaatatttagtaatagtgctgataattacttgtttattgtttgcttactatgtgtcccaacctgtgctagttgctttatatgccccatcttattggatcctcactatttaacagatgaagaaactatgtctttaagaggttaagtcatgtatctgatgtttgagagcaggccaaataccagtgtgatggtttacatccaggcctgcctgacttcaggataggagttcgtgagcatgaaggtagattctggtagtttatattctatagaatttggaacctgcatcatgaggtcagacgagaacataaagaatcttaggttgcaaccagaagaggactctgtggtctagaaagaaaaaaaaattccctgagttattaaaaaagttagtggaaaggcctaggttcccactcagcacctgttcctccataccacattgtgtctgctacacacagcacctcatggtctatagatgtcaattgtagcatggccattgagggtatggaatgaattgtaaacaggccttatctttcaaagcatccagcagccctgagttccacgactctttatacctgaggtgagagttggccagatagggaattgatcctatgtcctactgaaaaccagtgttggtattagcaatggtcttggtaaaatacaatgaagaagaataacgattttaaaatgaaaaaaaaaacttgaaagaaatggaaaattataaaggacacagttgcaggctcaatataacttaaattaggggttgacagactttctctgtaaaaggagtggagtttgactgaatgtttgtctcccctacaaattcatatgttaaaatctaaccctcaatgtgaaattattaggaagtgaggcatttgggaggtgattgagtcatgtggattgagccctcatgaatgggattaagtgcccttataggaatagagcagagagctagctccctgcctttccttcatgtgaggttacaaggggtagttgtttgttttcaacctaaaagagggccctcaccagaatctgatcacgttggtaccctgatcttcgtcttcaagcctccagaactgtgcgaaatacatttatggtgtttataagccacttagtctatggtactatgttatagcagcctgaacagactaagacagcctgtttatgactgctttgggatatgtattctctttttatctggcaggcaggaaatggccaagcctgagtaaaggcagagtagtccagtgctgcccaatattcctggttacctttgggtagccaaaggccacatttctctgagggtatttcttactgatagactggctattaagtttcactcttctgcttggaaacccagcttaaaagctattttgggcagtgaagttccatcagctaatatgtattccaatgacaatgacaagaagtcccagcctaggtttcatcaaataccaggccctacagactgctcctctgaatttaaagcttcaccctctctattattgtccatgtttgttcaaaagtatttatgaataatgataatgatgatcattatggctaacatttattgaagatctcctatgtgtcaggcattttacccaacattaatacatttttatcatccaattcttacaacaactctatgaggcagatactaccattgccgccattttgcagatgagaaacttgaggctcaaagaggctcagtgacttgttccaggtcactgttacttagtggccgaggcagatctgaagctcatgctgggtgataataaagtctgctgtttaccactctgccacactatcatccctgtttaaggttctagaaggcacaaggagcctgcctttctaaagcagacattatctccatcttcctttcagtctagttctgagaatgtgttctcacttctccctctcccatgttattcaattctcagtctcaggcctacagtaattcacacttggataactgcagtagctcttaactgtttcttttaaaaacaactatattgagatataattcacatatagtaccatacaattcacccatttaaggcatacaattcaatggttttagtatattcacagaattttgccaccattaccacagtcagttttagaacattaacatgtcaaaaaagaagcccaaacccttcagctatcatgccactatccctgttcactgtgacttccctccccaccagccctaagcaactgctaatctgctttctgtttgaatgaatttgcttattctggactttcataggtagacttataatatgtgtccttttgtgattggcttctttcacttagccttagtactgtttataattctcacatgtagcacgtatcagtacctcattccgtttgatgactgaataatattccattgtatggacatgctacattttgtttatccagccattagttgatggacatttgggttgtttccatcttttggacattatgaactaaccagcctcttaactagattctgcacagcactctcagattaattttctgaaagtacagctctcattatgtcttccctccaattagaagtcatcactggtttcttattgcctctaggacactgtttaaacttttgagtttggattttattgtgggaaagtgcaaggcatggagtgagcacttatactggggaaggaatggcaagggaactgtgctttactgagcccttgtccttaccctgccttatctcccaagatcctcaacacaaactctctcttatatttacatggatctaggcatcattcttcaaatatgtttctcattgtcttatctagactctgtttctcctccttgaaatgcctttctgttttatggctaagtcaggcccttctaaaccctgcttgtccatggagcctttccacgttgctgcggccttcagctagctctcccttccctttcatcccctaagcctctcaccgtctgtacggcccatttggccgtcagcatgtggggctgcacaatgagatggggctgcttttctatctcattttctttggtggattgggaacctcttgaggccagggatcaagtatgacttattatcatgatcattagtataagagtaatccctatcatttgtcctaggcattgttatgtgctgggtcttttactacatccttacatttgttaacaagaaaagacgtcagggtaggagctgttattccagtttcatcaaagaagaaacagactcagagatcctaaataacttatatttggtgtctcagcaagtaagtaatagagcttaggtctatctgatgccaaagtgcaatttccacaatgctgtgctgacaatgactttttttttgctcatcctgtcccttctcttcctcttcctcctttgtcatcacccagcatcattctcattttgcagatgaggaaattaaggttcgtacaagtttggtattttttccagagccacgttcatagtaagtaataaagcagggatgttaaaattaaaacttctgtctccaagcacaaatttattttccttaccatgatatttgtgtatgttggggcctcagcaggctgttttataataattatcatgctataaaacaatagggaggagaagattcacatacacaaacaactagaagaactataagatactgtattgtggtggggattataaatgtcatagaaattttgaaaaaagtcatgacaacttcttagatgaaggaaggctggtgctagaccttaaaggatgggtgaggttagccaagcacaaaggagagaggcaaagagaaggagagagacaaagacattcaagttttcttgtggagccattctcccagcccagtcctccacatcgactcaaattctctaagaaagagtgtagacgctggtcttaaccaccattgggacagctgttagaaggaaacaaatagttgcataatattgaaatggttgtgtggctttgtaatatgtttatatttatcaaagggaaaggcaaggacattatacaattcgatgaagtcctgatttaaaaatctgtattttcacttactacagtgtgaaaggggatagattgaggcctttatttattcgtttaattgcagacatatttaatatttattataaagattttatacttcctcaaattcaaatttttattttccaagtatgatagttcttttagtttttgtgaaaggcaaaataatacccaatccgtcgaatattctttttcaaaattgcaaatctgtttcacacgtaaaaatataataccaagtctgattataaaccacaaacaacaaaatgtgtttaaaaacaaatgctgtagttggaatagcagtaagataaatcacacaggtttttaggtatttgcagcagactattcagtagctgttggcttcaaggatgattaaaaagtagatttattgatttctaacgaaaccataatattaataatctgtggagggatagtagactattggctttttgccagaatggctttgaggagagtatggcctttggtactaatagcagcttctcagcagcagtcagaattgggtctctgagtccagtgcattaatggttcagcagcaaagttttttcagtactcaaatatgacttatgcccatcagtccctgatgaacttgttcaatttaaatgggcataagtcatatttgagtactggacacattcagagcatctcacccttacaaatgattgctcttcttgcttgattttttgtgtctttttgagatgctaagccatagcaactgcctttattcattcatggtatcacaggagaagagtagataatggatgatattaatagtatatccatttcttatacttgggccatggaaagtggaccacatagaaaaccacctacgggaccacgtaaggttagtgatcccgctttccctgttagaatacaagagattgcatccgtgaaccgaggccctgggaatgctgtgatgtcttcttgaatgtgatgcttggcttctgagcttttacttttcaagaaagtggtaattattacaaagcttttcacctttcttggctagtggaggaatcctatcatttgcaggtttccacatttttcaaaggaaaaacgctttttatcgtctttgttgtattgtagctccactgaagagttctcatcatggtcctttaaacgtaagtttttttttcagttggtagtctgcctttccctgagttgatcatcttttggggtttgggcttcagatcaaattcctagtgttgtttatagtcagtgctgcacagagcctctcattcttgttcatatctgcctattatcgtctctactcttctccttccctctctctttccctttctccatccttccctcctctctctctcccaccatctctccattcctctcacttttaagtgctaacatgttcttcctgaggtacatatttgatagctttacctcgcctccttaatctgctcgtgtgtccttggtttgtggcctgttgtacatggtaaagcaatgttccaagctggggccatctgctttgcaaattccaggtcatacctaatctttctgatgccatactattacaatgagttccagccccagagaagttattttgcctccctggcggttactgaacatgtgtttatgtgtgtgtgtgtgtgtgtgtgtgtgtgtgtgtgtgtgtgtgtgtgtttgctttccccagtaatgggaaggatgacccacatggccattgcattatttttggggttgtgggtgggccctgatcactttcaattctgcctctcagttgctgccaccagtatttcaggctatggttctggacttaactaatctaaaaataaatcgccatttttatgaccagaagtctactaatgtagcagttttcacaccttttaaggtttgttttgctttgttttcttctaacagtaattaaaaaaattctctctgaaatcttatgtaaagtttagtgtttcaaacaggtcaaattgtagttgctgtgcttgagatgttgatggagaattcagagttttccttcctcctccccacctcagctacagttctttggagcagactttgatatacccttggattggttctcttttctttcaattcataggtgagaaccagagacaaggacaggggagaggacagtaacataaaggctcaagggcagaaagttgaagtaccttgtgaccagggcctggtcattggtcctgcatgaagcaaaaggacaaccattgatcctacctacgtttgtcagtactctaacaactgtccagccagtattgaggcttagcaagtagagtttttgttttttctttccttttctttctttttttttttttttttttttgagatagaaacctcttcaccactattctctgcagccacaagcctcagacagaaccagttgtggatagcaactcgacaggttgccatgcttttaatagatagtttaagtaagttctgttcttataattaggttgttatttctaacttttattctatgtgaggctaggttagtcagacccagtaaatgcatatttgtttgattcatttggctacgttattttaggccatggctaagatgcgtgtgtccataggcagggagtggccagaggaagcaaaccgaggtgagatgagaccatcatttgtagccatgggggccataagagatcagctcccattttctcctagcaggggtacagagggagcaggctgtcaggaatgacgctctgtggcaaaggttgctaactcaggggagtcctcattgctagataggtgaagagtggctctgtcttgccttatttttgtttatttttgctgttcattcttttctttttaaattttagattcagtgggtacatgtgcagatttgttacatgggtatattgcatgatgttgagatttggggttctattgaacccatcacccaaatagtgaacatagtacttaataggtaatttttcaatctttgtccctctcccttcctcccctacttttggagtctccagtgcctattgttcccatctctgtgtttctgcgtacccagcgtttagcttccacttacaagtgacaacatgcagtattggttttctgtttggacattaatttgcttaggatgatggcctccagctgcatccatgttgctacaacaggcatgatttcatttctttttacggttgtgtagtattccatggtgtatatgtaccaatatatacatgatatatatgtaccaatccaccattgaagggcatctagtttgattccacgtctttactattatgaatagtgctgtgagaaatatacaagtgcatgtgtctttttggtagaattatttatttttccttgggtatatacccagtagggggattactgggtcaaatggtagttcgatttttagttctttcagaaatctcaccagtcagaatgaccattattaaaaagtcaaaaaacaaaacaaaacagatgtgctaccctattcagatccctctcgctctctccatccccttctgagctcagaggtgggggtcatgggcttcttctaagagccctaacctggcccatgctcgctgtcactgatctgtttcacacccttttctccctcgcctgaaatagtagagcataacactcatctttctgcctccaaactttttgtttgtgtgtgtgtgtgtttctaatgtttatggtgaaagatgcattcaaaaagtgcatatgacacatccatgaagattaaaaataattataatgaaaaaataaaatgaactcccatgtatttaccatatagcttgagaaatagagtgttacctatacttaaaagcctggctctggcaaccttgttaaattctcttaataaaattctaataatttgtaacattcttttattctatatagtcaatgatatcatctacaaataatgacacttttattgcttgctttctgatccctatgccatttactccattgttttgccttactgcactggttaagacctgtagtccaatgttgaatcagagtagtagacactcttcttttcttctagacttttaaatggaatactacaatattttattctgtgaatggatgttgacttttatcaaatgcatcttctgcgtcttttgagatgatcatatagtgtaatttatttatttttctctctcctttaaccctttttttttgccaccttttcctttaaattcagggagtacatgtgtaggtttgttacctgggtatattgtaggatgctgagggtttgggccatcctgaatgcacccgatctcatcctttaatcctttaaagcaagcttgtccagcctgtgggccatgagccacatgtggcccaggatggctttgaatgtggcctaacacaaattagtaaacttccttaaaacacgagattttttttgtgattttttttttaggtcatcagcaatcattagtcttagtgtattttatgtgtgtcccaagacaattcttcttctttcaatgtggcccaggaaagccaaaagactggacacccctgcattaaagcaatatggcactttacattcatagaacttttaaagtgaaacttaaattcctggatttaatctgagttggtcatgatttattttgttttctatacattgctggatttcatttcttaatattttatttagtatttttatatttatgatcacaagttatgctagtatatatttttcctttctcatgttattgtctattttggggtgacaaggtgagaatagctccataaaatgagttgggaaatattcttgtcttgttttctctggaagagttggtataagattggaattatctgtttctttaatatttagtaaaacttgactgatgtttgcttaatgggaagtttaaaaaaatttagtgcttataagaatgttcttgagtcaattaaaaaattttttttctactaatgtcgatatcttattgaaattgttaaatttatgggtgtaaagttactcatagcattgactgatcttttttattatctgctacatctgtagttatgacccttttaattctcaatattgtttatttgtgcctctgcttcttgtattactccttttatttcaaagtccacataattgctaaatcaatgttattaaacatgttattagtcatataattatcttcctcacttacaaatcacaggaggactttcagtgccctttatgatctagctccagcctagctttccatttacaaaacacaatttttctacttgtgattttgagttccagccacacaaaactagtgtacttctcctgatatattcttaactttcataacctggtacctttgtttatacccttctcaccattttgaccaccctttcctatatctttatcctttgaaatactcattgcttctcaaggctcatcgcaaattctacctgatccatgaattcccccagtttcccccagacagaatagataactcattctcctgtgtttccagcacacattccctcagactttttcatagcaagtattgtgttgttttattttaatgagttgcttacatgactgcaaactagtaggttgtgagcctcttgaaggcaaatccttgtctttttcatgcctacattctaaacacttagcaggggactactcagaatctgttcaattcaattggaatgaattaaagtggaattgaacaggcattcatactggagtaatgtgaagatttccttaccccccagaattcccccttcaccatctggctgaagtctgaaaatccactatttgaactccactaatttttcttattgtgtttctttcttgttaaaaatgctaactggtcttggaaagcagaggaggccctccctggcattgcaccctacccctcacagttttccctgttacctaacaaatggtagctttcctagatcttttcctgagagcagatatacaggcaggacatggaaaaggaacatccctaagggagaacaaagatgcagaaagtggtgggtacatatggttgttgttcttaatttagtatctactgtattccaagtattgtgccaagtcacatgtaatcttcacaccaaatcaaagagctgggttccattatcatctccagttttaaagatgagaaaactgagactcagataggtagaacaattaggccgaagccactcagcctgcaaatggaggagttgagattcaaagtgaagtctgatagactattattctactacccaagctatctcttctctatgacctcatctcaagacctcagctatttgtcaaacacctgttatgtgagtaacctctgcccggctccacactgttccacagtcagtttttcaggtatttattttagtggtcaaaagtgacctcatctctgctgattgatctctgaagctgctggaatgaggcaagaatgtgtgatgtgtgcaattcctttggctgcttcttgtccctacagcatcttactctgctccctgagcgagggcttttgggttttgaaaggatctggaactttttttcagaaacaagtctctgctttgtcaggtagttccaaccccatctgtaggatcttcctgaaggctgagcacaccaacatccagctgttggaaacaacagcttcctcaattaaagaagaggcagacaactatctgaaaggaagctgggaacaaaggttatcctcaggagattgctcaggaggccagccagagggcatgaatgtttggtgacagcatatatttgggggcaatttgtactttgctgtttcaagacagagctctgctggctaggagagcacattttttcttcccttactccactaattggcagcgccatttagggctgtcacagcaacagtcttacagatcttgtggtccagacccgtcactgtgtagataaaaagctaaagaccagaaaggaggagtgtctcatccagagtcacatagcagagtgggagtcaagcctgcatcaagactcaggacttttgatggaacgtcccaggctgggaaactttatttggccctcagtttagactaccctttttatcagttatcttttctatggaatatgttctttattttcagttagtccttaagtgccttgaagactgaaaacatattttgtaattgatttttggctctctaccatgatttgtacatataggggtttgttggtcaggtcagccctctcctcttctgactcttattaaacatgactcctattatctctgtatggccttgcccttgccactatgcagccctcaactgtatgcaactcctctcacctggatatggctcctaagtgtgctgaacctcagcttttccacagccagtagctccattagctctagttccttgaagtccattccaaactctgtttctaattcatgtaggtttgaaaacagtggttttgcattgtgtacatacagtttgtatagttttcttcactgaactttagaactacatgatagttcttcatgcagcaccattaacagagatatatagctctgtctaccatgttcataagatgcagagtaactcacttctcaatcttagttttctgggtcctgccacatttttaagaaaggaatcctctcttgggatattcatctaaaaaaacaaaaaggcactagagacggcctgtatgacaatgtgatatctgaaaggcatatcagatttgctagtcttttcttcattcacatttctgtattaggctgaggtgctatccctggcgtcctctaccaagcaaagtgactttggtcaagtcatttcattgctcccagtctcagatccttcatctgttgatagagataaaaaccctgaccatgaaatgttgggagaatctaataaagtaatgtctgccaaagcacttggacatgatgtattcagttctctgaatagtagcattacacttgttcgctattggagggctcagttatatggggggtgttgtgacagcagagatactgttgtactcttgcacgtgttcctaagcccagcgtcctgagtgctacccaacatgtgcatcttggctccatggaaatccagcaggctggaaccactagcatccccagtagactgaggccattagtagtcctgcccaagaagagcagcttgtaaaagtaataccccagtgtagattctgggatcacatcttcctttaacatccagaataatagatgaccaaatcctgaagtaagtttagagcccacttcactatctctggaagtttttagctctctagtgggaggtttgagtttatctctttttcttgagtcagttccatctgtcgcttgcttctccactgacccttggttcttctcgcaatagcagatgtttcaaagtatgtatgaccagctctgaaagcagcttccaaggaggagctgtctgaaagttgcatgcacaggcagggtagtaaattagaatcaggatgggacaaatttgaaggcaggaaatcacatggctgcgaaagctgaggtgtgattgtgacaactatccccagtctcctagaaccataccctccacctggtgtgttgcagaaagctgaccaactgactaattttacatctcttttcatagggatgattttgctcgccattggttctagtaaatagtgctccacaggtatttgcagcatgccccagtgctcatccctgtaaggctgatgcctccttctttattattcttttccctgctgatcactccaagctcttttgcttgcttgtggtggttccatttttagtctttgtgaaagttgttaaacagactttgttgtagtaagatttgagatgtgttctgttggtacagagatggctttactgagtattattgccttaccctaagatcagtaacttatcttagtggagaaagtcaaatccatctagtttatttttagcagatatcttcactgaatggtgggaggatagtgcagattgctctgagtaggtcaaaagtaaacatgcagtgccaaggactaatttctcttgtggggcttttggggttcttggaatgtctaagaacatggtggagaattaatcagggatctcctgccctttgcctcccagctacttttgaagcatttcgattggtaaatgctagtttctgaatgcacatatcaaattgccaagtagcgccgatcctgagaggcagatgccttttgttgtttgaggattggtgcagcaagaagctccaactagaagctaagacccagaaaagcagtggtcacagacaatgggatgcagttgttgatgtgatcacagtttaagggctgttgtttgaactggctggcttctgcctgtgcatcccacttcgatacttttctctgacaagaaagaaagcaatcagtaggaatgtgttgatgagatcataaaatttaagatttgagaatgttaaaaggtgttcaattatgccagagtttgaccaaatgcaggctggaatagaaggactgaataatcagaagctatttagtgagtcacatccttttagggagcaaaagtatctaaggaataagatgggtgtgagttgggactaggtattgcttcaggtcacctgggtgccattcagcaattaagcatagccttaatggaagagaagcaaaagtgtagctggcagccacccctcctttcctcttcccagggcatttctctatttcatttaggcaggcactcgatacctcttgcctgtatattgcaacagatagcctcctagctgttcttcagcttcccatgccttccttctctggcctcttctctttccagcatttaacataaagtggtgccaggtacctctttctaaggcttagttctatcagcttcgtcctgtactcagactacgacagctaaggaacagaatctcccctccctagcttcttgtccataggctttccaataaactgagcagcctatgcccctctgttctccttcatgtgcgctcatttccagcagaactagaccccttacctcttgctgaacacaccctgaagttttctgcctctgatatatagcagtttacctaaatgtatttctccttcttgtgattttacttgtcttttgtcagtatcatctattttactaagcttcttttgacaccctaacaccaaatgaaagggatttacttcctcagaactcacattgtctgtgtgattgaacttctctcctggcttaaattcatgtgctcatgacttgtttgtctctctcagtggacagtaagctccttgagggccaggacctgtgccagatgcatgattgtcacattttgcctctgggccctacagaacccatgataaatgttgtagtggccttaccccaccagactccaaagcttgcaaatactttgagatcctgtgggagatgataaactgcattgctccaaattaatattttcctgatcctctccctcctcccaccctctgcttgcagagcttgcaaatactttgagatcctgtgggagatgataaactgcattgctccccttctcaggacttcagctttctggactacaaatcagggggtttgccaagtttgcttttcaaggccttggctagttctaggattctgacccaagtttccaggaagggtttgtgtttgtttgtgctctacttagatcccaaattgttcctctgcagcatgggcttttgttacctttgcttccttctttagacaaagagagagagcaagagatagcctctgctttttttgcatcttgacaccccagttctctcaatatttccagtgcctttctaatttataaccctggaaaccaagaatacactgtacacagtctttttttttttttttttttttttgagacagggtctccctctttcacccaggctggagtacagtgacatgaacatggctcactgaagcctcaacctcccgggctcaaacaatcctgctgcctcacttccccaagcctgctgggactgcagccgtgcactagcacacccggctaatttttgtaatttttgtagagatggggttttgccatgttgccaagactggtcttgaattcctgagctcaagtgatctgccccaccccagcctcccaaagtgttgggattacaggcgtgagccaccacactcggccttagatgcagtctcaatgcacgtttaacagcacacactggggcctatcggagggcagagggtgggaggagggagaggatcaggaaaatattaataactaattggtattaagcttactacctgagtgatgagataatctctacaacaaacccccatgacacaagtttacctatgtaacagacctgaaatgtacccgtgaatttaaaataagagtttgaaaaaaacacattgggtattgcttactacgtaacaggtattaatgcctgttatgtactaagcactccatgagtctttgctatttttgttatcattattaatagtcactttccagtaagacagacctgagttcaaatcctgactttatgatttactagtggtgtgtgactagtgatgtcaggttcttgatctatgggaatctctactggaaacttactttgcagatgcattgttagggttaagcaagttactttatgttaaaacagctgctgtggtcatggtgcttgacacattatagctcaaaaatgtagcttattattagtagtagttttatgtgcatttttatggtataggaacttgataaattcattcaaaagccaattttaagtgcctactgtatcctgggagctatgaaaagcaccttaataataatgttaaaagccaggtgcagcggcttacgcctgtagtctcagttacttgggtggctgaggtgggaggattgcttgaggagaagagttcaaggccgcagtgagttatgattgcaccattgcattccagcctgggtgacagaggtagatcccatcaataataataataatgatggtcacaaagatgatgttactattacctatcagtaacacttattgagcattttctctgccataggcaacttgaagagctctacaagtatcttttctttaaatccttaacaggcctaggagagaagtactattattatcttcattttatagatgatgagagcaaaccatagagaaattgaggaaatttcagatagttgctccaggatttcagttgagatgaagaaactgaggcatataaagctagtcaatggcagataaaaaaaaattgagtccaggtcttctgtctctaaaatccatcctttatatcagcccataaccattgaatgaagttaatcatgtggaggctgacatgggcataaacatgacatctgaagcatagttttcaccccttcataagagtccagttgggtaccacataaatgtggccacaagaaagttatgatacttaaaaatctcataaggataatagtattttttattcaagtcagttattttaaacagtgcaaaggactttagtatgtatgcagtccaggagtttccaactttgatttaccttttgaaataaattagagtctatgagccacctgatttcctgtgtgccaagatttacctggagtacttcagccacctgtcctcagctgcctcattgccttgcttcctcccactttctctccaacacacatgcgtgcacacacacatgcacacatgatttatcataatctgggtaaccacctgtcttagtccatttgggctgctataacaaaataccatacattgagtggtttagaaataacagaaatttgtttctcactgttccagaggctgaaaagtccaagatcaaggcactggaagatttaatgtctggtgagaccccactttctggctcatagatggtgccttctcactgtgtcctcacatggtggaaggattgagggagttctctgtggcctcttttataaggacactaatcctgttcataaggcctccaacctcatgacctaataacttcccaaaagccatgaacttcgaggctaggatttcaacatatgagttttgtggggatgcagacattcagactgtagcctcctcgatggagtgtgttccttgcttgtgtgtcactgtggaaaaaaaaatgtggaaaatcacagcagtcaaccttctcattttatccctgaattggagattgtgagaggggacatatcactggcagtcctttcaaagtttggtctacatctatctatgtatagtggccaaatttagtgtcaatgatcatttgttttgagtttttttttttttttttcttgcaagtaatgctgagtgaatccaactgtagctgactttgttgaatctgcctgggaaaactcttgttcccttgcatcagaagccccaccataaaattggccttggttcaaaattgattatttgcacagattgggatatgttaacaaatagaattccttctcctttctttcctgctcaagttattacttaccaagtcatcaaccgttctctgataggcaagaaacaaactgaactccttaatcttgtttgttctaaagcttaggaagtgattttgaatcactatatagggtttcactgctaagatgtgcaatgggtaaacccccagaggctgggatacagattcaaatcagatcattcgctccaaatgtatcagaactcctaacaatgtcatagctgcccagcatgttttcgaaaacctgccattttgcaggaataacatacttcacgtcagactccaaatggccgcatggatgtgttgcaaagctgaaaattaatgacatgaaacttaacaaggtgttccagaaggtccttgctgcctccctcatgtcaatgctcctctgattccaaataggagagttcactggcaactgtactgttcaactgtggagaaaaatttgaaagccacatgatcataggctttctcagaaattaatctatacaaagatcaagtaaggtataattttcttggctgttgatggaaatatgtttttgtccagcaaataaacaatctagctgggttttggaatcagggcagtgtaaggggcacagacacagaaactgctgtgttaatgatagtgcttttgagacccagataaaacctaggtcttcagctttcccaggaataaagtggtagggccgagaaggtgtggagcattactgagtcaatccaaaacccatcacctgcttctcacaactgaaataactatatcaaacaaggatgactttgctcaatataaccatcaaaacacatggcgtatgtacagtttatcgaaagattttgggttcacaaagcaaattctggaaaatggcatgaaggcagagaatctgatcaaagagtaaatatttatttaaaaaataattcttaaagaggcccagaaaaataaatgaagaaaagactagctgtagattatggtggaaagaatgctgaacagggacacttgaattctaaatctgttattttaacttacttctgtatttaagctttttgttctctcacctaagtttcttattcttttttttttttgacggagttttcactcttgttgcccaggctggaatgcaatggcgcgatctcggctcactgcaacctctgcctcccgggttcaagcgattctcctgcctcagcttcccaagtagctgggattacaggtgtgcaccgccacgcccggctaattttgtatttttactagagacggggtttctccatgttggtcaggctggtctcgaactcccgacttcaggtgatccacccgccttggcctcccaaagtgctgggattacaggcgtgagccactgcgcccagccagtttcttattctttaaaatgaactggctgagctgtttttcagttctgacgttctatgactatgataacaacgtgatgaaatctgcatattggttaataacatacatctctccccagcaaagtgaaaaggcttctgttaaaattttggtctagttgtgcaggtgtttacatgttggccacacaaaaacttaagaggcaaaaattttcacatgaataatcaagttacctgcacttagttggtgacttaatttttatttttttattaaagtgaaattcacgcaacacatattaaacatttttttccatttttaaatttctaattattatggatacataatacttgtattttattaatggggcacatgtgattttgatataagcatgtagtgtgttaatgatcaaatcagagtacttgcggtatccatcatctcaagcatttattattttattgcattgggaatatttcaactcttctagctattttgcaatatataataaaatagtgttaactgtttctaaatgtgcaattcagtggtatttaatacgttaacaatgttgtgcaaccatctgctctatctagttcccagacactttcatcacaccaaaaggaaacttcatacccatttaagtaatcactcctccttgtgctctttcttcctgaatggcataatttttaaaatttatattttgcctttatttatctgacacagtatgtttggggggcagtaggtaggtgcctgcctgtgcttactgggaagctcaaatctccctgaaaccagcacgtcagcctctgaaaccaagttttggctactttgagagacttagagactaagggctagggatgctatctgtcatgatactgaacagatacaagttcattgttttaaacaaattattaaaaacaaaaccctgaaagtttttcaactaagttcaaagaagaagtaaaagtcaactaagttcatgttatccaggcataatcaccatttcctgtaatatctttgggaatcttcctctgcattttaacatatatactatgtatttgcaaaagtaagatcatatggtacacacttattttatttacaaggtaaaaaattgttcaaattaatacaagataggtttataaaatagaaaatagaacatctgtttcccaatcttattttttgatggagagtacatttcagacatatttttgtgtcaataaatatagtttcagagcatcattttaattgctgcctagtagtctattgtatgtagatgttacagtttcctcaactaggcttttttttgacatttaggtaggtaccatttgtcagctatcataatgatgctacagcttgcacctaaatttgtgcctatatctatgattatttcctttgaacaaatttgaatatgtgacctttgctcatgatgataatgatgcaatataatgaaactaaggctaaaatgtagctgctcacattagagtcacctattttgcaaacacactttgggtggctctttttattttacatagcatacccacacccatcatttcatttaatactatcagtggctaatagctaatatttattggacacatatgtgccaggcattgtgctatgtgctttagagaaaggtaccttattcaatgttatttgttatgtactattattatttccattttagagatgaggagagtcaggaggctcagagacattatgtaaattgcccaaagcgcagtaagtggtaaagctaaaattttactttggtcttttgggttctagatccagtattattcctagtgtatgacaagtcctttttttgaattgtaaagtattctgagcctacatttgggcaagggatttagattccgcaccagttatcttggaaagatttaacagtaaggaagcaacatggtgttcgtagactgtgccccctccatttctagtctaggctggcttcctctggggatacctgcctatagttaatttctgtggaactgtaagtgtagttcttgtcatgctggatcctttcccaaagtaagactagagtggctgtggctaagacagcgaggtgtgatttatgaaagttcaaaaggggccaggagcagagattgggagaggcctcatttacattaagagttactgtgaattaggttctggggcaaagtgctcaaatgaatttatcattaaagagccaataaaaagtattaaaggacaaattggctgaatttcattggaccgttttattctgtgcagaggaacaaatgatagcttgtgctatttattttttaggaaaaagaactgtaaaataagatacacatcagcaagcccccaggaccaatgtttttctgggaataaagctggggactatgggaaggcagctaaggttcccattcatggactgaagtaattttggcactgggaatctttgcctgttttcaaggacatctgctaagtccccaaactgtgtcccggttggccttgatgcttcgcggctccactgacccagatcacagagctaaacaggcgaatgcaaagattatggacttaaagaggtcagagttgtgcaggtccttggagagcatctaaggagtgaactcctcaaattgactagtggggaaaccagggcctaggcaaggaaagggacttgtccaaggtgcccaaacaagtgactgccagagtgtcaaaagtttagtggtcacatttgcaatcttctgtatgttatattcaccaatgacatgtaggactaaatgaacgatttctcttccttctcattttctccctcctttccctcttctaccttctccactccttctcctcttccccattttctctttctcctcctcctgttttattttctttttctccattatcatattcataacaacatctctggtatgtatcacgtatgctagctaactaacaagctactgttacctccattatctcatttgatccttcatgtatcatggctgtagtgctcagaaactgaaaatcttaccctgatgcagaatgtgcaagccaacacaccagtcccccatctcggcaccccccgactgaaaaggctgactggcttcctgagcactgtgcagatcctgtatacaagccatggactctctccctgggatactttctttctttcttttttatttatttatttttttatttgagaaggagtctccgtcgccaggctggaatgcagtggcgggatctcggcttactgcaacctctgactccctggttcaagcagttctcctgcctcagcctcccgagtagctggaactacaggcgcatgccaccacgcccagctaatttttgtatttttagtagagacggggtttcaccatgttggccaggagggtctcaaatctcctgacctcctgatctgcctgcctcggcctcccaaagtgctgggattataggcgtgagccactgtgcccggccctccctgggatactttctataggtgtttgagggttaccacattctctggcataatctcagactcagtggcaaaaaaggaaggaagtcaagaagctttcctgtcattggatccaggtcttaaatcaagctttgcttgacaagcatacttcccatatttcctggctggcacttctctgttggaaaggcctcactcatcggcactctttagtcaagaccaggttctatctaaggcatcatcactcacatggaagcccagtttctgagcactggggcacgatacatgaagagtcaaatgagataatggatgtaataatagcttgttaattggatagcatacatggtacataccagagatgttatgaatatgagacgggagaaaaataaaatgaaataggaggaggagaaaaagaaagggaaagcagggaaagggaacatcaacttttaagaacctagactcctggggcattagatttctctccaaaaggtaagagggggaggagagagagagggagggagacagaaagcgagcactataagcatgcaaaacagaatttcacacatagtgagaaattcatgtttttctttccttgttcattttttcattcactcaggtgacattcattgagtgcctaataagtgcccagcactgcttttatctccatgatacagcattatcctcaaacatttatattctagtgagggagacagacagtaaacaaatagacctatattatattatcatgtaattgccataatgccataatgctatgaagaaaaatgaaacaggtgtagtaatttcctaggatggccataacaaattaccacaaattggatggcttaaaataatggaaattttttcgttcatggtactggagattagaaatctgaaatcaaggcatcattagggccatcttccctctcaaagctctcaggaatcctttcttgacttttcctagattctggtagttactggtaatcctttatgttttttcacttttgtctgcatcactctaatccctgtctctgtcttcacatgggcttctctgtgtgtgcctgtacgtcctcctctcgtcttacaaggactccagtcattggatatagagcccactttaatgcagcatgacctcatttaatttgattacctctgaaaagaccctctattttctaaataagatcacattctgatgttctacgtggacatgaagtttgggtggagggaggcattaataaactcactgcagatggggaaagagaagggataattatggttggtctttagatagaatggttaggaaaggcctttctgaagaggggacatttgaggagagaactgagagaagtggagccagccatgcggatatctgagggaacagcactctagacagaggaaaggctaaatgcagtggctgtcaatctgaagtgtgcttgttgtgctagaagagaaacagagatcagcacagctagagtgcggtgtgaaggcatggagtagagtggtagggaatgaggtcagaggaataaccagagatcagatcatacaggaccttaaagatcgggggaagcaatctgggtattatttcaaaggcagaaagaaaccactggaaacttttgagcaggagattgatgtaacctgacttcaatttgaaaatgatcactgtagttgttgtgtggacaacagtcagtcacagagcaagggtagtgtcctaggagcaaatttggagattattatagaaatctaggcaaaagatgatggtgtcttgaagtagtgtagtcatagtagaggtgatgaaaagtagtcagattagttacatcatttgaaaatagagatgaaaggatttagtgcaacacataagagagagagagagagaggaattaagaatggctccaaggtttctggtctgagcacactcagtggcgttacttactgagttggagaaaactgcaaagcgagagggtttgcaggaaaaaatcaagacttcagtttcagatgagtaaagagtgagatgcaaattagaatgcagatgcaggtggcaaataggtaattggatatacaggattggagtacaagggaaagactgggatggagaatataaatctggaagccatccatagagatatgagactggatgagatcataacgaagtgtagatggaaaagtgataaagtctgagcattctgttttgggttactctaacattaaaaggtcaggtgttaagaagaagccaacatagagatgagaaggagtggctgatgggtatagatataaaattaagagagtgagatatcctagaaaccaagaaaatatttcaggggtgaaggagtaatcaactctatgaatgctgcagagagttgtacaatataaaggtaaaaattttctcctagatatcacaacagggaggttggtgatcttggttagagtatttttagtagtgtagtggggatgaaagattgcttggcagggcgtggggggcatttcaaaagagaatgggaggaaacgaattggagcagtaagcatggatggacaactttttcaaagagttgttttctaaagtggaagggaaggataaggtggtggctggaggagggagaatgcgtagtcaaggaataggtttatattttttaaagatgggagttattgtaatgtgatgaggatgatgcagtggtatagacatgagagggagtaattacaggggcaaagtctttgaataattaagaaaggatgggagactgtattgtacagatgctgggtaaatgtggtagtgggaggatgtagaatgtcttttctaattgcttctatttcctcactgaaatcagaagcttggacatcagttgagacaaaggaagagggaaggataattaaaaaagggaaattatgaaataactatccaagagaatagatggcagacagcaccgatggcccacacttggggtatgaggccttcagtttaaatgagaacagacagcatggttgtgtgtttttctagccaaaataagctgcttgggagcaggcatgaagtcatcaaagggttggacttaactcaaatttgggttttgccaaagatacgtgacagaggaagacaggagcctgggaattgaggatgtatacaaacctcttcttggattcatcttcttcagcctcattaatgtctcctccttacctttttgtgccttctcttattttataacatgacagataatacttctacacaagtattgaatgtggagtatgttccacttgttacaaacaggtatggaagagagagtgaggaaatgacacagtcccagaagaagcacatgtatgttaccaagagagattggcatggaagaataaaaatttttgcctaaatgtcacagcaaggaggttggtgatcttggttagagtatttttagtagtgtagtgaggatgaaagatttcttggcagggcatgggggccttgtagaatatttaatattaagaaactttataacatgtattttggggaaaaactcactgtggttctactttgtgtgtgtgcgtgtgtgtgtgtgtgtgtggtaatattttctctattttggtcaatgtaaaaacctgatcatttgatgatgatgatgatgatgatgatggtgatgatgacggtgatgttgatagaagcaactaacatttgctgagtacttaccatgaagaaggcacttcactaagtgccttcatttgattcagtaatttatttaatcctcatgacagtcataagaattcagaaccattactcccattttcagataaggttaggtaatttatccagtgtatgactaacaacattcaaaattagattttgaacccagaacattatgattccatagtccacactcttaaccactcctgcattgcctttcagtgccaaagactttacatgttaaagttggtacacttgtccatctccctatcccttcagtagaactgtcccaatgtccagtctctttgctaagtgattgtgttagttgctagttggggcaaaggtgtgggtgaagttcagccccaaattcttcatcatttttgtgctcatatagggattctgaaagaagctagagggaggatggtgtttgtcctgcaaagctgttccagagacttgtgttctgggctcataatatatattctgaagacaaagcctttggggccattcctcttcttccttcatctctcagacctagttttatcttctgttttttcttgatccatggatattaggcaactgtcttgttctccatattgtgatcccgtctcttgcccctgccctctctataagctctcacctttgtctgagacctgctcctggctcccacttcatcaggcttggcgtgacaaattgccttcttatcatacttaatgccagcctgtaaaatagggtatgctttctgctcacatgctgtcatcatctcctatatccatctagatccaggaggcctatttcatcaacataaaatccacagaagcaacacacgctgcgaatcggtgctccatgtcagagctgatgaggatggattggtgaattctgtagatcacatctgtcctaagcagcaaattagctatgcttgaattcagctactacattttgcctgctgtgaacttgctttactcttctatgaaatgtattttgtagcagtgcagaagaaatacacaagattgattagagttggcacgatttgtgcatacttctgcagttattattgtagtagctgctttaaaagactaaaaagattctttcaccaattttgttcctctgtaaagtttcatttaaacgttagcgggtatatttatgtgtaaatcggatcagcttccaatgatagttccttattgttagcgttttgatgttctgtttgcctgagcagattgatttgccattatgagagaacgtttgaactgaaaaagtcctctgaactttgttcactaatcttatcaaagaaaatagaagcagaggatgtagacagaaacctgcaaattaaatttacttttccaattcaaatgtatttgatctgcatttgttatggaactgggacagtagttgcttcttgattgtgcaatagcactgaagtttagaatatttttcaaagtcttaacaaattcagtgggggaaaatcagcaatgttaactgaaaatagcatctacccttttgtattaagttagtacagcatgtagatcatgtcattgtccttgtactcccatctatcaggcttagtgagcactgtgcaatggtaccataaatggctggaccatctctgctatgaggtgacagattgtttagggcaagccgctggcaacagaagtgttagcatgcttgatttgcagcgaagtgagggcccagtatcttctgcttgattcacatggatgggttatttcacatagctttactcagatttggagaactgtgctaatggcctgagcagtttgcttccttcttccctccccatcactttctctctctctcatttaaatcattccgaatttctgactcaagtaggcatatgaatcagaatcactgtggaaactaaacaaacaaacaaacaaaaatccaccacaagcttaagctctggctctggagatgttgcttgaatagctcaagtaggtgtaagacagtagaaaagtggaggacaaatggactttggtctgactcctgattccatcacttgctagtcgtgtgcccttgggcaatcatttattttctcctagcctcatcacttttttttcatttttcaaatgggtaacacgatagccctgctttcattaggttatgggaggagtgaatgagaaaatgcaaagtgactagtaatcactaaaaaatatacttagtatttgagtgcttcctatgattcactcttatgtggcaatcaggcttctgcattttaagtttacacattatctgcaggtcaatccccactgagaatcactacacttaaaagattcttaaaagctaagtatatgaagcacttgtttcaagtctgtgttcaggggctggttccaattttatgctatggtgccacctcataaaagtatatatgtatgtgtgtagctactggatatttatgctgtgcctggcaccgtgctaggtgctgaggacccagagatcatgaatcattgtccctaaccctaagaatgaaattgcctaataccacattctactctgtaataaagtggcacagtattgcaaatagagtataacaaaaattccctgtgacattcaaaggcgaattttatttcaaacaaacctaagcttctccaaacagaattgtcttagaaactaatcaataacaaacacttcactggtaatctttattttagttatcttccattggcttttcaaatagcgatacattttattaaagcttaactggcatttattgaatgctaccaaggggtctgatggcaagtggagtttactagaaagcagtgacatcaatactgaatcaatgcacttgaacggaagctgtgccctaagtgccattcagcatcacactgtcccattcttttgcagaacactgaattgatccccaaaacagtgcaggtgcagtgatacaggacaaacagccctgcggttccccaaaacccacctcttcaaatctgaagagaacattctttcttttctttgtcatcaaataaacacacctgtactaggtgctggtttctccctggaccgtagtgtagtgggagatagactgaaatacctcctcttatacttctgggcaaacctcagatacataatttgtgcatgggccaaatggccctcaagatattgggttccctaatagagctaccaaaagatcagagaatcataaggtaaggcactgagaaaaaatgaaactttccttctttcccaacgtcaaggtgatagccagattccagcctcagttgagcgatttttttttcagttttccagtgtttagttgtgtgcattattataactcagaaacattatggtagtatagcgttgcattttttcagatttctatttagtattcttatttcactggtcaatgaaatgacagaagagaaaatatcagctcattaaaattaaaaagacaccacccactaatgttgattgctttaaagcaaattaatctctatacatgcagaaggtgctatggttccctgttttgtgtgtgtgtgtgtttgttttttttacctttttagatctggtgaatgcgaaaaccagatactcttgaaagtaagtaagtatccaaataagtgcaaattgcacttccataccagtgtatttactccagtgattgcatggattttatttgaccatgtgataattagagcacattcaaatcacaaattcccattttacactttttgagtttttttaaaccagaatgcactaatggcctacagagtacttcagtgttaggtgatcagagaaaccatttatatgatgttcttgctaatggggaactttaaatgtggggaaggctatcgtcatgcatggaggctctaaatggccagaaaagggaaccagtataatcatcagagagcagttttacatgtgggtgagttgaatgattgttatagattcaagctatataaatgaaggtactttaagaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaatacacatacacagacacacatacacacaatttgctattggtttggtatggacaaattaatgtacagataatatacaggtttaaaaattaaaatacccattctgcactaatggcaaatgggaaaatagacgggaaaagagaggcaggtttagcctgtggacaagttgagagccttctttttctcctccatttctttttatttcagttccttctttcatctgtgcctaagcccactctgagccaggtgaagagaatggactcataaaaatgttgactctgaggtgtggacaaggcaagtgttacctttcccacaataggcttataaggattttgagagggatatatggagacagccattcttattggatggaacaatatcctgatggtgacattttaagcattagcaggtaattgcctcttctgtgtatgaggaaagctctccctggacaaagatcagttgccaatgtgtgtttagatgaaactgagaatagtccccactgagccaccagtgggatcgggtagtgcctgttgtgaggagaccactggccagacaagttggggacaaaggaacagaggagtggagaaaagcagaatgggaagatagagtctgggtaatgggagagaatagggcggggatgaatccctgggttcaaatcctggactactacttaactaacgatcattttgtagcttaatacctagtcaggaagtgagttgttaatcaagttattcatatgttcaccaaatagctattgaacttactatattacaaacatggtaggtgctatgaggaaaaagtacatgtcacgagagacctgatctagtctggggcatcagcgaacttcactgatggagcttcacattctgagacagtgaaactcgagttgaggtataaacaaggaatatgaaaaatgaagagttatttagacaagggtatgtgaagggaaaattcctgaaggaaggaagagcaggcttaagattcctaaggcataacaagagaatacagtatgttctaatgcactgcatgaaagccagcatgtctggagcacagcacataaaagtggagaaagctgaggctgaggagttgagaagggggcggagacttccaggtctacctgtccatggtaaagcacttgaacattagtgtaaggacaatgggaagccattggcaggttttatggaagatggtgttttaaatagatgtttctggaagtgtaaggtggacaatggattaaagtagacaccacactgaaggcatggtgactatttaggcagctgttagcagcagtctggacaaggtatgatggtttcttggactaaggtagaatcaaggagaaaaatgaatggattgtgtgaccttgaacaagtagcttcacctctctgagcctaattaagcttattttctttcaggtttggcctaacatatctaatgaatacactgggttttgcctctcagattatctgctgcgcataacctcccttatacgtgttaactattcaaaaaaaagttttatgtccacacttgatttatgaatgaaacatagaactagcttggagtctttagaatttattcagaattgtattaaattacttcctttaggctgctggtctggatgagttatacatttttgtaataaaaattggctttcaaatgaataaaagaacactgacatgccaccacacatgttattcctctcatcctaaagtactgaacaaaaggaccaatagaagactccccagcattcagcagtaattaaatacagatacacttatttaggaaactggtaacaggaaagagaaatttagcgccagctatctgagaaaagacagcccaaggactacattttgttctgagagttacaaacacttccaaacagaattaaaaagaaagtgcctttcagggctataacatctttccatacaactttgaaacttggcaaacatttcttgccagctcatcacactaaaccctgtaataattttgcacggtgtccaattgtgataggaaactagtagctctgtgagtgaagatttctattctgggtatccaaataacattcccagtggagaggagaaaaacactgaaattagatgcctatgtctttcaaatggttcagttccatttgattgatacgtgttgtggtacatgttctctgggcaagggcttgggctagatatcttcaaagaaggtagtcatggggctgtccaatcacttccttatcccacttgactaagcaagaatccttttgtctaataggaaggctaaagttagaaaccagggatctgtaacacaagaaagagagatataattaccttaacaccttaagaaagggaaaagagtgagtgaaataggggtgattcaaaggctaatgtttattaaaatcttctgtacaccacctactttaacctcattttatcctttgggcttcataacagctcttatgatattattatttttattattatcccttactcacaactgagaaaactggggtttccttagttgtgaagcttaagcgacttgtccaaagtcattccctgctctatctgatttcaaaagatatgctctttgcactgtactgggaagcctaagccaagtgttcgtgagttttgtagagaaaagtatagaaaactcaaattacaaaccccatggggaaatggagggagcaatgtgagacacagaaaaggggggggggaaaaacagctccaaactagaaaaaataaaacaatacaatgaaacgttgagacgattaactagataaaggaaggattagaaatgctaatgagagaaagtatacgatgacaggtagatttgaaaagaaataaatataacttctagaaaaaaatgatgattgaaattttaaaagggaaggtcaaaataatatttgaagaaatcacgcaaaatgcaacacagaaacataaaaagatacaaaagaggttcaaggacatggaagtagaatgaggaggcccagtataaatctaagaaatgttccagaaggaaagaatcaagaaaatcttgaaagtcaatattcaaatagataacagctccaaattttctagaattgaagaaagacttggatactcagttcaaaggagcccattaaatcctaagcagagtaacaaaaacaaataaacctagacatattgtagtgaaactgcaaagccctgaaaaagaaaatcttaaaagtcagagagaaaagagatgacctattagaagattgtaagttagaagacagtggacctgatatcagcaacaataaaattatcttccaataggtgagaaaaaatagttattaacgtagaactttatatccagttaaagtcactgtattagtcttctaaggctgtcataacaaaataccacatcttgggtggcttaaacaacagaaatttattttctcatagttctggaggctagaagtccaagatcaaggtgccatcagagagggtgtctggtaaagtctccctttctgacttgcagaaggcttcctattgctgtgtcttcacatggactttcttccgtgtgtgtgtgtgtgtgtgtgtgtgtgtgtgtagagagagagagagagatatttctgatttctgttctctcttccttttcttataaggacaccagtgctattggattagggccccacttttatgaactcatttaaccttaattacctccccaaagggcctatatccaaaatagttacattacaagttagggcttcagcatatgaattttggggagggggcacaattggttccgaaacatcactgttgaagcaggagagaaaagagaaaaataaaggcttttttttttttttttttttttgagatggaatctcgctctgtggctggagtgcagtggcacaatctcggttcactgcaacctccacctcctgggttcaagtgattctcctgcctcagcctcccgagtagctgagactacaggtgcctgtcactgcgcccagctaatttttgtaattttagtagagatggggtttcaccatgttggccaggatggtcttgatctcttaaccttgtgatctgccagcctcggcctccctaagtgctgggattacaggggtgagccaccgcatccagccaataaaggcattttgagatgaaaaagctggagaaattctatgaataacaggtccttaataaaaagtactattatagggtggactgtaatggaaatttattaaaacaaagaaagtgtgagttgtaagaagcaatggggaccagtgttattgataaagtacataaatcttaataagcatgggctgcataaacaacaataatcattactttaagaaggttgaaataagaaggaataaaactcttggacaacagtaacatggaagatgaagagaggtaataagatttaaaacattctgaatctttgcgttttgtaagaggaagatgaagatattggtcaacttcatgcttttcaaagttaagtattatgtaaaaaacttgtgtgtaccactaaaaggatggtaataaaacataaaacttccaaaccaatagaaggcataaacgaaaaaatgaaaattgtcaataaaatggtagacagagaagtagagacaacacggtaaatacaaaactcaaaattaggtcataggaataatcaggaattataataagtatagataaattacttggtttaaagataaagattctcagtgttggattttcttttttattattattatactttaaattatggggtacatgtgcagaatgagcaggtttgttacataggtatatacgtgccatggtggtttgctgcactcatcaactcgtcatctacattgggtagttctcctaatgctatccctcctccaccccccagtaggcctcagtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgtaaaggacatgaactcatccttttatatggccgcatagtattccatagtgtatatgtgccacattttcttcattttctttatccactctatcattgatgggcatttgtgttggtttcacgtctttcctattgtgaacagtgccacagtaaacatatgtgtgcatgtgtctttatagcagaatgatttgtaatcctttgggtatacacccagtaatgggattggtgggtcaaatagtatttctggttctagatccttgaggaatctccacactgtcttccacaatgattgaactaatttacactcccaccaacagtgtaaaagcattcctatttcttcacatcctctccagcctctgttgtttcctgaatttttaatgatcgccattctaactggcgtgagatggtatctcattgtggttttgatttgcgtttctctaatgaccagtgatgatgagctttttttcatgtttgttggctgcataaatctcttcttttgagaattgtctgttcatatccttcatccactttttgatggggttattcgtttttttcttgtaaatttgtttaaattttttgtagatcctggatgttagccctttgtcagatggatagattgcaaattttttctcccattgtaggttgcctgttcactctgatgatagtttcttttgctgtgcagaagctctttagtttaattagatcccacttgtcaattttggcttttgttgccattgcttttggtgttttagtcatgaagactttgcccatgcctatgtcctgaatggtattgcctaggttttcttctagagtttttatggttttaggtcttatgtttaagtctttaatccattttgagttattttttgtataaggtgtaaggaagggatccagtttcagttttctgcatatggctagccagttttcctaatgccatttattaaatagggaatcctttccccatttcttgttgttgtcaggtttgtcaaagatcagatggttgtagatgtgtgttgttatttctgaggcctctgttctgttccattggtctatatttctgttttcgtgccagtaccatgctgttttggttactgtagccttgtagtatagtgtgaagtcacgtagcgtgatgcctccagctttgttcttttggcttaggattgtcttggctacacaagcactgttttggttccatatgaaatttaaagtagtttttttttttaaattatactttaagttttagggtacatgtgcgcattgagcaggttagttacctatgtatacatgtgccatgctggggcgctgcacccacgaactcgtcatctagcattaggtatatctcccaatgctatccctcccccctccccccaccccccaccagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttccagttctagatccctgaggaattgccacactgacttccacaatggttgaactagttgacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatgatgagcattttttcatgtgttctttggctgcataaaatcaatgtacaaaaatcacaagcattcttatacaccaacaacagacaaacagagagtcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaacatcgtgaaaatggccatactgcccaaggtaatgtacagattcaatgccatccccatcgagctaccaatgcctttcttcacagaattggaaaaaactactttaaagttcatatggaaccaaaaaagagcccgcatcgccaagtcaatcctaagccaaaggaacaaagctggaggcatcacactacctgacttcaaactatactacaaggctacagtaaccaaaacagcatggtactggtaccaaaacagagatatagatccatggaacagaacagagccctcagaaataacgcagcatatctacaactatctgatctttgacaaacctgagaaaaacaagcaacggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcatagcaaaagaaactaccatcagagtgaacaggcaacctacaaaatgggagaaaattttcacagcctactcatctgacaaagggctaatatccagaatctacaatgaactccaacaaatttacaagaaaaaaacaaacaaccccatcaaaaagtgggcaaaggaaatgaacagacacttctctaaagtagttttattcaattctgtgaagaaagtcaatggtagcttgatggggatagcagttaatctataaattactttgggatatatggccattttcacgatatcgattcttcctatccatgagcatggaatgtttttccatttgtttgtgtcctcttttatttcgttgagcagtggtttgtagttctccctgaagaggtccttcttgtcccttgtaagttgtattactaagtattttattcttttagtagcaattgtgaatgggacttcactcatgatttggctctctgtttgtctattattggtgtgtaggaatgtttgtgatttttgcacattgattttgtatcctgacactttgctgaatttgcttatcaacttaaggagattttgggctgagacgatggcattgtctaaatatacaatcatgtcatctgcaaacagggacaatttgacttcctcttttcctaattgaataccctttatttctttctcttgccttattgccctggccagaacttccaatactatgttgaataggagtggtgagagagggcatccttgtcttgtgctggttttcaaagggaatgcttccagtttttgcccattcagtatgacattggctgtgggtttgtcataaatagctcttattattttgcaattatgttccatcagtacctagtttattgagagtttttagcatgaagaggtgttcaattttatcgaaggccttttctgcatctattgagataattgtgtggtttttgtccttggttctgtttatgtgatggattatgtttattgatttgtgtatgttgaaccagccttgcatccgagggatgaagccgacttgatcgtgatggataagctttttgatgtgctgctggatttggtttgccagtattttattgaggattttcgcatggatgttcatcagggatattggcctgaaatttgctttttttttttggttgtgtctctgccaggctttggtatcaggatgatgctggcctcataaaatgatttaggaaggagtccttctttttctatcatttggaatagtttcagaaggaatggtatcagctcctttttgtacctctggtagaattcggctgtgaatccatctggccctcgacgttttggttggtaggctactagttactgcctagacttcagaagttgttactggtctattcagggattcaatatgtgtccaggaatttatccatttcttctagattttctagtttattcgtgtagaggtgtttatagtattctctgatggtagtttgtatttctgtgggatcagtggtgatacccctttatcatttttcgttgtgtctatttgattcttatctctttccttctttattagtctgggtagtggtctatatattttgttgaccttttcaaaaaaccagctcctggattcgtttttttgtgtctctatcgccttcagttctgctctgatcttagttatttcttctcttctgctagcttttgaatgtgtttgctcttccttctctagttcttttaattgtgatcttcggatgttgattttagatccttcctgctttctctcgtgggcatttagtgctacaaatttccttctaaacactgttttaaatgtgtcccagagattctagtatgttgtgtctttgttctcattggtttcaaagaacatctttatttctgtcttcatttcattatttacccagtagtcattcaggagctggttgttcagtttccatgtagttgtgtggttttgggtgagtttcttaatcctgagttttaatttgattgcactgttgtctgagagactgtttgttatgacttccattcttttgcacttcctgaggagtgttttacttccaattatgtgggcaattttagaataagtgcgatgtggtgctgagaagaatgtatattctgttgagttagggtgcagagttctgtagatgtctgttaggtctgcttggttcagagctgaattcaagtcctggatatccttgttaattttctgtctcgttgatctgtctaatattgagtcgggtgttaaagtcccccattattaatgtgtgggagtctcagtctctttgtaggtctctaagaacttgctttatgaatctgggtactcccgttttgggtgcatatgtatttaggatagttagctcttctggttgtattgatccctttaccattatgtaatgcccttctttgtgtcttttgatctttgttggtttaaagtctgttttatgagagatgattgcaacccccctttcttttttctttttcttttttttttttttgctttccgtttgcttggtaaatattcctccatccctttattttgagcctatgtgtgtctttgcacatgagatgggtctcctgagtatagcacatcaatgggtcttgactctttatccaattttccagtgtgtgtcttttaattggggcatttagcccatttacatttaaggttaatattgttatgtgtgaatttgatcctgtcattatgatgttagttggttattttgcccattagttgatgtagtttcttcatagtgtcaatgatctttacagtttggtatgtttttgtagtggctggaactgattgttcctttccatgtttagtgcttccttcaggagctcttgtaaggcaggcctgttggtgataacatctcaatgcaaggaagctaacaaccttgaaaaaaagttagaggaattgctaactagaataaccagtttagagaagaacataaatgacctgatggatctgaaaaacactgcatgagaacttcatgaagcatacacaagtatcaatagccaaattgatcaagaggaagaaaggatatgagagattgaagatcaacttaatgaaataaagtgagaagacaagattagagaaaaaagaatgaaaagaaacgaacaaagcctcaaataaatttgggactatgtgaaaagaccaaatctacatttgattggtgttcctgaaagtgacagggagaatggaaccaagttggaaaacactcttcagcatattatccagaacttccccaacctagtaagacaggccaacattcaaattcaggaaatacagagaacaccacaaagatattccttgagaagagcaaccccaagacacataatcatcagattcaccaaggttgaaatgaaggaaaaaatgttaagatcagccagagagaaaggtcgggttacccacagtgttgtattttataaagaactctgctctatggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaaaaaagaaaaaaaaagaactctgctctatgcttattaaactggacattactaaaacataatgacagagaaatgttgaaagtaaatagatgaaaaaataaacaccagacaaatattaacttaaaaattttggtttaggcaatagttgacaaaatatatattaatgaccaaagcatcattaaaaataaagaaggacattacttaatgatacaatgaataatttcatacacaaaataaccatcctgaacctggttcatctaataacataccttcaaaatatatgcagcagaaattgacagaattataaggagaagttgatgagtacacagtcatactggggaattttaacatactgtactcgtataaactgatagatcaagcaaacaagtattgagggtatggaagatttgaataacaaaatggttaaatctgatccaatggacctgtatacagccctgcacccaacaataaggtaatacaaattcttttctaacaaatagggaacatgttcaaaaatttaccttttactgcatcctgaagaaaatctgtagtaccaaaagccagtattctatagaccagattatttgataaagatgcaatatagtgtgaaatccacaactataaactagattataggagaaaacaaaaccttattgtcaactcagtaggtacataaaacactctataaatttcgaaaaataaacattaagccacctgacaaactggaaatagatccttcacctgataaaggttatctagcaaaatcctatagccaacattatacttgaacttgaaatactagatgtccctttcaagtcaggaagaagactgataagaaaacctctcaccactatttttattgggcattataattgccgtcctaactaattataaggcaaagaaaaatgtaaggtcaaaaatatattgttagttttcacagatggtatgttttctacacagataatgtaagagagcatgtagacagactaacatagagttcaaccagtcttctgggtatgggatcaatatgtaaaaatccatagtcctcctctataatagcaagaaacaagaagaaaatgttataaaaacattttctgacaacagatatggcatccataatcatgcactgctgtctctcatcttacttctgactttctttcaggttttaagttgtttctgcaagatttgttacctccttcttccctgccacaatatgcttgagctatgaggttttctcttattttttccagaccctctaaatagcagttaaccaatttaaagcaaaaaatacaaattaaggtgaacaaggtagttgagaagaacttagagaatatccctcagtcatagttcctctttcaagtatttagtggctttgatttggctactgctatggaaattgaatatcaaagtgaaaatgctgatttttctggtaccggcttaagcaaaattcaacttattcctatctacctaagtaaaggatcccccactagggattgtgtgcccccctcttagtgtattcaagcaagaagtccatctagttactttccctttaaaaaccagtcccattgaggaaattgaaaaaggtaaaaataaatggaaagatacctagtgttcatggactagaagaattaatattaaaaggtccatgctacctaagatgatttacagattcattgcaatccctgtcagagtaccagtggcattcttcactgaagtagaaataacaatcctaaaatttgtgcggaatcatagaagaccccagatagccaaagaaattttgagcaaaaagaaggaagctggaggtatcacactaccttacttcaaaatatactataaagttacagtaatcaaaatagcattgtcctgacacacagactagtgggacagaatagagagcctagaaataaatccatgcatttacaaccaattcatttttgataaaggagccaagaacacacaatgaggaagggacagtctttaataaatgttgttgggaaaactgggtatccacatgcaaaaaaatgaaacaagatctgtagcttacacctatacaaaaacaactcaaaatggattaaagatttaaatgtaatactccaaaccacgaaactactagaggaaaacatgggggaaagctccgtgacattggcctgggaaatgatttttttggataagaccaaaaaagaacagacagcaaaagaaaaactagacaaatggaattacataaaactaaaaagcttctgcacagcaaaagaaacaatagggtgaagagacaaactatatatgggggaaatattttcaaactatacatttattaaggtgtaaatgttcaaaatatataaggagctcagagaacgcaatagcaagaagacaagtaacctgattttaaaatgggcaagggacttgaatagtcatttctcaagtgaagacatacaaacggccaacaggtatatgaaaaaaacactcaacatgactaatcaacagggaaatgcaccttaaaaccacaataagataccacttcataccctttactgtggctattatcaaaaaaacaaaagttaataagagttggcaaggatatgggcaaaagggaacccttgtaccctgttggttgtgcatcttagttcattttctgtttctgtggctgaatacctgagactcagtaatttattttaaaaaaaaataagtttatttattgcaattctggaggctggaaagtccaaggtaggtgggctgcatctaatgagagcctcatgctacatcataatattgtggatggcatcacatggtggagtgcatgtgagagtgggcatgtgcaaaagagacaaaacatgaggagtgacctcgctttataacagcattctctctgggtaactaatgtagtgccataagagtcagaactcactcactcatttgagactgcattaatcccctcatgagggtgaatccctcataacccaaatgccttttgaagctcccactaccccttaacacagttacattgggcatcaatcctcaacatgagttttggtaggagcaaaccatattgaaaccatagcagtgggaatgtaaattagtacagccacccaggaatattggtgaagatttagaaaaagatcatggatgattgtagacataaatatttaggtagctgcagagcctgttggagagtcaattgtagaggacagcagttatcttgaacctgcagattaatgtgatacaaagtttgtgaaaggtagttcttatatattaagttctgaattactaaagaatatgaaactatatctaaaatgaggaaaatggtgaagaagctgcattgtctataaagaagagattttaaaaaatgaaaaatttaatggaaaatagggacagaaggactagaaatatagaatagttggaagggaatacaaatgcaaaacaaagtaaattgtgaaaagaagaagcactttatatagaaaaaaaaacagaaaaagtatgtttgcatgtgcatgtgtgtgtctgtctttgtgtgtaaataatatgttctccaaacccagagccttctaatgagaaaaaagttactttgaacaagtatatacgttaaatgaaaattaagcaccaacacatattctaaagaataaaaagaaaaaacttgcatatatgattaccacaatggagaggagtcatatgcaggaaaagtagaagcttttataggaaaaatatcatttctgaaatatatatattgaagaaacaatgtcaaacaaaccaaaaagcagtctgtgaacacattaggaattgccctactttgttaaatggaatgacaaaattgactaatatttggtgagctcagggtgtctgctgctttcaagagcataagatctgtatcgttagctagttatttaatttatagaaatatactagaattagaatttatttgcaagagaaaatgctaaattgaagatggaaaactcccattcactatagcagcaaaacccatattagatctagaaatatacctcacaaaagatatgcaagatatgtaagtacatattatgagattttattgaagaacataaacaataatataaatataaataatagaagaaatatgccattttagtgatttggaaggctcattgtcataaaggaattaattctccacagattaacatatgatccaaggtccccaagcttactagtaatgagggaaatgtacattaaattcaaaataattcacaaccatcaaattagtatatattaaaaagcagaataataccaagtggtgatatcccaaagatgaaaggaattgggacttttgagggactatcaatttatacacctgccttggacagcatgtggcaacacctagcaaagtcaaagatatgcacaccttattataatcccaactcccacttctagatattttccatggagaaatcctggcatgtgtatacaggagacataaacaagaatgttcatttccacagtataaaattaatgtccaacatatgggaatggattaatactatcaatagcagcatgttttaaaatggaaggctatatggcagtttaaagtagctaatcacatccatatacttctacaaaaatgaatctggaaaatagtgttgagtgtgcaaaagaatttagaaaacattatgttccatacatttatgcaaaaggacaggaaaattggtcatgcctagagggtctctcagggcttttgtgtattgggccccacaaaaccgaggaaagttctctgaggagattgttggaaaagttcagtactgtctcctcgtgcctgacaaacctgaagcagtgaagcagagaggtcctcctggccttttttacttagagaatattctctctctctctctctctctcttttttttttaagaacattcttcactttatcattggagaaaagcctggtgttaagaccatctattattgtggcagtgactcaggtatactgtctggtggctctctgccaaagagagttgaggggtcaaatgactaaggtttctagattaaaaggacgagtttacaagctgaaccagaggaacttaaattgtgtttttttttctctctcttttttacgcatcactgaaaactttttgaaagaaaaagttcttagtggttattctaatcacctagcttttggttggtttttgttaaagattagaacgtcacttctcaaaattcagcacaattttcatgctttgggccataataataatgaaagtgatactaaaagacttttttctttctccacccccttttctttcaatctcagaacacaaaagatgaaggcagttttgaagagttaactttttggttgagtaatccccttgaatgcaatgtaactttaaaagagagaaaaagggaaggctagcagagatcaaatcaggacctcatggctacccaggctcctgtcaccatacgtaggtggtaaagttaggtggtagggttcatgggtcctggggtttgatctgaaatctcctctgcatatacgaaagagcatggctgaattatgtattcatttggaactttttctcttcattccaggaacctgcaactattataatacatttgttgatgtgtaactttgtgctaataaacagttctgatgcaattattgatttacagattttttcatcttactttagtatgttcacacattatgttgagaatcagtgtgtacagatactattttaatattatagagttaatggtcaattctaacaactgatatagaaaattggacctggtcctctgtctaaaaaaggacattttactcatttatatgactaaattgtgactgtggaggtttatgagtcagtatttgttaaataaatggattgatggatgggcagaaggaaggaagaattgaaggaagaaaggaagaacagacagaacagacagatggaaaggagaaatctgcttgaaaatagctttcatgaagaagatattcactttataggaacattgtcttttatatttaaaatatctgtcctcttactttggatacccagagtgccagccacaggatgcttgctatttatgatcttgaaaatgtttgaagcccttccagggagtaagggaagaaaatcacatcaaagctacactgcgccttttccttttctggttttgtgttcaaacatagcattcaagacgatgcaggtatttgattgtgcagagttaatattcccccagaaaatcaaaatagctgaattataaatagcctctttagattttttagtatagttctttaggagaatgacattcacacaaaaaagtgcacagatcctaagtgtatatctcatcaaatcttcacgaattggagaaaccatagtaatcagcacccatataaagaaagataacattaacagcaccccagaatttcttctgtccttttcttctaaaccttatttctcaccaaaaggttaagtgctataacttttaatatcattaatttgatttccctattctggatattcatataaatggcatcaaacaatatgcagctcttgtgactttcttctttcagttagcatatcgttttcaaggctcatccatgttgtgacatgtatcggtaatcattcattcttactgccaaataatatttcattgtatggatataccaaaatatttgtacccattcatcagttgatggagatttcagctttttctactttgtggtggttatgaataattgtgctatgaacatttatgtacaagtttctgtgtggacatatgttttcaattattttgggtacacgttttctctgggtatacattccatttcttttgggtatatacctggtagtggaatttctgggtcatatgcaaaactgttttcaaagtgacggcaccattttaaatttgtattagtaatgtataagtgtttcacttgtttcacatccttgccaacactccgtatggtcagtgtctttaattttagccattctggtggaaaagtttgtttttttttttcttcttgacaggtttttatataatgttgtgatactcagaaaataatactgataccaacttctataaattaactaatcttaagtcatttcctatccagggatttaattggagcgacaagtattttcctgtcatttctaaaatatgtggacaaggccttcaagatttagctcagatgccccttcttatagaatctttgcatccaagttctgggagggcattagaggtcatctacccaatcccatcattttatagatgagacagttgaagctcagggaagggaatggacatgaccaggcaacatgggcctagtgggcaagtctcctgactttagtccatggttctttctgtctccccagacagctttgtctactcatctttgcttctccttcgctgctaatttgaagagattgaaattcatctttgacaggaaaaaagttgtaagtttctagggcttaaattgaacatcaaagaagcagctctcctcccattgaaggctcgcatgctccatcactgaaaactactatcatttaagccagagaaagaaaacttaaagtgacttttcagcaaataccatttttaatacacacataatatcttctgttttatactctgatcatgattaagaatttcaaatagctcaggaagaattaaggagatttacacccacattattactcataaccacttagagcaaagaaggaaatcttttaaaaggatgtttattgctttcataccaaatgagaatctgaattaaaatgattcctagcacagtctttcgagttgaaagtacattcagccgttttcaaaatcccttgtaataacaacaatgcttggtaatttcatggagtttgtattttttcaaaggagattagggtaaatgctgtaaacatgaacttcctaatccttattttgtgatgactgccctgggccggtcttgctatccttggtcctcagatggagatgctaacacagagtggctgtccaggtttcaaggtttgatctcttggctcactgtgaatttacttcaagtgggagaaccttagttcttcagtaattatctaaccctcagttcctgagctgtaaaatatgaggattatatacccatttctgaggattaatttgtgtaaaacacgtagtactagtaggtgttccttatatggttggtacttttagattctttgctggagaaggctgttgtctaggaacaaaagtggcaggctttggggattccccagacacttatattcattcattaatatattgagaaagcaaagattggttgcttcctaaccctgtatgagaggacttcaagaagttcatgaaaaatatgtattataaaaaattgcacatgaatttctatttatttttgcaccaaaataaactcatactaacttggtataacatatctgaacaggacctagttttgaggcactaagaaagataagacattagtttgaaaagagcccttatcacagcaacatgaattctgctagaattgaagcaaaaataaacataaaattcatcttgaagattggtggaaaaatagtgaaatcactgatgctttataaaaagcttatggggcaatgccccaaaggaatcagcagtttacaaatggataacttgtttaagaagggataagacgatgttgaagatgaagcctgaagcggcagaccatccatatcaatttgtgaggaaaaaaatcatcttattcatgccttaactgaagaggactgacgattaacagcagaaactatagctaacaccatagacatctcaatttgttcattttacacaattctgagtgaaaaattaaagttgagcaaactctccactccatgggtgccacacccattgcatccagatcagctgcagataagagcagagctttcaatggaaattttaaacaagtagattcaagattctgaagcatttcttcaaagaagcataacaggagataaaacctggcttgaccagtacaatcttgaagacaaagtacaatcaaagcaatgactacaacataatactgaatggggaaaagttgaaagcattccctctgagaactggaacaagacaaggatgcccactctcaccactcctcttctacatagtactggaattcctagccagagcaatcagacaagagaaagaaataaagggcatccaaattagtaaagaggtagtcagactgtcactgctgacaatatgattgtttacctcgaaaaccctaaagactcctccaaaaagctcctagaactaataaaagaattcagcaaactttccggatacaagattaacatacacaaatcagtagctcttctatacaccaacagcgaccaagcggaggatcaaatcaagaactcaaccccttttacaatagctgcaaaatacaatacaatacaatacaatacaatacaatacaacacaacacaacacaacacaacacaacacaacacaacacttaggaatatacctaaccaaggaggttaaagacctccttgaaggaaaactacaaaggaagactacaaaatgctggaaagaaaactacaaggaaaactacaaaatgctgctgaaagaaatcatagacaacacaaacaaatggaaacacatcccattctcataaatgggtagaatcaatattgtttaaatgaccacactgccaaaagcaatctacaaatttaatgcaattcccattaaaataccaccatcattcttcacagaactagaaaataaacaatcctaaaattcatatgggaccaaaaaaagagtacacatagccaaaacaagactaagcaaatagaacaaatctggaggcatcaggttacctgacttcaaactataccagaaggccatagtcaccaaaacagcatggtactggtataaaaataggcatgtagaccagccgggcgcggtggctcacgcctgtaatcccagcactttgggaggctgaggcgggcggatcacgaggtcaggagatcgagaacatcctggctaacatggtgaaaccccgtctgtactaaaaatacaaaaaaattagctgggcatggtggtgggtgcctgtagtcccagctactcgggaggctgaggcaggagaatggcgtgaacccgggaggcggagtttgcagtgagccgagatcgcgccactgcactcaagactgggcgagagcgagactccatctcaaaaaaaaaaaaaaaaaaaaaaaaaggcacgtagaccaatcgaacagaacagagaacccagaaataaacccaaataccttcagccaattgatctttgaaaagcaaacaaaaacataaggtgtggaaaggacacccttttcaacaaatggtgctgggataattggctggccacatgtaggagaatgtaactggattctcatctctcaccttatacaaaaatcaactcaaaatggattaaggacttaaacctaagacctgaaactataaaaattctagaagatagcattggaaaaacccttccagacattggcttaggcaaggatttcatgaccaagaacccaaaagcaaatgcaataaaaacaaagataaatagttgggacttacttaaactaaagagctttttagacatcaaaaggaacagtcaacagagtaaacagacaacccacagagtgagagaaagtcttcacaatctgtacatcggacaaaggactaatatccagaatctacaaggaactcaaaccaatcagtaagaaaataaccacacagtcccatcaaaaagtgggctaaagacatgaatagacagttcttaaaagaagatatacaaatgtccaacaaacatgaaaaaatgctcaacatcactaatgatcagggaaatgcaaatcaaaaccacgatgcaatacctccttactcctgcaagaatggccataaaaaccaaaaaaaaaaaaaacagtagatgctggcatggatgcagcaatcagggaacacttctacactgctagtgggaatgtaaactagtacagccactatggaaaacagtgtggagattccttaaagaactaaaagtagaactaccgtttgacccagcaatcccactgctggatatgtactcagaggaatgatatatgatatatacacacacacatatctatctatgatggaatactactcagccataaaaaggaatgaattaacggcatttgcagtgacctggatgagattggagacttaagtaaagtaactcaggaatgggaagccaaacatcgtgtgttctcactaatatgtgggagctaaactatgaggacacaaaagcataagaaggataaaatggactttggggacttggggggaagggtgggaggggggcaagggataaaagactacaaatagtgtgcagtgtatacagcttgtgtgatgggtgcaagcaaaatctcacaaatcaccactgaagaccttactcatgtaaccaaataccacctgtacccccaataacttatggaaaaattaaaacaaaagataaaaatcatgaaaataaataaaaataaaataaaatatagaaaattggtgtttcaaaaacaaacaaaaagcaatggctactaagaggtggaagcggtcaaagcaaaagtaggccagtcaagacatgctcaaggcattttgcttgttgactttcgaatggagggccaaagaatgataacatctgcttatgacaggagtgttttgagaaagcaaggcgcagctttagcagaaaaatgcctggaaaagcttcaccagagagtccttctccaccacaacaatactcccactcattcatctcatcaaacaagggcaattttgtaagagtttcaatgggaaattgttatgcatctactttaagtccttatttggctgctgctgacttctttttgtttcctcatcttaaaaagatctgtaaagggcactcatttttctccagttaataatgtaaaaaagactgcagtgacatggttaaatttccaggatgctcagttctttagaggtggactaaatggctgggatcatcacttacaaaactgtcttgaccttgatggagcttacattgaggaataaagtttatattttttatttttatcttttacttccattttttccactaactttttgaaatatcttcatattagtgtaatgagtgtgtgtgtgtgtgtgtggtgtgaaaacaaaattttcacattaaagcatgtcacattctatttttattatttttaacttatgatttttataaataaccattattaccagtgctaggttccaggatactaaaacaaggcaaagttggaaagaatgtttccatacaaaaaccaatatataacataaagatatgaacagatgaatgaactataaagcaacttctgctaaactggtaattgttagaactaaagcttcagagacttgtaatttataccaactcctggatatgggatattccattgttggattgatggcctaaaataagagaaacatcatttttttcagaagaagttttagaacatggctgaaatccgtcataatgcttaaccttgaactctcagatatcagtgctaattcatattttgtagggcaaatataggacaagagaaactgcacaggcagactgctagtgggtggaaaaatgccctttgactgggaatcaggagacttggctttttgttctagatcagtcactgctttatagggtgacctgagcaagtcactttaatgttgtggatcttactttcctcatttgaaaactacttgtttagtcaaaactattaattataaactatgttctgtagtaataggcttccacagaggtgccacagagatcactgcaggagggactctgcgaccttaatccccaactatgacccaagtagttcttttgtccactggtctatatataggggctattcttggggtttcatttgaataaaaggttctaaggtctgagtaaaatggggcactcccaggctaaatgatcctgacttaggatacacaacctgatcaaggttcttcaggttttaaggttctgtgatatctggataaccaaagtaggtgtttgtgacattctgtaacttatctgtctgtgatatgttagccagttctagggctggaatgatgatggtaatagacatgcccagtgatgaatgacctaccatgctacctaggacatcttacaccttgattattgaatttaaaagagcttctgaatcatcagagaaagatcaaatttggcttagttgtcattttactattgtatatttctatctgtgtgtggtatatttagtgaggctttaagtatatttggtgggtctccagtaactagaatgtttcattgacctatatatgccattccccagttatgccaggcagttgaaagtttatcgaatcagactgaagaatttgaagttgaggcaatgcttctcacacctatataaaagatgtcatgaggaagaaccagagaggaggagtgtgtatgaagtattggtcaattttttatacacatatagtaaaggctgatttatttgaggcatagtgttatttcaggcaatctgaattaactatgactaaaaatggctgttctgagctattacatttccaagtgactaaaaaacacgtgcatgaaagcaaaatctagattttgtcagaatacacccaacatctataagaaaataagctggaggcatatagcacattctattttaaaacatagtggcctccctttgagagaaagtggtgctgttagtgtcattttacttgagagagataactttgtggcactagtgatgcttttatgtgcatttatccatttttatcagcctctttattccctattcattcattcatttttgctttttactctatctctgtaggccttaatgcttttgatatttggctgtatttatgtgttcatgcaatccaaagcagacagagcacctcctgattcaaagcaaggctctgcgtttggcactgttggggatatagagatgattagccactcttcttagtatgttattgcattttagaagataatgtcttgaagatagattattgtcttggatgaagcccctgattaagactggagaaagaaagttgattaccatatccaagatggaggctaagggggaagacttgaaggacatggatcctatacctctttttttattgcacctcatctcattgtatcacattgatctgttgacatatgtctcttccctattagagtgccttgagagcaggcttttgactcaatttgaatggctagaacctagcacacttcctacagagttggttatgcacctactcagtgaatgacagacatgagtctgagctataacttgggagggactgttctagaaaagtaaaatgtggtgaatatatgttactatgtagtgttttaaactgtcattgacatctaggaagaagatgttaattgacttggctttggactgtggcaggaaaacatttagatctcgctcaaatgttcatgacagtcttatttaaaaggtagcctacattgttctccttactgcttattacaaaaatgcacatatcccagaaatcaaaaggaatgctatgggattccgaaacttattgccatctgggccatgtgtggctgaactatgaaaagtcattcagtcagcaagatagaaataacatctgcataggcagacaacttagcagactcagaccagctttcctctgaagcccagctgccattgtgactcatggcaagttcccagcttgaaaaagcaaagaactgaaaagcagaggtacctaacccagagtggagaccataaagggcagggaagcacacaagtcagtcttctgacattcctgaacaaatagatttcctttaactcatttatctccatggagtcaggttgactgttgggcagagaagttggagagttggaggggaagagtgacagaaacattttaattacaaagttaggttcgttatagaaatgcaagcctgtctcaacagttggtaatcagtatgatagatctctcagtatgagagatttgaagtaaataggccatatcatcagtagaaacagaaaaaaagctaattctacccaactgtatgtttgtacccattaaccattccctgtctacctccccctgccactacccttctcagcccctggtaaccattattctactctctatctccacgatttcaatttttttagcttccacatatgagtgagaatatgtgatatttggctctctgcacctggataattaaaaattttaaaaattaagaaaataatgccaactcttaaacacgtcgaagtgcatttaccataaaccaatagtaaacatcataataaatagagaaatataaatggcattttcattaaaatcagaaacaagacagggatttccccattgttactactattcaacactgttttagaagtactcgttagtgttgtgtgccatggaaaagaaattagttttataaataggaaaatgacaaaattattattatttgcatacagtaccactatatatctataaaatccaagagattcaactataaaatcatttgaatgaataagaatttaactgggtggcttggtgcaaaatatatattattaaacaattgcttttaattatactgacactaaccagttagaaacaggacaaaatcccattcacaaacaaggtagtaatttaaaaaattacccaggaatagaattaattaggacaatacaattatgacaatacaatctatgtgagattaatcacaacattgtattcaatagaaaaaaaaaaaaaaacaagagctgtagaaggtgagagacataccatgccccctgcatggcaagaattatgttatcttaagcacttaataatattttttaaaacttaagatcatgattctaaagtttctatggaagaacacaggtgctgcaattgttaagggaatcttaggaaaaaagaaaagtgaaggaaaagtgccccgttaggtatgaaatttaatgtaaatgagagtaatattggtccaaatgtggacaagcaaatcagtggaacagaatggagaatacagatccaggtatttgtgggaatctgctgcatgataaaagtattattgaaatcagtagcaaaactgtgactttttcaatatatggtgttagaagaaaataaaaatagaactgcttcttcacaacatgtacaaaggtaaattctagatatattaaaagtaatgtaaaaaagaactactgaagtattagaaaacggtataaaaatatgtatatgtctgtggggtgatgttccttaaacaagacatagatccatgttctttaaagaaaaaaaatctctacagatttaattatataaaattaatctattggaagaaaatatttgcatacatctgatagaagaaagtcttgatgttactaatataaaaatactcctacaaattcataagagaaaagaactacctaatagataaatgaacaaaggatttggataggcaatttaaaggagaaattacaaatttgttgaaacattcatttggaatattattaggttggtgcaaaaataatcgtgcttttgccatttgacagagggagtaaattaacatatatgataaacccactgtatgctaggtactatgaaaagtggaatatatcttctcatttaagcctcaaaactcattttacaggcagttaatgctaatttagccattttacacataaggaaattgaggcttaatgagtttgactaactcttccaaagtcatgcagtccaaaagtggcaaagctagcatattttctggagatgtattgtacagcatggtgactatagttaacattaatgtgctaagagagtatacgagttagtgggtgcagcgcaccagcatggcacatgtatacatatgtaactaacctgcacaatgtgcacatgtaccctaaaacttaaagtataataaaaaaaagaaaaaaaaaaccaaaaaataaatgttctcattctccaaaataataaggatgtgaggtgatatggatatggatgtgttaattagattgatttactcattccacaatgtatacatatatcaaaacatcatgcactatccacagcctgggaaaatgtgctagttggtggcatagttagatgaatttttaggtcattaagaaaatataccccaacattgttgacttagagctgataatgcattcctagttcaaagaggacttcaagtagccagggaattcagtctattgattctggcttgactgctaacacacagggaaatcctcagcaaggctctcagatcccatgaggtagatacataagaggcttgaatgattgaaccaggagaatgctgaatgagggctctgtgtctacattgttccagggttttgaggacagaccagttattttcttaattcttgtattatcaaagcagatactcagcctggcttagtagaccctggagggtgcactgtagtagagggggccatgcaggctcttctctgtctttaaccctttattgttcaacctataaatatcgaatttgaggaacccacaggagccacgctagtcaggtttttcaattttgatgatggagagggtgtatgccaataaatattattccattcattcctttccaagttaaaagttcattgggaaataaaattcaagaggtggagaaatggagacagaatgccagaattattactaataaatccagcagaagaatttggttttagatctatagtgaaaagggttttctgacatttgtactctgtcacatcccccaactctctcaagtccagacatcaggacagcaaacccaagggaaaggttgagcccataggagccactacatttacccagggtgctgcctcttactgattcaaggcagatagtgacagaaaagtgtgaatcctcagtgcctttgaccttttttattgcaaggtgatatagtttggatacttgaccctgtccccaaaatctcatgttgaattataatccccaatgatggaggtggggcgtcgtggaaggtgtttggattatgggggcggatccctcgtggctcagttctgactttgttatagtgagttctcacaagatctagtcatctaaaagtgtgtggcacctccgaccccactctcttgcttgctcctgctcttgccgcatgacgtgtctgttctctctttgctttctgctgtgattgtaagcttcctgaggcccccgtagaagccaagtagatgccagaaccatgcttcctgtaaagcctgcagaaccatgagccaattaagcctgttttctttgtaaattaaccattctcaggtatttctttatagcaaagcaagaatggcctaacacagaaaattggtaccacgagtggggtattgctataaagatgactgagaatgtggaagcaactttggaactgggtaacgagcataggttggaagagtttagagggctcagaagaagacaggtagatgagagaaagtttggaacttcctcgagactggttaaatggttgtgaccaaatgcagatagtgatatggacaataaagtccaggctgctgaggtctcagatggaaatgaggaacttattgggaactggagcaaatgtcacgtgtgttatgcattaacaaagagcttggctgcattctgttcatgccttagggaatctgtggaagtttgaactaaagagtaatgatttagtgcatctggtgaaagaaatttctaagcagcaaagcattcaagagctaccctggcttcttctaatagcctatgctcagatgcaggagcaaaggaatgacttaagttagaacgtatgtttaaaagggaagcagagtgtaaaagtttggaaaccttgcagcctggccctgtggcagagaaagaaaaagctctttagggagaggtattctagcaggccacttgctagaggtatttgcataactaaaagtgaaccaagtgataatatccaaggcaatggggaaaaggcctcaaaggcacttcagagactttcccagcagcctgtcccatcacaggcccagaggcctgggagaatggaatggattcatgggccaggcccagggcttcactgctctgcacaccctcaggacactgcaccccatatcctggtcactccagttccagctgtggctcaaaggggcccaggtacagtttgaggtaccactttggagaatgcaaaccataagccaaggtggttttcatgtggtgttaagcctgtaggtgtgcagaatgcaagagtgaagaatgcttggcagcctccacttagatttcagaggatgtatgaaaaaagcctgggtatccagggagaagcctgctgcaggggcagagcccccacagagaacatctactaggacagtgcacagggaaaatgtggagtcgaaggccccacacagagtccccactggggtgctgcctagtggagctgtgggatgggggccaccgtcctccagacccgagaatgtcaaatccatcagtagcttgcaccctacacctaaagagtagctatgtcggctgtatcctgcaaagccacagagttggagctgctcagggccattggaggcgactcctcacaccagcatgccctagatgagggacgtggagtcaaagagattattttggagctttaagacttaatgacttccttgctggattttgaacttgcataggacacatagcccccttttttttaatgctggaatgagttaagattttgagggactgttcggaaggcatgattgtattttgcaatgtgagaaagacatgaggtttgggaggggccagtggtggaatgatatagtttagataattgtttccacccaaatcttacgttgaattgtaagccctaatgctggagacgggacctggtgggtgtatagatcatgggggcagatgtctcatggactggtgctgtcattgtgatagaattcccttgagatcttgtcatttaaaagtgtgtggcacctcacacctcattctctctcttccttgctcctgcttttgccatgtgatgtgcctgcttccactttggcttctaccatgattgtaagcttcctgagtcttccctagaaactgagaagatgccagcaccatgcttccagtgaaacctgtagaactgtgagccagttaaacctgttttctttgtaaattacccagtcttaggtatttatttatagcaatgcaaaaatggcctaacaaacagtaaaatatacacaacataaaatttaccttttaactattttgaagtatacaattaagtggcattttgtgtattcacaatattgtataaccacaacatctatctagttttaagcatgtttattaccccaaaagaaaacccagtacccacaaaacaattacctccccctgcaactttccttcccctaagatcctggtaagctctaatctattttatctctgtggagaatttgcctattatggaaatttcatatgaatagcatcatgtaatacgttgccttgtgtgtctggctttcaccatttagcaaaatgtttccaagagttcaaccgtgatgtagcatgtgacagaactttcttaatttttaggactgcatagtattccatagtatgcatataccacattttgtttattcatttatctgttgatggacatttaggccgtttccactttttggctattgtgactagtgctgctatgaacttttgttttctagtatttgcttggatacctactctcaattattttgggtagatacctagcagtggaatctctgggtcatatggtaattctatgtttaacttgttgagaaagcaccagactgttttccacacttgtggctttaaaatattgataagcagccaggtgcggtggctcacacctgtaatcccagcactttgggaagccgaggcgggcggattacctgaggttagaagctcgagaccagcctggccaacatgctgaatctccgtctctacaaaaaaatacaaaaattagatgggtgtggtggcagtcgcctgtaatcccagctactcaggagactgaggcaggagaatcacttgaacttgggaggcgggggttgcagtgagccgagattgtaccactgcactccagcctgcatgacagagtgagactccatccccaccccaaaaaatattgattagctttccctaattgaaaagtgtagcccagtggatgtgccccactaattagataacttcctcctccttggggtggggtaagtcacacgtgggtataaagccaggatgttactacacctgaagttccttcacatgtgcacatagggcagggaaaaagagcatgccatcttcaacagatgacatacagctgggagcaataactgacatctagctattaaacacaaacttcttgaagacctataatgtaccaaaaattgtggcaaacattgtggatccagaaacaaggaaaattttcggtcctccataagctcagattctaaaagctgagcactaatttttaatgaaatcgtaatgcactaatcagaatccacgatacatttaaaaatccaattatctgaaatacaaatttaacattatacggggatgtcgctcaatgataagtgacctcactctcacattacgtcagttcataaaatatgtagaggaccatgtccaaaaaattacacataattcagctaagatgagcactgcacaaaattgaataaattacagtggttcatctgtctttaaaataatatttaaattaagaaaccaaactaatcactagctgaacttgattattaaaatcaaattttttttacataaatgcatgttaatagctagacaacatacactgcaataattgcattatatttgtcagtttcgatttacaactgaatttaccatcatcatgtaaaacatgaatctgtccctaaactgagtgcaggcattaccaatgagctgattatatctccacctactccatttaaccatcgtcaggcactacctgaaatattatataccaacacagcactccattcttgggatgattcctggtccaaatgattcatttctcatggatctgcctccacatacccaaaacccatgttccgtatcattggatatcacattagtgtgggccacagagaacacccatctcttgctaagaacaacagcactattctatagacagcatagctctggcttttgaaatggaaagaaacacatgtaaccatgccgtctttattgctctgtgtaacttttatttaagctcttaggtaatttagacatacccattcttctagttaatggctaacagcccagtattgtcaaataccatgatgaaatattctgacaggtctgcagttttacacatgtgattgaatgttcagactactttctctccatgacaggctaccaaataccatacataatttgagtatttttgacagaagaatgcacatcattttctttctagggaataacatgcttttgaggtttattacccgaatttgaacacattcttatagtggattttccatattgttcttccaccaacaatcattaagggttgtgatgttgtgttcaaatgccatcttatacattaaattaaattcaagttggtgtggttaatgttattggaaaatacctattaggcttgcttgaaaaatgttaggaactgtgattgcatttagaacacagaatcagacttatggaagcaactgagttctattaaagtacctgagtttatgtagaagagcaaagctaaaatgtgactaagtgcaatgcttaaaacacactaataccagttaaatggataagtacctgtagtaattaataaaaaaggaaattcatctagaatataattttaggtgtcaataggaggagtccatcctgcagaagagattcagatagaaattctacttctaacctagataaccatgtattagtatcagtgcttttgtatgcacgttataatctcagctaatcctctcaagagtgctatctcattcatttaaatgggttataatagaaaatggatctgctcattctattctacataataggaaattaaaaaaacaacatcctttgttgtttaagcatacatattatattgctctactgaaggttgtctaagcttctattttcttagacaatctttttttttcttcaatttctattttaagttcaggggtacatgtgtagaatgtgcaggtttattacatagatcaatgtgtgccatggtggtttactgtacagatcatcccatcacccagatagtaagcccagcatccattaggtattcttcctgatgctccccacccccacccccacctccgacaggccccagtatgtgttgttcccccgatgtgtccatgtgttcttatcattcaactcccacttacaagtgagaatatgtgatgtttggttttctgttcctgcattggttttctgaggataatggcttgcaacttcatccatatccctgcaaaggacatgatctcgttccttcttacagcttcatagtattccatggtgtatatgtaccacattttctttatccagtctatcattgatgggcatttaggttgattccatgtttttggtattgtgaatggtgcttcaatgaacatacatacgtgtgcatgcatctttataataggataatttatatttctccaggtgtatacctagtaataggattactgtgtcaaatggtatttctgcatctaggtctttgaggaattgccacactgtcttccacaatggttgaactgatttacactcccaccaacagtgtaaaagtgttcctttttctccacaatctcgccagcatctgttgttttttgactttttaataatagtcttaggcaaatcttgatcttctcctacccctcccaggattttggtttttaagtgtcttttgatgttgaagattgaatctatgttctatttctagctgctgtgcatctctgttttcctccatctttaacctcctctccccttacacaggtgatccttcaatgaaacacaattccttattttgtgagtctctcaattcacttttatgactggatattgtttccaaattccttggcaggtttagttactacagtgattagatgaggccatgatgtggccaggcattggaatcagaccagagggcaagttattcaacttctctgtgcttcactttcctcagctgtgaaaacagactaatgatagtacttacctgataggactattgtgaggattaaatgggataaaacacttaaacactttatatagtccctggtaagtgctcaactaatgtaacaaaagacgttggtgaacattagggttcctcatccataagttctctcaggccatactattaaacaaaccactcagaaagtatctcactgatttattttaatttgtttgaaaatggaagtatacaaccttttcaaaacgttttcccatctctagtcttctgacacgtctcatatttttcaccttcccttgcattataaagggtcattcagaaatctgatctgcaggtgttctctttgcctgggatgccatctaaatgtatcaggagacttagttcattcataatatattgatagaatgcctgctatgtgacagttgccgttctagggatatagggtgaaaaaaacaatatccatgacttcatgaagcttcaatcccggtaattagaaatctcttaaatagccaggggttcgtttccaatctctttgcctagctttgtcttccttattccaccccactccattattctgttacaaactaccttagttgtaccttttccaatctttggatcattacctataatgaagaatacataagcaaaacagtagttgaaaatacctgttttccttctcctctggttatagcatgctgttgttcccaagaacaagcctacgaatttctcttttatttttttctggaaaatataaaacacatcctttttaggaaagcctcaccttattctaggctttaatatttctgacactgtgtcaagggcttcagaaaatcttgatgcaaaggaaagggctttgccttcaggctcaactgaacttaaatctaaacttaattgcttcttagcaatgtgtgtgacccctggcaaatcatttacctttctgaggcttagtttcctcatttttaggtaaggataatgaatgccactttgtggggctgtcatgaacattaaaatgaaagaatgtctataaagcactttgtacaagcctagcacaaattaagtgctcaataaacattaactatttttagcaagagccacccagtaaagaaggcttggtttcaaatctctgttccaagcttactagctgattaaccttcagcaagttgctcatcttcactgaatatgggcttccctttctgtaaaatgaaatttaatatctacttatctgaataattgttctaatgattaagtgagaaaaatgtaatgacattgtacagaatatattccttctacttttatgtcttttgctcactaccaaatttttcaaggccttgtatccagccctgggagaataatatagacatgatctcttgcccttttggagaaagacaaattatgtattatatgattagaaatgatgtgaaaattttatgagggaaataagcagtgctgttctagagaataatggttgtttaatttaaatcagaagagaggacttcgttaagagatgacatccaaacagatccaaatgataagaatctagcaattggaagaacatttcagccagagggaacagcatatagaaagatcctgaagtggaaagagcttggcctgttcaatgagctaaaagaagcctgatgtcccgatttttttgagagaatatacctatcctttatttagaaaagtaaggcagagttgttgacattatcaaataaactagaggagtcaagggagtgagggcaggtaggaaggttttaaaaggtggtcatggtaaactttccaaaataatatcaatattttatcagttgggggtcccgacaggaaacaggtggtacatgcaaagtgggtagctagaggataatgtaataaagggatatatacaacgctgtggtcggggtttaaggttaatagttaaagaaagccaacaaaggagaaggaagcatcccaggacaagcaacagcaggggtggattatcaccctgtgtgttgatgaaactaggagtgggggtggttacagagcttggagagggcagcagctgcatggagaaggcctggtaaggtttttggtagaggaacataactgctatcaatctgtagtccagaaccaagggatctggtggtagggacacataccctgcccttctttcactctcttgccagtacctcctattgggcatactcaagtggaagccagagggaaaagggagttggtttgatgtagcctgtagagatcagtcttctggggcacacagaatgtggagaggggtggagtatagatccagagagacaaattcaaactatccatcacaacatctaatatataattgtgctaggctgaataatgccttccccgaagatgtccatagcctaatccctggaacaggtgaatatattaccttaaatggtaaaatggactttgcaaatgtgattaaggattttgagatggggagattattctggaatatttgggcaggccctatgtaattgtaagggttttataaaagggaggcagacaagagaatgagatgtgcccatggatgcagagggcagagtgctgtagagctatgagccaaggaatgcaaacaacctcttcaagctggaaaaggtgagaaaatagattctcccctagagcttccaggagaaacacagactgctaacgccttgattgtagcccagagacctgttttggaattctgacctccagaactgcaagaataaatttgtgttgttttcagatactaaatttatggtaatcttttttttttttacagcaccaataggaaactaataaaatagctttctaattctatactgttttttactactgtcaagcatgctcatgaacattacctctttcaatattcacagcaattctgtgaggaaggaattattttctttagtatatggagagagaaagtgagggtcagagatttgaaaagtcttgcctatagttatcacatgatgcagctagagatgaaactcagcttttttgactccaaatgcagtgtccttttccctcaatacactaaatttttttctgcagagaagcagcagaagaaagcgaggcttcagggagatgtgggacaaataggtggttcagtgtattgtggtagaagagttgtctccattggagctaacagattctattgcttgatctgacctaccttcagattcagagtatcaatgctcactgaaacccgtgtgatatggtttggctgtgtccccactcagatctcatcttgaattataactcccacaattcccacgtgctgtgggagggacccagtgggaggtacttgaataatgggggtgggttttcctcatgatagctaataagtctcatgagatctgatggttttaaaaagagttcccctgcacaagttctctctctttgtctgctgccatccatgtaagatgtgtcttgctcctccttgccttctgctatgattgtgccacctccccagccatgtggaactgtaagtccattaaacttctttcttttgtaaattgcccagtctcgggtatgtctttatcagcagtgtgaaaatggactaatacactatgcttgatgcaaggcagtggttttcaaacccatgtttggagcaagccccagaaacctagggcttttgaggaaaaggatgtggggtgatggggttctttcaaccagagaagctctatgctcatctattttttaactaattgactttgatgtaggccacatttcaatttacaaaaacaattctggggctaaaaagaagtttgaacataatggtggacattctgcagactttcactgtagatgataagaagaagtagaaacgtagaaactccagggtgattttcagtaaactccatagaaaggaggatgaggtagagcagaattcttggagacccccaagcacaagctggctgtgagaagcagcagaatatcatatatatgacagcatctgggctcttgtttgatttttaaagtagattataacatttggaactccatatcctatgaggcttaaacacatttgtgatggcgggatgtttctgttgcattggcaaaggtcaaaatcaatagaattcgcaaatgttcccctatgtcataggtcaggtgcactattattccatagatcactagtgactttctctgtgatctttaagcatttgtttgacataaaaatgacttttaaggtttacttactggtcccttggcaaactaagaacacttcctatctctaatgctttaaataaatcatctgaaattattgcacattgagctgttactttgactggctgctgagaaatgtgcttgtgttttaaaggacttctcttttggaggtgggtgagtgggtgaagaacctctttttttgtctgctcctctagaaatggtctttctgaatgaaatgagcacatcagagagctatgtccctgaaatgctcctcaaccctcctaagcccaccttctctgaattgtacttcagtattaggtgctggacctccaatagagaacactccaaaaattcttcatcacagacttgtcgttgtctttatggtaggggtggtattgggagcattgtccagaatgtcccaaatacactttagaagaacccgtgaaaggaaagaagttctctcagacctcattgccaggaaaagctgtgtttctcttcagcaactagtgtgtttttacgcttatgagtatttggaattttgttattcagtcagtggccagacccactgaataacaaaaccatagctgcatattagatatgcatgaatgcatggccccactctcaggaacttaatttttcaaatggtgaggctaattttgcaaaaatgctcctcctgattctaatatgtagctaacgttgaagatcactattataacaaaatagtccctgtgatttagtcactggaaaactcaaaatcaagcctggggcatttttgaacagttatacagtaccggatgtgcctttctgagtgtggttctgatctgggcttgatcatagtgacatgttctgatttactcttcctcctaatttctttacctattttttaaatcaatttttcattatatatttattagatctgcttcaaatgattttgaagtgaggcaatagatagattggtagatggagagatgatagaaagatagatcattgccaagcgatgtttatactgcgtctagttactgctagggcatttttctaacgattagatacagcaaattgaatgatatgggccaatcctgctgcagaaattatagaaaacattgtcttttgtgttgttattatgaaaacattcccacagttctttcatgttttaataaaaaatgaagaattattaccaatagctttggaaagtaaagaaaaaggaaatttaaaaagtaattcctaactccaattccccaacatcacaaaacctttgattttttcagagcattcatctatccttagaagacttctatttaagaaaataaataggagtagaaaaatcaacaagtgaagtatttaagaaaaataagcccagtcttcaagatgcttggaatccgcatttgctacttgcaagtcacataagaagaacaagccacttattttagtgacttcctgctgggctccagacaccatagcctatgagatctctaaaactgggcccctatttactttttcaactttcgagccattcaccacttcccctcccctccattcccacatacaactctagtcaggataaacatattttagtttctagaacatggtctttcttctgggtcttcatacatgttgttacctctggatcacattatctccccacttcccccattcacccagctaactcactccccttcattctttctatgttttgccttagatgccatttcctactggagcttctttgagttttcagacttgcttccctgctgtaggtacttttcctattaagccacttgttccaatgaatggtgattacttagtgaacatccgtctcttctgttagactataggctgtggacgctggttttgtcactgtatttccagcacctagcacagtgcctgggacagagtaagtactcaaagcatatattttgctgttgttattataaggtttatgtttttcatgtttgaaaggcacttgtaatatgtcaataattctgatagaagtcatttttagagaaggacgccataatcattcagtgagagaacacagaatgctcagacagtatgtggaccctgtagctggacattacttttccctgctgatggttttctcttcagatattatgttagagattataataagacatgtagcaatggagagaaatcagctcatcccaaactgattttcacttttagttaacacttgctctatgcaagaaaaggtcatattagttggtagcttgaatgcttccaagaccattgcctatttcaatgcttcaaagcttcagaagctctgccctgtgctgcagtcatttggtgtagaagtggaaggtgcctgaaataagacagttaggggttagaagcacagaggcgggtgttataaaatgtcacgtatgtttacatggcttttttctcagtacaattttgattattgccttgtaagcaagaccctgtagtatattgaaaatagctctgaatttgtagtaaaaactttttcatctttctacttcctaacagtgttactttggacaggccaatacatcactctgagctttgatttccttatctctaaaatgggggcagtgacataagcttcatactaacctggtgaaaattctcttgtacctaagtcagtgatcgataaaggtctattaaatccaaatgtcaaggaaagacttacctcattggatggaataagtgtgaactttctggctttcctcttttgcaaagtttgtgaatgcatttaatcatttttattagtagtagtattacttatttacccctctgcaaatcagttatgaaaagaaaaatgtcaaatgtaacttacctttccaaagaaaattgatttgttaaagcaatagttgccagaaactccaattttgctctgatttgatatgatccagtacaagctaggagtttcctcacagagctgaggggaaaaggaagagccaaaaaatctctccaaattagcccatgaatgtgagctgtagttttttttttttttttttttttttttttggataatcagatattctgactttggtcttctaattattttaccaggccaggaaaggagagctgacaaataagcctgattcttccttggcaccaaaaaattcaaagaagaaccgaaagtccattgaagttcttgtttcctttgaaatgcttgtgatctgcctcctgagactgcaaggttattaacttgcatcaggaaggtggtagagaactgaataaagaaatatccatccatctcagttgtcgtggttcttctgtcattcagaccccagcagagcaggaagcagtgagctggaaagtgcatacattggtttttccttgcttctactgaaggatcaaaactccttaggccactcagtgacttggttgatgccttccttcttcctacctttgcctttcaatatctaagcaaagttgccctttgtttatgtctctggggttttttctctttccttctcagaatgtcttttcctcatttactcttattcccaaacaactctttgtgtaatctagctgggaacacattgtatgactacttaggtataatacagaggcatagtgctagaagtatagagataaatgggttctcagtgaccatcctaacagttatacttggtggttttcaaactgtgcttcaaaagaaccctataggtatattctgaaggaatcccaaaggttttataaaaaggaagttggtggaagatgcgtggtttggtgtccaaggaaagctaaacagaaagggctatgggcaagccatcatcacttccaccaaagaagttccgctttaatctgtatcttatatttggcattagcaaatgtttagataaagagttctgtggccaaaacaattagtggggaaagcatctgcttagccctgttacttatctgtagaggggtaaggacctaagtaatgttaataatgttaacatttagtgttaatattattttgtatctgctgtggttgcatagatgcatcttctgtttgctcaactggaacgtgaacccatgaagatcacggcctaggtttgctgtctttatgaatagacacctggtctgttcttattgggcataactctgtcttatggattggctgctgttaaagtttttggagctgtctttttttaataatctaaccagagttgtagaaccactgttataaaatacatctgtagacagcacaatttacatattatttcaaggagttctggtgtcactgaagtcaaactatgcactttgagcataagaaacctggcaggagaggcttcttgatttaccatacaaacttctggagcatgtttgtttggttttttttttttttgaccccgatctttagaactgcccaatattggaattggaatgggctacttcatgacagactcaatgcttgattcctttgcatcaacccagaacatattttagattctattgtttccaatttctacatatgtttccttgggcaaatcacttaatttatcagagtctcagttttcttatctgtaaaatgggagtaatgatattgcctactttataatgacctcataaagttgttgggaggagttaattaggtgggcacagagtaggtggtaaaaatgtcagttccctaaaattccttataatttattacagaaaatacaatctgccttgtgtggaaaattgaattagatgctcttgggtcccttataatgctgagattctctgttggttcatcctttctgctttgttttgtcaaataatccagaagctgttgcctttttgctttggatttaccttcaaatgggttttaggtatagaatcttgggaaattattattatttttttgcctcaaaatccagcttaaaaatgttttacaaatatcttcagctgctttgaagggattttacatctttattgtaaagtggctctgagtttccctgaggaagatgagatttttgactaaattgctgacatgttgcactttgtagccaaattgtctagggagatacacatttatagtagatagtgtacgcttagagtttgtgatgtactttggcttcaggcttttaaataagtccgccaaggcctgttccaaaaaccagatctttaaaacgtataccttttaacatgcctctggtggactatgcttccctggattcaagcccttccttttaacctgggctagcatttgactaattgaatgtggcagaagtgacaatgcacaactttgtaggctaaatcataagaagacttgcaacttcagtctgtgttttttggaatgtttattctgggagaagctgggaaccaggtaagaagtctgactgtgtactccaccatgttggagaaacttaaataggaagaggccacatggagggagagagatgtctgaccagcccttagctgctctagtcgtcccagctgaggtgccagaaacttgagtaaaatagccattttagacatgcagccctggtggctgcaattgcagaagagatctatctaagaacctcttagtttggcccagttaacccacagaactgtgaggtaatatagtaaaatgttgttttgaattactagttctgggtggtttttacacagcagtagataactgaaacagatgcctaaattacacatcgtttgcaggcacacataaatacaaatactggtgaattatttgaagctaccaccacagtgtctggtaggattgttagaggtcctggagcttcctagtaattaggccagctttcgttgccatttactcaagtcgttaaggcttagctgctcagatcaagaaaatcatttgttattaggttcaaggccactgagacaaaaatccagcttttatctttcccattggactctttggcatcaaaattttcactttatttcttattcttaagttatatggaggatttttgccatggttctcccaaattacttgccaggctaactctgtctaactttgaaaactaggggttggcaaagtagggcctgcagacagtccacatgtttttgtaagtaaagttttattggcgcatgcttatttgtttacataggtctatttctggatttgcactataattgcagagttgaatagttgtgagaaagatggtatggtgtacaaaactaaaattatttactatctaacctttacagaaaatttgccaaaccctggtcttgactattgaactaactggttaatgatatttgagattctgtgcagtatcatagagtcagtctgagatcttgacttcatgataatgttcttctaatttcatctttgctggggatcaccaagcaggtaaattgagcctcatataacgtatgttaagtacctactatgcaatagttactgtaggagagccagagatcacatcacctccagccctacttttagctcttagtgggctcttcagctggatctagaaactaaattgacaccaggcagattaacaagataaaaacagacacattttattagttttacatgtacaggggatcttcataagagagtgaagtctaaacaagtggccaaagcaagatgcttatacattttctgacaaagagcaataaatctgaaaagaaatggtaggactaagaagatctggatagggcagtaaaatttcctagaggagtcactagaagatatattacgggtgtaaaacaggtggaagatatgagttacttcattaggtatgtttattcatgtccatggcagccatcaattccaagtgtctggtaataaggacggttttctcaccctggtttagagagggtacaccttccagaggaatcttcttggctttcacggcttgctgaatgcaggaagagccaggtttctgaaactacaatttctccagtgttttcaattcgaaataatcactttacttatctggcatattttggagtggcactccttcagtaccatgatatatgctttcttttatgccattcattgctacatataataatcctgtgagattgatatttctgtctccatttaacagtaaggaaatttgagactttgagagaaaaaaatgatttccttaaggtcatacagctactgacatggctaggctaggacatgaacccagtccatgggcccagtattgggttctttattctatactagtgctttaaaaaattttatctcattattttattgtatgtatgtatttatgtaagaatttatgtatttggcagtgggcatcttattttacttaaaaaaagctaccaacgattctatccaatgtgtataaaacagattaaagcagaacttatttgattaaagtgctcctgtgatcatacacctcttctttgcaacacacacacacacgctctctctctctctcacacacacacacacacacactgtctttcacacacactctctctttctctctctctctcacacacacacacacactctctctctctctctctcacacacacacacacacacacacacacacacacacgctctctctccctctctcttctgccttaactgaaacatatggtggaccttttcaggacctataacaaaagatagaatgacatgaggtttggaccatcatcattcagtctttattttcctcatagcacaaacacctgattgctctattgcctcaattccaggaatttccaaggcattccatacaattgaaataagaaatcaaggattactctatttgtttgtgtgaggtgtggctgctttaatcacttccaagctccagattttcccatcaaatccaaggtagtctcaataccattgttttcacaaacttatttttagcttggcacttccatgtggatggagttttatatacaaatactaaaaaatatgtttataaagatatttagtgaaatcagaaatctttttagtgcaatgctgataaaagagctctgtatatactgcagtctcagctttccctgcatgatgtatttaagtggagaagtatgtgttagcttacttactcctagacaagtacaattggaggaacctgtgcttaaataccgttagtgatctctgggtggaggggttctgtgtgactgacactgtctgccttagaactttttgtattgtccattcttttgaaagcatgtagaaatgatttgccaaaaataagtatctgtgtatacttgtgacactttgtgatattgtttcaaaaatttgagacgaaatggctggcttgagagaacaggcatatcttcgtcccagaattccttctctctgagtctagaaatttcctttcatttttttttggtctgcctgaatttttctgtttctttatttgcagtgacattaaagagagagcacaaaaggcctttgaccttttatttagcgtgtttacagatgtatctctacttacagcttatcagtattgaatgaaaacttgactggaaacacacctctctgtgttttgaacaaaagaagaacagatgttaatccatgttacatgttttaaatgtcactgtcagtgtatacatttggatgtaaataaactgaatccatgtggtaacttcaaagtatgaatgagattatatttagggagacaaatggcttgagaattttaaaacttacaaatgagtccttatactcaggaaagaaaataggtgacatgctgtattacttttcactgaaagtttcctatatgataaagtttattaactgcacagataagtttttgaacatttatgttttggggaaaatgtagaatgaaaacttgcatgccattctggaaaaaaggttatgcattaatgccacttccaaattcaaaaagatcagtgtcacattatgtaaacatctttgtatcagttatattgcaagtgacagtacattttataaggtctaaggaagcttacataagaacaaatattttctcaatacaatcaaatgccactttgaataaggggcacagtagaggagatgcaatggatatgtgtaatgtgtgctaaatttgtgattgccttgggcactactaaagccacactgagtaatttcatttgacagccaaaaaagaggagttaaaggaatgtggcagtttcacctcctatgtctattcacaaactcccatggtgacctcattaatcttggggaggagaattactcaaagactggatgcataatgccaaaatgactgcttgtaaaagttagtatccagtccatctgccactggttttctttatgctggcgtttggcagttttataaaggagtgtgccaaggtgtgctgggtcacagtttggggaagagaatgctgaatgaacactggttggagcagcaacaaaggtttcccttgcatactgtgcctgccagccatgggagctcaggctcaagtcctcccacctctttattgctactggtttgtcaccattctgctggcgagaatggtagtgagcagcagggaggaagccacagggtttcccaccagagaaactggactgtcccggcatgatttgcatactttggcacaaacaccagaggatactgaccttgggccttgatgtcactacaccagacaattggttgaactgatatgctttacttgccttgactaacattgtgttttgccaattggccaattgtttagtggccaaggagactcactgactttagatttgaattcagtaaacattttttatgtgatttactttgtgccagacagtattctggtcactctggcactttttatctcatttaataatcataatattttagaaataagttgatatttttattttaaaattattaaaccaaggccctctatttcatgctgtggctctcctgaattcaaggagaaatatgttaacgttaaaaaaaataaaattgtatcacataatgtgacataaagatgagggcatcatcttttaatagatatatattattgttaaaaatgttaattaggtattgaaaattataacaaggacatttcaccagtgaagtggtgtaagggcagggaagttggggcaatgggaattggaatataatgagccacattaagcatacacatgtcaagtctagttctgaatcctgtggcaggccttacaagagagtccatgagtcagagaggtgcaaatagaaccaggaatttgcattgttgtggatgcaaaggaggaggaagtgttcaacattgtcagatgtagaagagaggtctagaatgataaagactgaaaatagccataggactttgcagatgggaggtcaatgctgaccttaccaagagccccttccatgaaattgaaagggcaacaaacagaaatgcagaatgagggatgagtaggaagggaaggaagagagaagattgttagtgaatagtccagtccttccaaaggttgtgctgggaagaagagtggtttctagagggaacacatctgtaaggaagaggtatttcttcaagtttaaggaaatggagcatctctagcataactactggagtctgaaagaaaagggagagaatggtttgagatataggaagggacttgaagaccaatgccacagaaggaacagaaagatgtggggcagggcacagagggaactgattgaccttcaactggatgagagaccccactgtcctcactcttgaatgcttatattgtgaggtggaaagttaaagaaaatcatagctgatggcttcaattgtcttgatgaagcagagaggccagcaaaatattgaaattggaaggaatggggattgatctaaggacttttgagcaagggagtaaagactgaacagggtcattgagcagaatagaaaatggactgaagaaaagtataaaagagtgtagctgaaaatccagcaaaggttggaatttgtaatgatgccaaacttccagatttgcatgtctttctcttgctgtgtaaatcagaaagggtggattgtaaaattagaccagggtttgggatttagggttttggcagaaggacagtggtgaaaagacactgaggggactggaggacaagtggtttttaatcatagccatcatatccaggcagggcaggaaagaaagtgaagataggaggcatttattaggctgggaggagatgcagagacctatggatggcaggactctttgagagtgatgacaggatggggtagaagaagcagtaaactatgccccaggatcatcctgaatgtggaagaattattaggaggcctagagaggtatatagttgagaaacaaacatttcaagagaccagaggtctttagattaatgatccgggaataatgatcataatgttgggtaggaaacaacagggccagatcaccaatactctgatcctgcaatggcaggagtagatgaaagactaagcagtcttcacttgaaatcccttcagggaaagcagtgtcatcagagaagagccaggttccattaaaggtttgagttggagaagcattctgtcaagtttaggaagtatatgaattaatctactatgatcttaaggatccagaacacacaacgagaatgtttatggacaagggcagcaatacaatcttgaggcagagagaagcagcacaatggggtgagaatgagactgtagatgacaaagggacttatattcagggcaaggaccaaggatgacaagtatgggatagaggaatattgagatttgctggcctcatgttggtgcataaggccaatgggaagccctatggagcttccttgcaattctatgagttgtataaaagcgagtcatgggtgagagctcttggagtccagagctcgagtttgtataaggatcctaaatttacatagtactttatgtcagtttttcttaccaagctgggagcttgcttagatacagctttcaagttatttacattgcaacagactttttaaaaaaatggcttacaggggagacttttggtcaaaaatatgtttggggcactatgtgtggatttcattgattcctgctttccatgcacctgctagttgtctgtaggttcactgcccctgtgaacagaagacccagcccttctggaaaaaaaaattgttttaatggacctaagccaaaaatgctttaagcccggagaaacatttagtaattcttcagaaattttatagcactactgactggtgtggagcaggtagaagttgaaattttttcctgattatgaaagtaagatatatgcattgtaaaatatattaaaaatatagaaaaagataaaagaaaaaatcacattaaatctcaccagctgcagatatccactgttaacatttggatgcatattgttcaatattttgtgtctttgaatatgctttttagctaaaatgagatcatagcaacatattttatattttcttgattgtcttatgaacatgatgacgtcatcaataatcttctaccgcatgatattcagtatagtatttcatcgacttactgtatatacttaaccaatcttctcatgctgttcatctgggttattttcacctttgtagaattatgaatcaccctggtatgaactttcttaaagagaaattaatcttgcatacatttatgattacttaagatgcattcttagaaatgtaatgactggatcacagtgttttcttctctctctctctctcttcccttctctctctttgcttctttttctcttcctgctttcttgtctgcttttctttttttgctacaatttacacttgaaaccaattttatcctacaagctaagaatacattttagatttttaaatggctgaaaaattctaaagaagaatgatattctgtgatatgtgaaaattatataaaattatatgaaatttttatttcaggatccattaatacagtttgttgtacagccatgcccatttggttatatactatctatagctgctttcacactactatggaagagttgagtagttgcaacagagactatatgacccacaatgcctaaaatatctagtatttggttctttacaggaaatgattgatgagtcctgatttaaacctgaggagtttacaaagttattatagataatgtaaatcctttaacttgattccagaacaattttcttgtatgccatatactaatattgtgaatcagaaccccagtttccttgtctgtagtatgggtctaataatagtgataatttcaaatggtttttgtgaagggtgaatgaaatacatttcaagcatttgaatagtgcttggctcagaactgaaaagtaacatcactagaggacatgcagctgcttgcaaagtgtcccattggaagagtgtgctattcatttcaaaggaaggaagacagagcttgcttcttttggagaacctcatactgtatatgtttgacccacatctgccttttaaaatgattgcagaggctctttcatgtggctggggtgggaattggtctccctgataaagtagcaactttgggttgctatccttggtgggtacatcttagatgcttctggtggtcgaatgtggttgaatatatttcacttgctctacaaagtcactgtcagcagcacatggattgcaaatacacgtggaacaaacaatttcaccaaaggaaagataaaaactgggttggataaagaagatataaagaaagaaaaaagggacttgacggagtagagggaagccaacggaagaaaaaatattggatgtgattactgctttttaactttaaataaatgtaggaaaattatttttacaatgccctgtgtattgtgtgcctaaaaataatacagaaaacataggattttaagtgcattaatataaatgacttgagtaccccaatgctgctatgtaaccgaaggttggagttattgccccttttatgtaacttaagtcttttctgtgcttctttccatatacatcccttttttcttcctctctcatcttagaagaaaataatccctcttttcctacaaagactagtccattagtcctacttccccttcctcctcttgctcctgtcccatccttacctggcaaatctcccaccttgcttcatcaattatcctttccatctcacttactcctcaaccattccaagtgatactttctctagaaattttatcaaagaattctctctggtatttggagtaacacaaagaaagaatctaatatggataaaagagtctggtcactgacgtctcttaacataatcaattctcaatcatctagtccgatcgaatgtgaagtcgatgtggtggctatttatttaagtattcacttttaaagtatttaccatgcatactttgttcaaaatatttgaaaatccatcttcagcctataaattatttagattatattttcagtttctgaacacacaggctggtaggtctctttctctttcccttccttcctgtctttcataataatttattattggatcttgggattttggaaagagcttgtgttctttattaaagcaattctttggaattttggggagttcctttacaaccagtgtgtggtcagattttctaatgttctgcatgtgcttgaaagaaatgtgtattctctaattactgggtgcagggttctatatggtttaattagattaagcttgttaattatgtagttcaaatctatgattgtattaaattttgcatggttggtctggcagtttttgacaggtgtgtgttaaaactgctgctgcaattgtggatttattatttttccttataagtatgccattttgtgtcacttatttttagactgtagtgctactttattaatatttttacatttaatctttatataataaacctgtttattactggtaaaattgataaaagataaaaccttaaacaagtacttacctcttagaaatgttacaagatttaggggatggcagcccaaaatttacctccaaaagcatatctcttaattttgttaacttgtaaatgtaattaactgttcattgtgggaatttgaattattggcttcttttatttatacatacattttaattatttttggttgctggccttagtggagaacgtcttagatgcttctggcaattgaatgtggttgaatatatttcacttgtactaaaaaggaagtgaaatatattttacaatatatttcatcacccggtcataatcactgccaacatttcatcatacagccttccattcttccttctctacattttttttctggttgaggttattatccaattcaatattttatcttgatttgttttaactttcgttatagcttaaacattttctcatgtcattactaactcttttatacatcctacttctccacccctaacaaccaagagaattacagtgaaccttgggatgcaataaaatacacctaaaatagtgaatagtacagaactaaattgggaagaacagaaactaaagaatgtgacttgaccattaatcacattatttgcaccacagtttagaaacttgaattatcgagtgtctacaatggttgcagttcttggggaaagctttatagcaaaggtggaatttaagctgatcattgatctcttcgtcaatgctaagccaactccatttagcaaaggtactagggcaggtatgaaccaggccccataatacggagtgggtgatggaaagtagattagacagcagtaatgtagtaggaagacccgtcagctttactcttgagaggggcaggtatacaatttaccaagcagcatgggaccaaattctggaggacctagactgtcaaaaaagttgctgctctctgtgcaaaagagatgcttctagctgtgttgctgccacattgataagctggtagtttgagatgaggaaagaggaatttttatgtccccatgggttatgcagtctcaactacaaatttctgtctgtgaagaagggaaggacaaagcagaactgctttaagaaaggaaagcgaaaaacattaggctgattttgctggtgaatttgtaaccctaagttagcatagatcatcattttttgtccttcttataaaagtatgagaaagtataattatcctgatattaaataggaaggaaccagatctcaagggggttgagtaatttcatatgaccaacaccacaagctagatcttagggcagctagtttgacaggttttctattactttgtactgcttcttcagggctcaatgtgatactatttaatgatgataacagtggttgctagccttttttttttcacacctttgaggtctgtaaggtcttaatttttcctagcaaaattctgcaatactaaatatcagaaggaaaaaatttccagagaagtccagcattatagttactgtttattaagccctttttttttctagactggttcattgtgggattttatgcacacacacatagacatgaacactcacacacatatacacatcatatttatctaggtgtggatctcttcattgtttttgcctggaatttgagggactcattttatcaatatcctcagctttctcctcagctcagaaaagttatcctcagttatacttttaataattgtttttctgtcaccttcatcgaaatgcctgtgatggctaagtcagttcagcccttcatatctatagtcttttctctcttcttttccatgttttagtttttgacttttgtactctggagaccttcagaatgtgaggattttgttttattttctgtagtgttagtttggcttttacttaatgtgcctctcttgacctacctttccctccttttttcccatatttcaataaatggaaccttcatccacccaattgctcaagccaggagctctctgtgtctgaattcttacagacaaaaccatgccgtatcttttctaacatacatccaaagtatacgttgaatcatttcatttcacaaagcaaaatagtggctaaggtagggctggaacccaggttttctagaacaccctggtttatatcctggctccaccactttctacctgtgtatccatggggaaattacttgacttctctgagtgctcatttttaaaataagacatgaagatagctacatttcagagatacatttacaacattctatgacttcatttctatgaaatgtacagcttaggcaaatctatagagacagaaaatagatcagtggttgcctagtgataagagggtctaggagggaaatgtggggagcattgactgctaaagggtatggggtttctttttggggtagtgaaaatgttctaaaattgattgtggtgatagtttgacaattctgtgaagatactaaaaaccatttaattgttagctttaaagggtgagttatatggcatatgaactatatttcaattaagctgtttacaaagaaaaaaaaaaagagtaaaggagggaaatttcctgagatggccaacgatggagtcccttctgcctcaaaggcccagatgaaccttttcccatgttctagtttggccatccaggtttgtagcccaatgaaactctcataagtatgtggtcttggacctggacagagtctcctcagctgcatcacagtgaccattttaacaggcttgcctccctttagaaacacagcttggaaacctctatccctttgtggattttggaagctacatttggcagcttcctaaggtaagcacagagcaaaaataatttgccacctggggctttatggcagatggaacttagtcgcctcttaatatcctcagctgaagagttgagacatacctcgggcctcaattttttcaaaggtctgatccatttgtctttaatgcaagctgcactggcctgatagtcctggtaattccaatgctgaattacttgagacattttatagagttaagggcatatgttttaaggaatctgctttaatcgtcctcactgagaaatatcctccaatgtggattactcagtgcaggtttactggagacatttgatacaatctggaagatttaagagttgaagacatgccctgggtctccattttataagaggttccatgcatcagtcttcacaacaaaccattcttgcctttcaccttccactgagccaatccacattaaaaggaagctgaaagaaatgacacaacttgcactttgattttataagaagttggatctatttatccccattggaaccattctagaattactcccaacaacatagatttattctgaactttcaatgcaatctatataacagagttggggacataacttggacctaaattttgtaagaagttggatcttcccatctccacaaaaacaaccctggcctgtctctctcccatgctgaattactccagtttttcaataacttctggaatatataagagttgatgatacacctcaggctgcaattttgtaagaagttgctcctacttatctctattacaaagaatcctgaattaacaccgcccagagtgaaatcacttcatgcagatttactgcaggcattctctgtggtcaggcattttactggagacattctgtatgataagggaacctgaagagtgaatacgtccagttggtctgacagactaacctggtgccatcttttcccacttcaagaattcctttgaaggttcaactagataatatagttatagtacttggcacacagcagtctcttaaccaatgtttgttctcactgcctctgaacccatttctattgtctccattcatacaaccacatgggtatatttatcatgtgtatttacacacactcgtgtatgtattcatatctattacatatataggagtgtacatatacatttgtgtgtgtgtgtgtgtatatatatatatacatacatgtatatgtaatacatatatacacatctattcatcgccattggaaccatcctagaattactcccaacaacatagatttattctggactttcaatgcaatctatataacagagttggggacataacttgggcctaaattttgtaagaagtttgatccccccatctccacacaaaccatcctggcctggatgttttgatatatatgtatgcgtatatgcattacatatatgtgtgtgtgtatatatatatatacacacatgtatatgtgtatgtttgtatatacatatattctggagtaaaatgggtagttatttaagtcatttgaaggaatgctgaagctatttaccacagagatctgttttgagtattcggtgtgaaggaaggatatgaatattttagaaagacaaaaataaaatattactttgactgaaagagatcagtgcatttccatctttctttaaaaacacagaaaataaattaggaaatgagtctatttgtgtggtatgggggaaagcaactgtccctcaagtggcccatttgttcttggatctccatgcaaaaggcaaactggagaccagggaggctggagcaacctagataggacatcagtagggaggccatgtgattggccctgaggcacctcacagactgtcatctcaagtactgttgtggagccaaatgctgaagtgaataaaatatgttctagttatgcttgggagacctcccgagtccagctgccttactttcctcctccctttgctttattttgccaagattatgctagaaggaaaaggcgagaggagaggagagtgctgggacaactccatcactaaattatatatgttacacttttacttgcacttagaaaatcttggattgcctatcagccctgtgtttacttcagattgggagagaactaggaagagcgctagaagatttgatctttcactgactttgggaaaatttctttgatatcctgagcatcaacttcactatttgcaaaaatagcaatagagataatagtactttcccccctcttttcacatattgcttgttatcaacatataaagcgcaaacagatattattttgaactccttcctagtttcacataattcacatttaaatgagactaaaatgtttagctaaactcaaagaagaaaaaaattggcagaagtgaaatattttctacatattaaaatagcagagattaaaaaataatgacatgtattggtaagagtacaaggagatgggcagtttcatattcttctagtgaaggttgaaattttggtatatggtgagagataggcatctagtttcattcttttgcatatggatatccagttttccagcaccattgattgaagagactgtcctttccccaatgtatgtgtctgatactttggtcaaaaatgagttcgctgtagatgtgtggatttgtctttgggttctccattctgttctgctgatttatgtttctgtttttatgccagtaccatgctgttttgattactatagctctgtagtataatttaatgtaaggaaatgtgattcttctagttttgttatttttgcccaggatttatttggatattctgagtctgtagtggttccatatagattttaggattttttttctatttctgtgaataatatcatttgtattttgatagagattgcattgagtctgtagattgctttgggtaggatggacattttaacaatattgattcttctaatccatgtacatggaatatctttacattttttggtgtccacttcaatttcttgcattaatgttttatagttttcattatagagatcttttacttctttggttattcttagggttttttttgtagctattgtaaatgggattactttcttgaaattttttttctgattgtttgctgttggcatatagaaatgctactgatttttgtatgttgactttgtatcctgcaactttactgaatttatgtatcatttctaacaatttttttcatgaagtctttagtaggtttttccaaatgtaagattataccatctgaaaacaaggataatttgactccttccttttcaacttggatgccctttatttctttctctcgtctgattgctctagctaggacttccactactatgttgaataactggtgaaagtggacacccttatcatgtacctgatcgtgaaagaaaagctatcagttttttccccattcattacaatattagctatgtgttggtcatatatggtttttattatgttgagatatgttccttctatgtccagttttttgagggtttttgtcatgaagagatgatgaattttatcaaatcctttttctgcatcaattgaaatgatcatatgatttttgtctttcattctgttgatatgatgtatcacaataattgattttgtatgttcaaccatccttgcatgcctgagataaatcccagttggtcatgatgaatgatctttttaatatattgttgaatttggtttgctaatattttgttgaggatttttgcatcaatattcatcagcaatagtggcctatagttttcattttttgatgtatctttgtctggctttggtatcaggataataccagccttgtaaaatgagtttggaattattctgttattctctattttttagaatagtttgggtaggataggtgttagtttttgaaatctttggtagaattcaacagtgaattctaccaaattcacttttcaatatggcttaaatctctttacctgttatttgtctgtacaagttttggatctcttcatggtttaatcttaataggttgtatgtttctaggaattgattcatttattctagattttccaatttattggaatatagttgctcatagtagtaattaatgtggtaccatttgtaacatctcttttttcatctctgattttcattcagctattttcgcttttttccttggttaatctggctaaaggtttgtcagttttgtctgtcttttcaaaacaccaacttttagttttgtttatcttttgtattgtttccttcatttcagattcatttatttctgctcttgctgtttattatttcgtttattccactagttttgtgtttggtttgtgcttgcttttcaagttctttaagatgcatcattaggttattttaagttttttatttcttttttgatgtaggcacttatagctataaacttccctcttagtactgcttttgctgtatcccataagatttagcatattgtatttcaatttccatttgtttcaatacattttctaaattttttcttaattttttcattaacctactggtcattcaggagcatattgtttaatttctgtgtatttgcacagtttccacagttccttgtgctattgatttctagttgtattctgttgtgttcagagaagatgcttgatttaaaaaatattttttttatttcagtaggtctttggggaacaggtggtgtttggttacacgaataagttctttagttgtgatttctgagattttggtgcacccatcacccgagcagtgtacactgtacccaatgaatagtcttttatcccttgctacccccaccctttcccaagtccccaaagtccaatatgtcatttgtatacctttgcgtcctcatagcttagctcccacatatgagtgagaatacacagtgtttggttttccatttctgagttacttcacttagaataatagtctccaattccatcaaggttgctgtgaatgccaatatttcattcctttttatggctgaatagtatttcattttatatatatatatatatatatatatatatatatatatatatatatatatataaaattttctttatccattcattgattgatgagcatttgggctggtttcatatttttgcaattgcaaatcatgctgctgcaaacatgtgtgtgcaagtatctttttcatataatgacttcctttcctctgggtagatacctagtagtgggattgctggatcaaatggtagatctacttttagttctttaaggaattttcacactgttttccatagtggttgtactagtttacattccctccaacggtgtaattgtgttccctatttgccacattccagccaacatctattactttttgattttttgattatggccattcttgcaggagtgaggtgttattgcattttgattttgatttgcatttctttgatcatcagtgatgttcagcattttccatatgcttgttgaccatttgtatatcttcttttgagaactgtcttttcatgttcttagcccactttttgatgggattgtttgttttttccttgctgatttgagtttttgtacattctgaatagtagttgtttgttggatgtgtaaattgtgaagattttctcccactctgtgggttgtctgttaactctgctgattatttcttttgctgtgcagaagctttttagtttaattaagttccatctgtttatctttgtttttgttgcatttgcttttgcattcttggtcatgaaatctttgcctaagccaatgtctagaagagttttttcaatgttatattctaaaatctttatggcttcagtcttaaatttaagtttttgatccatcttgagttgatttttgtatagggtaggagatgaggatccagtttcatttgtctatatgtggcttgacaataatcccagcatcatttgttgaacagggtgtcctttccccactttatgtttttctttgctttgttgaaaatcagttggctgtaagtatttgggtttatttctgggttctcttttctgttcaattggtctagatgcctatttttataccagtgccatgctgttttggtgacgatggccttatagtatagtttgaagtcaggtaatctgatacctccagatttgttctatttgcttagtcttgctttggctatgtgggctctttttttggtcccatctgaattttaggattgtttattttctagttctgtgaagaatgacggtgatattttaatgggaattgcattaaatttgtagattgcttttggtggtatggtcatttaaacaatattgattctacccatttatgagaatgggatgtgtttctatttgtttgtgtcatctataatttatttcagcagtattttgtagtttttcttgtagaggtctttcacctccttggttaggtatattcctaagtattttattttatttttttcagctattgtgaaaggagttgagttcttgagttgattctcagcttggccactgttgctgtatagcagagctactgatttgtgtacattaattttgtatcctgaaactttgttgaatccatttaccagttctaggagctttttggatgagtctttaggattttctaggtatacgatcatatcatcagcaaacagcaatagtttgccttcctctttttacctctttggatgccctttatttctttctcttgtctgactgctctggcttggtcttccaatactatgttgaatagaagtggtgagaatgagcatctttttattgttccaattctcaggggaaaatgctttcaacttttgcccgttcggtataatgttggctgtgagtttgttttagatggcttttatttgttaaggtatgttgcttctatgccgattttgctgagggttttaatcataaacggatgctgggttttgtcaaatgctttttctgcatctattgaaataatcatgtgatttttgttttaaattctgtttatgtggtgtgtaacatctgttgacttacgtatgttaaactatccctgcatcccaagtatgaaacctacttgatcatggtggattgtctttttgatatgctgttgtattaggtttgctagtattttgttgaggatttttgcatctattttcatcagggatattggtctgtagttttcttcttcttctttttttttttttttttttgtttgtttgtttgttaggtccttccctggtttttggtattagggtgatactggcatcatagaatgatttagggaggatttcctctttctctgtcttgtgtaatagtgtcaataggattggtaccaattcttctttgaatgtctgatagaattcagctgtgagtccatctaatcctggacattattttgctgacaatttttaaattaccatttcaacctcactgcttgctattggtctgttcagagattctgtatcttcctggtttaatctaggagagttgtatatttccaggaatgtatccatctcctctaagttttatagtttatgtgcataaaggggttcacagtagtgttgaataatcttttgtatttccttggtatcagtggtaatatctcccgtttcttttgtaattgagtttatttggatcttctctcttctttacttggttaatctcactaattgtctatcaattttacttatattttccaagaaccagctttttgtttcattatcttttgtattttttttttgtttcaatttcatttagttctgctctgatcttcattatttcttttcttctgcggggtttgggtttggattgttcttgttgctccacttctgtgcggtgtgaccttagattgtctgtttgtgccctttcagactttttggtgaaggcatttaatgctatgaactttcctcttagcaccgcatttgctgtttcccagaggttttgagaggttgtgtcactattatatttcaattcaaagaattttttaatagccatcttgatttcattgttgacccaaccatcattcaggagcagattatttaatttccatgttatttgcatggttttgagggttccttttagatatgatttccaattttattccactgaggtctgagagaatacttgatataaatttggttttcttaaatttactgagatttgttttgtggcctatcatatggtccattttggagaacgtttcatgtccttatgaatggaatgtatattctacagttgttgggtagaatgtcctgcaagtatctgttgagtccatttgttataggctatagtttaagtccatcattcctttgttgactttttgtattgatgacctatctagtgctctcagtggattactgaagtcacccactattattgtgttgccatctatctcatttttaggtctagtagtaattgttttataaatttggaagctccagtgttaggcacatatatatttaggactgatattttcctcttgcactagtccttttatcattatataatgttcctctttatcttttaagattgctgttgctttaaagtttgtttagtctgatataagaataactactcctgctggttttggtgtgcatttacatggagtatctttttccactcctttaccttaagtttatgtgggtccttacgtgttaggtgagtctcctgaagacagcagaaacttggttggtaaattattatccattctgacattctgtgttttttaagtggagtatttaggcccattacattcaatgttagtattgagatatgaggtggtattctattcaacatgctatttgttgcctaaataccttgttttctttcattgtgttattgttatataggtcctgtgagatttatgctttaatgaggttctattttggggttttttgaggatttgtttcaagatttagacctccttttagcatttcttgtagtgctggcttggtagtggcaaattattttaacatttgtttgtctggaaaagagtgtatctatccttcatttatgaagcttagttttgctggatacaaaatttttggctgataattattttgtttaaggaagctaaaaataaggccccagtccctttgagcttgtagggtttctgctgagaaatctgcgttcatctgataagtttttcttcataggttagctgatgcttttgcctgatagctcttaagattctttcctttgtcttgactttagataacctgatgactgtgtgcctaggtgatgatctttttatgatgaatttcccaggtgttctttgagcttcttgtattttgatttctagatctctagcaaggtcagggaagttttccttgattattccttccaatatgttttccaaactgtgagatttctcttcttcctcaggaacaccaattattgttaggtttaccatagtcccaaacttcttggaggctttgttaattttttaaaattcttttttctttgtctttgatggatttggttctgcttgttcgattctattgctgagattttccagtgaatttgcatttctctaagtgtgtccttgattaccagaagttgtgattctgcttttagttattctatttcactgaagaattttcctttcattttctggatcatgtttttgattcctttaagctggacttcacctttctctggtgcctccttgattagcttaataattgaccttctgaattctttttctggcaattcagagatttttatcttggcttgggttcattgctggttagctggtatgatgttttgggggtgttaaagaaccttgttttgtcatattaccagaattgtttttctggttcattctcatttgtgtagactatgtcaggggaagatctgggattcaaaggctgctgttcacattcttttgtcccatggggtggtcccttgatatggtgttctcccccttcccctaggaatggggcttcctgagagctgaactgtagtgattgtttttgcctttctgggtctagccacccagtggagctaccaggctccgggttggtactggggagtgtctgcaaagagtcccgtgatgtgatctgtcttcaggtcttgcagctgtagataacagcacctgctccggtgaaggtagaggtagcagggaagtgaagtggactctgtgatggtccttggttgtttttgtttagtgtgctggttttgtgtttgttggcctccagccaggaggtgacgctttcaagagtgcatcagctgcagtcctataggaaggatgcaaacttgccctagggtcacctggttaaatattcaggtttctcaggtggtgggcagggccatagagctccagagagattatgatctttgtctttggtaccagggtgggtggagaaaaaccaccaggtgggggcagggataggcatatctgagctcagattctctttgggcagggcttcctgtggctgcctttgggaagggggtgtggttcccagtccattggagttatattccctgggtgattatagctgcatctgctcggtcatacagttcaccagagaagtgggggaaagacaggagtcacaggcctcatcccgctgccttgcagcctgcagtcctaaaggccagtctcactcccactatgcccccacaacagcactgagtctatttccagatagccagtgaccagcactgagaacttaccccagatcacaaacctccccattgagaaagcaagcagacacagtttttcggtgtttcacggagcctgcagtggtgatccagttccttcaaagggtctgtggattcctttggctttcctagtattttcctgcagttgttcttggagcaaaagttcacgatgtgagtctctacacactgctttgtcagtccaaggaggagctgcaagcttgtcctgtttcctatctgccaccttaatctctatagaccaccacaatgcttgatattatttcaattttttgaatgttttataactgttttgtgacctaacatatggtttatccttgagaaagatctaagtgatgaggaaaagaatgtgtgttctgtagctgttggatgaaatgttctgtaaatatctattaggcccatttggtctatagttcagattaagtccaatgtttgtttgttgattttctgtctggaatatttgtccagtgctgaatgtagggcattgaagcctcccagctattattgtattggggtctgtctccctttagctctgataatatttgctttatatatctgggtggtccagtgttctatatgtatatatttataattattgtatcctcttgccaaattgacctctttatcattatacagtgactttctttttgtctttttctagtttttgtcttgaaatccattttgtctcatataagcatagctactactgctctttttttggtttccattggcgtggaatatctttttctgtcctttcattttcagtctatgtgtatttctataggttaaatatgtttcttgtaagcaaaagatctttttttctgttttttaaaatccattcagccagtctatgtcttttaattggagagtttagttcatttacattcaatgttattattgataactaaggacttactcctggcatttggttatttgttttctggttgttttgtagtgtttgcttctttctttcctttttgtcttccttttagggaagatgattttctctagtaatatgacttaatttcttgctttttaattttcatggatttgtttcatgttttttgatttggggttaccatgcggcttgtcaatactgtctttaacccattatttttacttgataataaattaacactgtttgcataaacaaagaaacaagcaaaaagaaaagtaacaacaattctacacgtcaatttcatccccccactttttaactttttgatgttttgatttatattttattgtaatgtctatgtcttggaaagttgttatagttattatctttgattgattcatcatttaatttttctatttagtataaaattagtttacacaccacacttacagtgttatgatattttgtgtctctctgtatacttactattagtagtgagttttgtaccttcagttgatttcttattgctcattaacattcttttcttttttactgaagttctctctttagcatttcttgtgggacaggtctaatgttgatgaaaacccacagcttttgtttgtctgggaaagtttttatttctccttcatgtttgaaggatattttcaccagatatactactctggggtaaaggtttgttttcttcagcacttcaaatatgctatgcctctctctcctggcctgtatgtttttcactgaaaagtctgctgccagacgtattggagctccattttatgttgtttcttttctcatgctgcttttagggttctttctttatccttcacctttgggagtctgattattaaatgccttgagatagtcttctttgggttaaatctgctttgtgttctataacttttttgtagttggatattgacatctatctctaaatttgggaagttctctgtttttatccctttgaataaactttctactcctatttctttctctacttcctctttaaggccagtaactcttagctttgccctttagagactattttctacatcttataggtatgcttcattgtcttttattcttttatcttttgtctcctctgaccatgtattttcaaatagctgtcttcaagttcactaattttgtcttctgcttgatccattctgctattagactctgcatttttcactatgtcaactccatttttaaactttagaatttctggtttttttttgtttatttcaatatttttaatttatctgatagcattctgaattccttctctgtgttttcttgaatttctttgagttttctcaaagcagctattttgaattctctttctgaaagaaggtcacatatctctttcttcaggcttggcctctggtgccttattgagttcatttagtgaggtcatgtttttcaggatggtgttgatgcttgtggaaatccacctgtatctgatctgggtgttggaaagttagatatttactagtctttatagtctgggcttgtttgtatgcatcctccttgagaagcctttcctggtattcaaaaggacttaagtattaggatctaagccttgtctgcattaggaggcaccccaagccaagtaacactgtagttcttgccaacttctagaagtacaactgtgatgatcttggattatatccagaataattccttggattattaaacaaaaacttttgttctcttcccttatttcttccaaagaaatggagtctgtctgtctgttctgtaccacctggagctggggggggggggggggcagtgacacaagcaaccctgtggtcaacgccagtgggcttctcctgagttagacctaaagccagcacagccctggatcttgctgaaggcccactgtaaccactacctgtcttccatctatgtttgttcagggccctggggctctacaatcagcaggtgcttaagcctgccaggcttgcgtccttcccttcagggcagtgacctcccctaggccctggtcaggtccagaggtgctgtctgggatctagagcctggagtcaaaacactctagaagtctacctggtgttctgttgtactgcagctgagctggcactcaaactgtgagatgtggtccttcccacgctttcctccccattccacaggcagagaagcctcaccctgttgccaccactacaggcccacagagggtagccaatgtcccctaaagctcaagagctctttagttggtttgtggtgaattctgcctagtctgggactcacccttcatggtagtgggctcctctctggcccagggcacatccagaaatgtcattgaagagccaaggcctggaattgagtacctcaaaagcgctcttggtgttctgtccctttgtggctgagctggtgagacgtgacagcgtgctggcagtcctcagagccctcgcttgctctcggcacctcctctgcctgggctcccactttggcggcatttgaggagcccttcagcccaccactgcactgtgggagccgctttctgggctggccaaggctggagcccactccctcagcttgcagggaggtgtggagggagaggcgcgagcaggaaccagggctgcgtgcggcgcttgccggccagctggagttccgggtgggcgtgggcttggcgggccccgcactcagaacagccggccggccctgctggctccgggcaatgagggacttatcacccgggccagtggctgcggagggtgtactgggtcccccagcagtgccagcccaccggcgctgcgctcgatttctcaccgagccttagctgccttcctgcggggcagggctcgggacctgcagcccgccatgcctgagtctcccacccactccatgggctcctgtgctgcccaagcctccccgacgagcaccaccccctgctccacagcgcccagtcccatctaccacccaagggccaaggaatgcgagtgcacggcgcagtactggcaggcagctccacctgcagccccggtgcaggatccactcggtgaagccacctgggctcctgagtctggtggggacgtggagagtctttatgtctagctcagggattgtaaacacaccaatcagcaccctgtgtttagctcaaggtttgtgagtgcaccaatcgacattctgtatctagctgctctggtggggccttggagaacgtttatgtctagctcagggattgtaaatacaccaatcggcactctgtatctagctcaaggtttgtaaacacaccaatcagcaccctgtgtctagctcagggtttgtgaatgcaccaatcgacactctgtatctagctgctctggtgaggccttggagaacctgtgtgtggaaactctgtatctaactaatctgatggggacttggagaacctttttatctagctcagggattgtaaacacaccaatcagcgccctgttaaaacaggccactcagctctaccaatcagcaggatgtgggtggggccagataagagaataaaagcaggctgcccgagccagcattggcaacacgttcgggtccccttccacactgtagaggctttgttctttcgctctttgcaataaatcttactactgctcactctttgggtccacgctgcttttatgagctgtaacactcacggcgaagatctgcagcttcactcctgagcccagcgagaccacaagcccaccgggaggaacgaacaactccagacgcgctgccttaagagctgtaacactcaccgcgaaggtctgcagcttcactcctgagccagcgagaccacgaacccaccagaaggaagaaactgcgaacacatatgaacatcagaagggacagactccagacgcgccatcttaagagctgtaacactcaccgcgagggtccgcggcttcattcttgaagtcagtgagaccaagaacccaccaattccggacacactggtacctaaagtgcaagacaaagtcccttttgcttgtccctccacttttcccaaacagaaggagtctcttctcatagccagcacagctgggaatttgctgtatattacctgaagtcaataagtcttagagtctcacgcaaggcctatagtatacttcctgggtatcactactggttattcagggcccaagggctctttagtcagcacatggtaagtcctggcaggactgggtttttcacttcaaggcaatggatttccttctggcccagggtgtgtctagaaatgtcattcaggatctagggcctggaaatgagaactcacaactctgattggtgtcctattttactgtgactgagctggtatccgtgatgcaagacagagatgtctttactctcccctctcctctcttcaagtggaaggaagggatttattttggaactgcaagctgtacagcttggggttgggggacaagtggtacaagcatttccttagcttccccagctggagtctcagtagctcacatatccccctgagtctactggctcttagccaagtttagcactaggacttgccttgaatttgcagtccttgtggcccagactgcttttctatttttttgacggcaatattagatttattaaagttccatatttaaaaacgcaatacatctttaagcttttgtgttcatcttttttttaaaattatactttaagttctgggatatatgtgtacaacgtgcatgtttgtttacataggtatacatgtgacatgtgagtttgctacacccatcaacttgtcatttacattaggtatttctcctaatgctatccctccccaagccccctacccccaacaggccctggcatgtgatgttcccctccctgtgtccatgtgttctcattgctcatctcccacttatgagtgagaacatgtggtgtttggtcttctcttcttgtgttgctttgctgagaatgatggtttccagtttcatccatgtccctgcaaaggacatgaactcatcctttttttatggctgcatagtattccttggtgcatttgtgccacattttctttatccagtctatcattgatgggcatttgggttggttccaagactttgctattgtgaacagtgctgcaataaacatatgtgtgcatgtgtctttacagtagaatgatttataatcctttgggtatatactcagtaatggggttgctgggtcaaatgatatttctagttctagatccttgaggaattgccacactgtcttccacaatggttgaactaatttacactcccaccaacagtgtaaaagcattcctatttctccacatcctctccagcatctgttgtttcctgactttttgatgatcaccattctaactggtgtgagatggtatctcattgtggatttgatttgtattttccaatgaccagtgatgatgagaattttttcctaactttgttggctacataaatgtcttcttttgagaagagtctgttcatatccttcactcatttttttttcaaggggttgtttgtttttttcttgtaaatttgtttaagttctttgtagattctggatattagccctttgtcagatggacagattgcaaaaattttctcctattctgtaggttgccttttcagtccgatgatagtttcttttgctatgcaaaagctctttagtttaattagatcccacttgtcaattttggcttttcttgccattgtttttggtgttttagtcatgaagtctttgcacatccctaagtcctgaatggtattgcctaggttttcttctagggtttttatggtttttaggtcttacagttaagtctttaatccatctggtgttaatttttgtataaggtgtaaggaagggaaacagtttcagctttctgcatatggctagccagttttcccagcaccatttattaaacagggaaccctttccccattgcttgtttttatcagatttgtcaaagatcagatggttgtagatttgtgatgttatttctgagggctctgttctgttccattgatctatatctctgttttggtaccagtaccatgctgttttggttgctgtagccttgtagtatagtttgaagtcaggtagtgtgatgcctccagctttgttcttttggcttaggattgtcttggctatgtgggctctttttggttccatatgaaatttaaagttgtttttttccaattctgtgaagaaagtcattggtagcttgatggtgatggcattgaatctgtaaattaccttgggcagtatggccatttttacaatattgattcttcctatccatgagcatggaatgttgttccatttatttgtgccctcttatttccttgagcagtggtttgtagttctccttgaagaggtccttcacatcccttgtaagttggattcctaggtattttattctctttgtagcaattgtgcattggagttcactggtgattttgctctctgtttgtctgttattggtgtataggaatgcttgtgatttttgcacattgattttgtatcctgagactttgctgaagttgcttatcagattaaggatatttggggctgaaatgatgaggttatctaaatatacaatcataccatctgcaaacagaaacaatttgatttcctcttttcctgtttgaataccctttatctctttctcttgccttattgctctgaccagaacttacaatactatgttgaataggagtggtgacagagggcatccttgtcttgtgctggttttcaaaggaaatgcttccagtttttacccattccatatgatattggctgtgggtttgtcataaataggtcttattattttgagatacattccaaaaataactagtttattgagagtttttagcatgaagggctgttgaattttatagaaggccttttatgcatctattgagataatcatgtggtttttgttgttggttctgtttatgtgatagattatgtttattgatttgtgtatgttgaaccagccttgcatcccaggaatgaagcctacttgatcgtggtggataagctttttgatgtgctgctggattcagtttgccggtattttattgagaattttgcatcgatgttcatcgtggatattggcctacaattttctttttttgttgtgtctctgccaggttttgttatcaggatcatgctggcctcataaaatgagttagggaagattccctctttttctattgattggaatagtttcagaaggaatggtaccagctcctctttctacctctggtggaattcggttgtgaatgtgtctggtcctggactttttttggttggtaggctattaattactgcctcaatttcaaaacctattattggtctattcagagatttgacttcttcctgatttagtcttgggagggtgtatgtgtccaggaatttatccatttcttctagtttttctagtttatttgtgtagaggtgtttatattattatctgatggtagtttgtatttctgtgggattggtgatgatatcccctttatcattttttattgcgtctacttgattcttctctcttttcttctttatttgtatagctagtggtccatttattttgttgatcttttccaaaaaccagctcctggattcattgattttttgaagggtttttcgtgtctctatctccttcagttctgctctgatcttaggtatttattatctgctgctagcttttgaatgtgtttgctcttctttctctagttcttttaattgtgatgtgagagtatcaattttagatctttcctgctttttcttgtggacatttagtgctataaatttccctctacacattgctttaaatgtgtcccagagattctgatacattttgtctttgttctcattggtttcaaagaacatctttacttctgtcttcattttgttatttacccagtagtcattcaggagcaggttgttcagtttccatgtagttgtgcagtttttagtctgtttcttaatcctgagttctaatttgattgcactgtggtctgagaaacagtttgttgtgatgtctcttcttttacatttgctgaggaatgctttacttccaactatgtgatcaattttggaataagtgcaatgtggtgctgagaagaatgtatattctgttgatttggggtggagagttctgtagatttctattagatctgcttggtccagaactgagttcaagtcctggatatccttgttaattttctgtctcgttgatctgtctaatgttgacagtggggtgttaaagtctcccattattattgtgtgggagtctaagtctctttgtaggtctctaaggatttgccttatgaatctgggtgttcctgtattgggtgcatatatatttaggatagttagctcttcttattgcattgattcctttaccattaggtaatgcctttctttgtttcttttgacctttgttggcttaaagtctgttttatcagagaccagaattgcaacccctgcttttttttttttctttccatttgcttggtaaatcatcctccatgcctttattttgagcctatgtgtgtctttgcacgtgagatgagtctactgaatacagcacaccaactgatcttgactctttatccagtttgccttctgtgtcttttaattggggcattttaattgggacatttcaagttaatattgttatgtgtgaatttgatcctgtcattatgatgctaactggttatttttcctgttagttgatgcagtttcttcatagcgtcgatggtcctcacaatttggcatgtttttgcagtggctggtactggtcgttcctttccatatttagtgcttccttcaggagctcttgtaaggcaggcctggtggtgacaaaatctctcagcatttgcttgtctgtaaatgattttatttcttcttcacttatgaagcttagtttggctggatactaaattctgggttgaaaattcttttctttaagaatgttgaatattggccccccctcttctggcttgtagggtttctgcagagaggtctgctgttagtccaatgggcttccctttgtgggtaacccgacctttctctctggctgcccttaacattttttccttcatttcaactttggtgaaaatctgatggttatgtgtctttgggttgctcttctcgaggaatatctttgtggtattctctgtgtttcctgaatttgaatgttggcctgccttgctaggttggggaagttctcttggataatatcctgaagagtgttttccaatttggttccattctccttgtcactttcaggtataccaatcaaacatatatttggtcttttcacatagtcccatatttcctggaggctttgtttatttctttttactcttttttctctagtcttgtcttctcgctttatttcattcatttgatcttcaatcactgataccctttcttccacttgatcgattcgaccattgaaacttgtgtatggttctcgaagttctcgtgctgcgtttttcagcttcatcagttcttttatgttcttctctatactggttattctcattagcattttgtctaaccttttttcaagttcttagcttccttgcgttgggttagaagatgcttatttagctcagaggagtttgatattacccaccttctgaagcgtacttctctcagttcatcaaaatcattctccgtccagttttgttcccttgctggcgaagggttgtgatcctttgtaggagaagaggcggtcttgttttgggaattttcagcctttctgcgctggttcctccccatctttgtggtttcatctacctttggtgtttgatgttggtatcctacaagatggggttttggtgtggatgtcctttttgttgatttgatgctattcctttctgtttgttagttttccttctaacagtcaggctcctcagctgcaggtctattgcagtttgctggaggtccactcccaaccctgtttgcctgggtatcaccagcagaggctgcagaacagcaactattgctgcctgatacttcctctggaagttttgtcccagagaggcacccgccagatgccagccaaagctcttctgtattaggtttctgttggcccctactgggaggtgtatcccagtcaggctacatgtgggtcagggacccacttgaggaggcagtctgtctgttatcagagctcgaacgctgtgctgggagaaccactgctctcttcagagctgtcaggcagggatgtttaagtctgctgaagctgcgcccacagcggccccttcccccaggtgctctgtcccagggagatgggggttttatctataagtccctgactggggctgctgccttttgttcagagatgccctgaacatctagaggtagaatctagagaggcagtcggccttgctgagctgtggtgggctccacccagtttgaacttcccagcagctttgtttacactgtgagcataaaactgcctactcaagcctaagcaatggtggacgcccctccccccaccaagcttgagcaccccaggtcgatttcagactgctgcgctagcagcgaggatttcacaccaatggatcttggcttgctgggctccgtgggagtgggacatgccgagccaggcactggagggaatctcctggtctgctggttgcaaagaccgtgggaaaagcgcagtatctgggcaggagtgtaccgttcctcctggaagtctctcacggcttcccttgggtaggaaagggaaatcccccaactgcttgcacttcccgggtgaggtgatgccgtgccctgcatcggcttgccctctgtgggttgcgcccactgtccaaccagtcccagtgagatgagccaggttcctcaattggaaatgcagaaattacctgccttctgtgggtatctcactgggagcagcagaccagagctcttcctatttggccatcttgccagaccctctccagactgcttttcaagtttatttggggtacctgtacactttagcttaccctggtgaggcttgccagaactgatgttccaactgctgggatgggcgattcccctctaactaggggtggtttaaatactccctccaagtgtaaattagttcatccattgtggaaagcagtatggtgatttctcaaaaagctaaaagcagaactaccattcgacccagcaatcccattactgggtgcatatgcagaggaatataaagcattttaccataaagacacatgcacacagatgttcattgcagcactattcacaataccaaagacatggaattaacctacatgcccatcaatgacagattggataaagaaaatgtggtagatatacaccatggactactatgcagccataaaaaatgcgatcatgtcttttgtgggaacatggatggagctggaggctatcatacttagcaaactaaagcaggaacagaaaaccaaacactgtatgttctcatttgtttgtgggaactaaatggtaagaagatatgaatacaaagaacaaacaacagacactagttgggggagggctgttgggaagagagaaaggagcagaaaatataactattggatactgggtttagtacctgggtgatgaaataatacctacaacaaacccctgtgacacgtgtttacttatgtaacaaaccttcacgtgtactcctaaacgtaaaataaaaattaaaaaataaataaaaatcaaaattaaaaaataaataaaataagtactcaatccacaggtgggcatcagctgaaattatcccagttttactttctgctgagtcagggcagcaccgaggtcaatgcaatgtttcacaattgctgtactcttcctctcccaagtgcacagattctctctccatgccatgtgaccattgctaggggatgggggaggggtaatgctggcaatttaagactgtctttcctgccctcttcattgcctctttcagtgatacaatgttaacacgaggtactgtgagtgtttacctgactgaagatgcttttttttttttttttttggttacatagttgttgaattggtgtccttgagttggggtgggacaagcagtggagccttctgtttggccttgtagctacacccctctctgaatgcagttgttaaaaagaatattatgaaagaatatttattggcatagataaatgctctcaaaagtgtagatgcttgtttacatgcttttcaacacgtaacattgtttataagaataatattgggtgaagcaaaccataaaatatcaaatgatagaggattaattagtactataatacatactctgattaaatataaagcatggttaaaaatcatgaatttggggtgttttctaagcctgtatgaatattgatgcaaatgctaaatgaaaacacacactatatgttcagtataatttataatatctgtaacctatatgtataggaaaatataagggattatatcctgaaataataattagtcaacttttatagtaggggaattatttgtttaaaatgtatttatttttaaatttgaaattaagtctaccaagtaaaatgactatcaacaaaattatggactagatgtttgcccacaaaattcatattgaagccctaacccccaacatgatgatattcggaggtaaggcttttaagagacacttaggtatagatgagttcataaggttggggcacctgtgatgtgattagtgccctcataagaagaggaagagagaccagagcttcctctctctgttgtcagaggatacagcaagtaggtggttatctgcaaccaggaagggagccctcaccagaacctgactatgctggtaccttgagcttggactttcaggctccagactatgagaaataaatgtctctgttaagccactcagaatatggtgttttgttatagcagtctgatcagactaaaacaaaatgacaacagcaaaactggaggctttctatttcaaggatccagtagtctctagtactatacaggaggtaaaatatatatctctaatgaccagaaattgttccagtaattttaaaagcatagatcccaagaggaaaggttggatcaattagcatgataataaaattgatggaaagagtagttactacttggtgtctactaggtttttgacactgtaagaggcacttttacaccttaactcatttaatctttatgacaacacagtgtgtcacttaatttttattatgcttcatgggaaggtggggattatctcaatttcacagatatggaaagtacatctctaagagattaaggcacttaagatcatatagctatcatgtgcagaaagcagcgagaatttcgtttgtctggttcctatgtatctgttattttgatgatcactatgccaactgggtgtaatgagggaagagtttttagaagggatggtattcagctatgatagttaaccaatagctagagtttaggtttgagtactctgttgtcttagagatacgttttcattaagcattgatgatgaaagctgctttagttcttacactgttcactttggatgaaataggttggattgcaaaaagggacatttttaactttttattttgaaataattttagacttactgaaaaatggcaacatcagtacagattttctgcatacttagtttcccctcattttaacttcttctattcccatagtataattattgaaactaggagacactcattgatacaatactattaactgcactacagattttatttagatttcaccagttattccactaatgttcctttcctggtcaaggatctcatccagtatctcatgtttcaattagttgccattctccttagtctcttctagtctgtgacagttctgtcttttcttgtctttcatgaccttgacatttttgaggtatactggtaagatatttttcagtatgtttctcaatgtgagtttttctgaagtttcctcatggttaaattcagattaggaatttttggtggggataacacagaagtgtgtctttcccagtgcatgatatcaagaggtacataatttctctatgtctccttactggtgatgttaaccttgatcacttaggaaatgtggtgtcaccaggtcattccattataaggatgatacagttttccctttgtattaattagtattttattaggaaatactttgagattatgtaaataccatgaatacctgtttattcatcatatgttttgctcactaattttagcactcatcaacatttcttaactacaataatcacttttgtggtgtttgcccaatagcaatgttctatctatatcattcattctacatttattaatttgaattctactgtaaaaagatctgcccttcttctccatttatttatttattcaattatttatttttattagtatatactccaaggtatttattttattatatggattgggctctattattatcatcatttaattatccctatatctcatgctatataaaataatgaactccaaaaggaacagctaaataagtgtaaaaatgaaaccacagaaatgctagaagaaaatatgggtgatttcctcttaaggtttgttgtttaaggctttccaactacaacttttcaatttacatgaaattccatatgcaaaaataactaaatacataaaatattgataaattagactacatgaaactaaaacaattgcactataaaacacgataaacaaaattgaaagacaactgataaacaggaagaaaatgtttgcaccatatcacaaaagactaatatcccccaaatataaagaactcctaaatcgacagctaaatgactaaaaacctgatagaaaagggaaaaaaagacatgaacaggaaattcacccacacacttacacacaaacacacacacacacatgtatatatatgtgtatatgtaaagatgtcccataaatataggaaaaatgcctaagctcacttataattagagaaatgcacattaaaacaatagcaagatgctgttttcttcctatgaaactggtgaaaatttaaaaatatgacaacatattcttttggcaaggctgtggggaattactcctccttattgctgatgggaatgcaaaccagtgcaaaaggggactttttcaactatctagcacagatgttatacagatgaaacagaaatgtatttattttctggtgatatttgggagaaggctgcgttacgatgatgtttctggaggtcactggtaatgtaagttatattacataagattatacaactgacatttatagctacttgaaatactttcccaaactttcccttattgattgtctttaaggaaatatagtcatgttcagggagtgtcaaaatgccagccatctccattgttactgaaactatttctgcttccctcctactctccacctgattcagagatctgacttactttctacaagaaaatagagctatagagtcatataactcagagctgaaaagacctttagagatgatctagcccatgcctgaatgatttagaggagtaaatgaggcccagagaggggcaatgacttgtccagggtcacacactgagccaagactggaagaaaagggtcctgaccagaatgctccatatctcttgcaagatatgtgtaaattaccagacacacagtaggcatgcaatatatgagagcaataacaaccatttatttcaaagggtgcaagggttcccaatttcattccatgagaggaatttgtgttttaagtatcaaattgaggaaagcatacactctatttctgtaatcattaataatatttctcccagggttctcaagtagcaggcatccattagcacttaacagctataacatcatgagaaggcatcaacggagtagtgactactaaatttcagtccagctctattatcttttcctcttgatagtttgacttcgagctttagtaactgtgggcctgcactgggcctggagcctccatttcaaaggaggcttgtggttgcacagtgcacaaggatgcataccgagggaggtaatgggagctagaatccagcgtatgatctgctaactaaacctggagcccttgcttgggactgtcttttcccaaggaagggggactttgttctcccaaaggctgtctacatgtgcctacagagttgtgtctaccttgaggggagagcttattaattcacacagaggtgctgtataaggtaatggaggctgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactgtgagtcctattaaacctctttcttttgtaagttgcccagtctcgggtatgtctttatcaacagcatgaaaatggactaatacaggggctctggttagaattaaaaaccaagtctgtctaaatataaagcctgtgtttctccatctttactcagaaagctatgtttttatttattatttttattttttaataatttaatttttatgggtacataggtgtaagggctgtatttttaaatcttaacccaggaagctagaagattttatagaatatctgctccaaatcttaccctttatagactataattttggccccttatgattaagtgccctgcacataatcccacagtacatataccttgctctgaaggtatcattcagtgtatttctggaaaaaaaggaagtctttaatttttcaaatattaggaagtctctaggccttgagacatactgttcaggcaggattcttttaagatgccaaaaacatactttcagcattcctttgtttttataaagcctttaaaaatatctgcctggaaatttatactaagtcttcacttaattcaaggcagtggatattatagcttatttggggactccaaacttgaattttggggttttaatgtgacacaatagtgtgaacacggtttgggtatggatgaatcttggttatttcctggtgctttttcgaagtagttttataactctgggctggccatttaactccacaaagatgtattacctatttttttttttcagttaatagtaaattatgattgtttttccatgtcattatcgtgttatataattatttttatgtctgcatagtatcattgtgtggctcaactatcaaaagtaatcaatctcctattatggttagatgtctgtgctatttcccataactgtgataatttctcttatagctttatctctgcaaggcctctaattctgagtgttatttttcagatgaaatctgcctactctagatatctatgacaataccaagaaatttatttagctcgggaatttctaaatatggaaaaattagtaacaatagttactgtttattgagtatctaccaggcgctggatcccttctaaatgaatattttgggttaggaaatgtttcaagatgggcctcaccagctgttcacttcaactgtagggaaatccagtaggaagtgtggttgtgatcgccatagcctcctggtattctggccagtacaactcagcagtaacataaaatcccaggataccaaatcagtttcaaaatggagttcttcttctagggagggtagttttcattttgatccagtttgtaaagagtcctttctggtagttaaatgcacatgccgtttctctcttagtttcttcttttcattgttcctggttgcagatattaaaaacatatcattagcataagagaagaaacgtatttcccaactcactgtggcatatattttactcatctataagtggtagccgacagccaaggatacattttaagagtataaaaaccttagccctcatccttctaaaatgaatacttagtcattcttaatttctgttctcagcaatcttcaggatatttgtatatatttcctagtgttgagaaaatgaagtataaaaatttattaagagatgagccacaataaggaagatgccagcaagcatgctcagaatggtgcaatggtgtgcatttgtctcttccactctacttaaacctcaaaactctatgctagtttcagctcctgctttctttgattgtattttaaaatgaggcagctaggtagattgactgtcccattcacctaagtagtaaatgatgtttgtgtgttccagagctagaggaagtttgggctttctgtgtgatgcacatgttgcaatcatatatactaatgcctgcatactccctctgcatactaatggcagagaaaagctattttgaatgagaatatttacattcagaacctggagccttttagaaaaatagtaacaaattttgataaattttcaatctgtgggctttcctacatttttatagaacatgatttagagatcccagctgaggagcctatgataatagctcatcattatatagcatagattgcattcagttattcatttgttcattcaacaaatatttatgaaacacatggtatatgccttttcacctgtaataaaaattagaaatcggattttctgacttaagtgccaaatgcatttgctacagaaaataaggtgattagagagagatgttagcatatggctagttggagccagggagcagatgatattcacagcaggagtgagtatagagaaagaagaggaaggtgttaacaaaggagattttggaagaccaagatttaggcaaggagtgtagatgtaaaagagtccaccaaggaaactgtgaaagataatatagtgagttaggtggaaaatgattctgcttgttgttggaaactagggaacaggtgaaaaccagagagagcataactaagctgtacaaatcaaactattatttttatgtgtaacaataaaacaatgggctgtttttattattgtaatgataaaattcattcctatcctccaaggtattgtaggttacaaaggaagtcatatagattatgtttttgtcccctcatcaacattgagaatgaactcacaaatgaatagcgtgttttatatatgcttagtttatcatcaaaatgtacatgtattttatagccaaaagctgcataatagccgttaagaaaacaaatgttaacttcaccatgatccctaagaaatttccaatatgagttcaataattcactgattttccctgatatatctgactaacattatcatcagctaattttccagtgttaacattttttatacatcatttggatcagaactttatctactatctgagtcattaagaagtcattttggtcagtattaagattattcaacaaaatgaacatcagccaaagctttactttagctgaaaattatccaattttgaattttaaaatttaattaaatgaatttaagccatgaattccctctgtggaactgcacatctggagctacttgcaggatttgcaccttccattttgctgcttatgctggttgcagcagttctggcagagtattcagaataacccagaggcttattagtagagtaggaacagagtctaagagtgaatactataaggaaagggaaaggatggggcagagcaaacagtgacccagggagatcggaatacttaaaataattagatttctagaaaaactgaatgcttactctcacatctgccaacactgctgctacctttatggatgtgacacaacatttgtgctatacttcagagaaatcttagagacattttctgtctcttgccagtatctccagttcttcagtatgtagaggaactgaagtgtggctgggccatttaactccatacatgccttcagaatgattcatacatttacaaagctatgtcagtcttctttcttctgaaggtttttcaggttttgtttattttaaatatttgttgcacaagcaacattataacagtattaaatatttggtatgaagagatggtgaggtaatagatgattattaagaatgttctatttctgttaaatttctgtttccttcctatgactattttgatataatttttataatatcatgtgacaagataatctaataacacatttctatttttaaaatggattcaatgggaaaatcaggttgctttatagaaatttattctagagcaaatttatttagttggtatgtcagcctactctttaaaaaatgtttccagctggatgcagtgctgtgcccctgaactcccagctacctgtgaggctgaggcaaaaggattgcttgagcccaggagttcaaattcagcctaggcaacatagtaagaccccgtctttaaaacaatttttaaaatgttgccattttgtgggaaaatgtaccctccttcctcccatgttggggtaatacatgctgctgctgaagcccagtagagggcaagtgcatagtgtagtggaagaaattcaggctggggaagtgtgaggtaatggcacatagtttcaattcctggctctgctattcactcattgttcgatcttagacctggcttagtcctcagtgttctcatgagcaaaatgaaagaaattgtgatagatgagttcaaagtgctgctttagtcgtaattaccatgatcagacatggagatggagctgaactccattgctcttatagggcaaaaaattaaaaacaaacaatcctaccattggtacatttccaggcacatagacataggagctagtctatttgggtttgagttttatctctatcatttacaaactatgtgaccttagttggctttgttaacttccctatgccccagttcttcatctgtcaaatgagtgtaataataatgccaagttgtctggttgtaaaaataaaatgaagtaatgcatgtaaaaccgtcagattcaacagtcgattataaacagtgtgctgtttgctgtttttttcttcaagtagccaagttatatgatatttatatagaccacatatgccagcagtcttttcacctttcaaggcatcttgtagaaaaaaagtcacgtttaattttattaccagatggcttttatttatcaaaaatgatagtctctcctaataaaattattccaatgctaggcattctgctgagaaaataatatttttatttactatttacttattttctaacaacaatagtttgagtaataacccatttctttaagactaagtgataagacacttaggcaaattaggaaccacattcagtaatcactcatatttgttaggtaaccattgtcttggggtttgagaatagtccagtgtgaccttgtgcaaaacctggaagcactttcaggctcttccagcctgttggactactgatatatctcatcttctcaattgtactcacagaggttggtagggtatttagattaaggatcacttttatttttaatctctgtaataaacaagaatgattgaagaggtgttgtcacaggagactccatcctgtttaacaggaatattaggtaggcaggggcatggtggaaagccatagatagagacagctgacttgaatcctcttcccatctctgccactattcactgtcctctcctctctgtgtgtttctgtaaaactctgtgattctatgaaccttgttaacttagctggttaaaaacaaacagaaaccaaaaccaaaatccaggacatcagttcctttctgtaaatctgcgaaacatttagttgcttgtcacaacatattcagtgtgatctagacacagcctaaacttttccttccacataggcctaatggaggatgttgatgttttgtttccttacttcacagaggtgtcatgaggacaagcatgaaaaaagtagggatgcatcatttgagttcttcaggaggaagctactacctaagtaagagacattagtatgattaagtgtgatgtcattaatattcccccaaactgcctttatcctatttgtactgtaggtaatttttgtgactggggaacatccccagttgtattttcattttaatgagaaatgatgacagtgttgcctcattgctcttaaaaaatacaaaaattaaaacacacacacacacacacacacacacagaactgacataggacctcagtacatttttacctttaccttgctgctgctgcttttctcctccttctcctcctcctccttctcttcttcttgttctcctcctccttctcttcttcttcttctcctccttcttcttctccttcaccttctcctccttctccttcttcttcttctcctcctcctcctcctcctcttcctcatcctcctcctcctcctcctcctcctccttcttcttcttcttcttcttcttcttcttcttcttcttcttcttcttcttcttcttcttcttcttcctcttcttcttcctcttcttctccttctccttctccttcttctccttctccttcttctccttctcctctttctcctccttattcttcttctttcttcttcttcctttgtttgacagagtctcactctgccgcccaggctggaggctggagtgcagtggtgcaatctcggttcactacaacctccgcctcccgggttcaagcgattcttctgcctcaaactcctgagtactttgtactacaggcatgtgccaccatgcccggctaatttttgtatttttagtaaagatgaggttttgccatgttggccagactgatctcaaactcctgggctcaagtgatctgcccgccttggcctgccaaagtcctgtgattacaggtgtgagccactgtgcccaccctaccttgcttcttcttaaaaaacaaagcaaaacaaaaccataaacaaaatgctgaggtttcttctagcactggtctttattgctcactagtcaaagctcctcattttttgcaattttggtaagaatacttaccatgagacctttctttttaaacacattttaagtgcattctactgtattgataactataggcaaaatgtcgtataactataggcaaaatgttaaacagatctctagaacttaatcatctttcataactgaaactttataccagtcgaatgctgaacactatcccattgtacgtctacaccaagttttctgtattcattcatttatcaatgggcattttggttgtttccatatcttggctgttgtgaataatactataatgaacatgtgaatccaaatatcttttcaagatcctgattttaattcttttgtgtaaatactcaaaaatggtattgctagatcatatggtagttctatttttaattttctaaggaacctcaatactgatttccatagcagctgccccattttacgttcctaccaacagtgtatataggttccaatttctcagcattctcactaacacctggtagtttttgttttgttttgatagtagccatcctaacaggtatgggatgatctctcactgtggtcttgatttacatttccccagaaataaactcatatatatatatatatataagatcaacttatctttgataagggtgccaagaatacacaatggggaaagaatagcctcttctatgaatggtgctggaaatactggatagccacatgcaaaagaataaaattagaccccgtctcccaccacttgcaaaaatcaactacaaaaagagtcttaaatgtaaaatatgaaactgtaaaactcccagaagataacatggggaaaatgcctcttgacattgatcttggcaatgatttcttagatattacactaaaagtacaggctacaaaagcagaaataaacaagtgggattgcatcgaagtaaaaagcatctgtacagcaaaggaaataatagagtgaaaaggcaacgtacagaatgagagaaaatatttgcaaactatatatctgatacgaggttaatatccaaaatatgtagagaactcctacaactgaatagcaaaaaacaaatattgccatttaaaaattggtaaattgcttaaatagacatttctccaaagaaaaagacatacgaatggccaacaggcatatgaaaagatgttcaccatcactaatcaacagggaaaggcaaatcaaatcccattttagagatggagaaattgagggtcaaagaagaatgttatttgcccaaagactctaaactatctggtggcagagcctggatgagaaccttggccttctgattccttgggcgtacttttcccactccagtttgtgctgatgactgctctgccactaaatcatgtgtattaaagtttctcttctaccagtctgtgagggcatggattctatcatatttagctgaaatgattatttcttcagcctttcttgtgcaacttcctctatgaatccctgagtctgcatgcagaaatgcgttactgaaatgcagaagccgttttcccccactagtaataatctgttcctcattcaaatacacaccttctgagctggggttttgtcctcttttgttttctttaacatagatgtgtcctgactatgtggagggactggaaaaggaaaataacgtttcacaggagaagggctgagaatattgttaaagcacagacaatggtggagcttgaaatcagagaaaaaaaatacagtataatggctccctgtcccttgtagcattccatctttcagctctcaccatattccaagcacaactacgtcccttaacaaaatcatatccctgaatcctgatgatacccaacaactcagataaatttcccagacctgttcccaacctctctctggtcacacctgcattcctgaccttaacgaccttctcccaaccttgattatatccttcaaccataaaaagccacttgagctgaggccattctaccacattaatcatgtcctccgctgttagttatacttctatcctcatgctcgctaaagtggccacacagcaatagtatttaacacaccctttctgactcttcttccaagccttgtcaaactgcttggctctgatcagatgtccagtgtgatccttgattctgaacaccaactggtgactgattctgggagccagattaaggcaggcggtaagagcaaaggaattggatgaaccaagagatatgtgggagagagagagaaataagatgtgagaaaaagggtaaggggactgagtatgagaagggcttcatggcatggccaccaagtctagaattaaatgtcttttgcttgtgggtgggtattgagaatgagtttaataaggtaggctggttcccaatttttacctctctgtgaactgtggtccaaatgggctgggctgttggactgtatcacctgagcctgatggagcaggctgattgagcattttctggaacgctgtgtgggtgaatgatgatgtacagaatatgtcctatccatcctcatttcttcccattcactcctagcatgttggtatatacctgacatatcatggttgctcaaaataggatcatttcttcagaataattcttgcattccttagtatggcatatagagccctgattctcaactgcctcatttctcatcaggataaccctcctcccttgtgttcgcatgtgtgtgtgtgtgtgtgtgtgtgtgtgtgtgtgtgtgtaagcacacaattttgttccagctgtgtttatccaacggggccaagttctttcacatcctgttgccattgtacctgttgtttctctacctagagtacccttttcctctattttttgctcagtcttccagtcttatcacaagcactactttgtccaaaaagcttttcttattggccctagaatctcctcagatgtcccttttctgtgttctcatagcattccactcttaaggcatcattgccataagaatgaaataaacaaaacttgacagttttgtttctgatttcatcccatattgaaccatgagcttgtagagggcagggactgcatcttatttgtatttttctactcctagtgcttaacccaaggccttgtacatattaggatttcaatgtatgtttcctaatatgtgaatggaaaccttcctcctatttatcttctctgttctatttgacttttttgttcactttcatttttttgtctgtaaactgaatacatacattaagaagtcaccaaaatgaatgggcatctacaagcaaaccctattcattcttatcatccagaaaacaacctgtatttctcctaaacacaaatttcttctatgctttccttgccattaatgcaaaaaaaaaaaaaaaaaaaaaaccacacttctggaagcatccatagtgatgacgatcattactattctctgtattctctgaagattattagaatttatcaagcagctgtttcatgggaagagtgttagcaattgtattgcattttgtagctaattgcaggaacaaagtgtcaactaatgcaaaatttggtttttaaaagaaaacattctctccctaatcaagtcctcatggtaaagacaacatgaaattattattgatcatcactcatgagccaggagagagatgaagtagtatattctttttgatttctacttaagaatttgaaaggtaggatgctacatgtttcaaggagatttgcagaatccagtaatacaaattctgaagactgaaaatcaggtaaggtttggctcggggattaaaaggaatgggtaaaaagtgcttctgaacattagagaagcccagactgatagagatggacagacttttcagaatatctattttggtgatcctcaatttctctttttgcttatatcccctctaaaaggaaaaaaaacattttgaaaaactacataactgttcatacatctttatattgagatatatgtatatacattttaatcatgagtttaaatggttatgaaggaaataactttcagcatattgcatattgattatacattttaagtacatttttatcacagccttggcattactcaattaactcattcagtttatgggaaatgtctgccatgtaacctcaatagtgaaaccagtcctcattgtcaaaccagcctgccaactcagactggctttctgtttgaaagagtctgatttcattatattcccctgtgacaagcatctcgctactgaattctaacataaagataggtagctaaggtacagagccttgccatggtttgtcacttggatgagataaaggcactgcctcatcaatatttcttacccaaacactctgctttgctctccagggactctttttcaggagtctctgtgtccttgaatcccttctttgttgtttggtaccccagaggatcttgccctctggtacaatgctccatactaaaattcaggatgagaagtatgtctgtctctcttttgtcaaatgggaaaaaggtcattgtggaaattgaaatggaaaaaaaaaggaatatacaaatggtaggaagatataccaggctactcactctttggaaagtcagataaccaaatttgcctgcacattgtttacatgtaccctaaaacttaaagtataataataatataaaaaaaaaaagaaaatctctgatcttatctactcctcccttattttgttgttgggccaactgatacctcgaaaaaagaatggactaatcccaggtaccaatgcttgttaaccagtggcaaagccagtactggaatataggtattttcatttcccaactaatgtgcttcctgcctcatggtgtctccttaatctgtcctatattcaaacgattgtaatttctttatccagtcacagtggggtttttctcatagaagaggtctgacctttacatttctttacagggaggtgtgtgtacatagagaatgccaagatggtagttgtttgtttgtatgttctcttacattacttgcagttgaagcaggtaaggtgactacttaacaagtcttcattcaaaaacctgtaatttgagaagcttgctccatattagtggaaaatgcacttttcatcatggggcctaaatctcttgatgcttatcattttttttggaatagtttactatttacttaattttgctatttttgtagatttagttgtaaggtctcaaagtacataactctgttttttactccattatctcaaaatcctgtaaaacattcagtaatttggtcaaactgcctcagttcagatattgatctgccacctgctagcagtatgactttggaggcagtgttaacctcttgttacttcagtttccccctctgtaaaatgagttgtgatgattgaatatattatataaatctaatgctttgaagtacctggtacaaacataataagtcttcagtaaatgttaactattgttatcatcattgttgattgaaaccatcaagtaatctaacattaagaacaccaggggccgggcgcggtggctcgcgcctgtaatcccagcactttgggaggccgcggcgggcggatcacgaggtcaggagatcgagaccatcttggctaacacggtgaaaccccgtctctactaaaaatacaaaaaattagccaggcgtggtggagggcgcctgtgatcccagctactcgggaggctgaggcaggagaatggcgtgaacccgggaggtggagcttgcagtgagccgagatcgcgccactgcactccagcctgggcgacagagcgagactccatctcaaaaaaaaaaaaaaccagggcagctagcccatagagattaaacaggttggaaagtagattaaatttacacagaggcaagttatgaggcagagagaacagacctgcagaaggaagtggcctggcagtgttatggacggtccatcaagtcatgtctgaaataatggtttagaacaatgctgtccactggagctttctacaatgatagaaatgttctacatccacactttctgctatgatagctgctatttgatatgatagccagttgtcacatatggctcttgagcacttgaaatccggctaatctgaataaaaaatggagtttttcatcgtatttgatattaattaatgtacagttaaatttatatgacgacatatagttagtggctaacattttggccagcacagatccaagacttcagctttgcttttgtcaattaccttaaatctttgaatagtaaaccagcttaaataattcatgagaacagtgacggtaagactgtctcttccagctctgtccatctctttgttactccttcatctctttttctctagctctgctcccatttctcacacttcatctgtggtatcctccttcattactccatgtttctttaaagccaggctcctcagccaaatatattttgatacctgtgcatgtataggtatgttcttaccaattaaggtcagatattcatgagcaagtatatgaagacacttatggtgcaaaggccaatttcttaggaatggaatgtgattgtgaggaagttgcaagctgtggcaaaaagaaaccttttcccacattattttcatgtgaggaattactgtccatcaagttagtattgattccactcacctattaagtagtagatcataggcaagatcatttaagattttgtagactgatggcaaaagctcccactatttaccagagctatataaagatgacatttcaatgccttcctcatgttataacacactatattttgaaagcttaaatagtcctttaagggaaagagaaacacttaatatacgtcaagaaaacgaattgcatttaatgtgaagaagtaccggccagaccacatgaagtgagcatcactcatgttgctatccaggcactgctttgggccagtgttcatcatgtgaacaaagtttctggaccttccaaaactacccttctctacattcctaatattcagattcaaagagttcattgttagtattttgattatcttaaatgtgcactgagtcatagttaatatcttaaatgacttgaacatttgctattctaacagaggctagtttatagagcactgtaaaacctctttttatttatggaatgcatccatattaaaattataacttcagcagctttctgtggagaaaatggtgactctgaccttttattccatctgaccactgagaaaaggactataatttcaacaatcaaatctcaaatgtgttattgtgcctattttctttttgtaaaatgtcattccatctatcatgctaacagctcaccttaatccattttcaatgggcttttttgcagaaaatttgcacaaatattttaaaatttctctatttcaatagcttttggggtacaaatggtttttggttacatgggtgaattttatagtggtgaagtctgaaactttagtgcccccatcacctgagtagtgtacattgtacccaatatatcattttttatctcttgtcccccttttaccatcccccttctgagtctttatagctcattatattgctctgtatgcctttgtatgctcataacttagttttaacttataagcaagaacatatggtatttggttttccattcctgagttacttcacttagaataatggcctccagctccatccaagttgctgccaaagacattattctgttccttttttatggctgagtagtattccatggtgtatatatactacattttctttatccactcattggttgatggacacgtaggtttgttgtatgtctttgcaattcacaatttttaaaaaatattctttaaaatagagctgttgaaagctctcacatgtttccagcgtaaacgtatttattaacaatgatttatttgaaaggtcagaggaatgtgagccttgtttccggtggtcacaaggggccaggagcattcccgagtccagcgcataacaaaagtaatgcagtgtcagaagaccagactgaaaacagcagttgtcaatgaatggacactaatgcaattcagatttttaatttgtttttctattaagagaaagtgagaagtgtccaatgaacagtggctcaaaatctaatacgcttggtcttaggcaactccctcaagctccatttcctatataggccaaactgccaccttcccagtatattcacattgctgccagcttaggcttcctaaaacacaacatagtgaccttgaactctgataatctcaaaccttccatattcatcaaagtccttcacaatttgctcttaccctcattctcaacattgcttttattttgttcccctgcagccccagtgaactgctctcagtcctgatgtcattccccacacttttttgccatcttttgctcacaccattcttcctccaaggccctttctttcctctggatctgtgacaaaagaactacccattcttctaattgaagttcaaatcctatctactccaaggaaccttcttagagcccccagtaatactgaaggcctttcttcttcttttttttttttattatactttaagttctagggtacatgtgcacaacgtgcaggtttgttacatatgtatacatgttccaaatgtccatcaatgatagactggattaaggcctttcttctttacagttctctggttctctaacactctggtgtagtagaagagctgggaatcagaaatcctgagtttggattccagttctgccattttctatgtacatgatcttggacaagatagtcaacctcactttctgagcctgtgccatcaactggaaaatggagataataatgcctttcctgcacatgtcacaggcttgctgtgaaactcaaaggagataatgcatgtgaaagctttctatatacagtgaagtgccatgcacatggggagtattattgctttcattattgtttttccattgaaaaatcagccaaggctgcttgaagcaatttgcttgaatggcacagaaggatgaagtttgtcagtcagtccctgagcacaaccatcaaagtgtcccagaaacttcagtatttcagcctccaaactttactctccagactgcctctggcaccacaaaagaaattgaaatcctcagtctcactatgtgttctgatttagggtttaaaaattagggtgcctgtaattacagcacttgattgcactagatatgagtttcatgaaaacaggtaccgcatatgattcatctctgtgtcttctccattgcttagcaccatgctgatgccaatccatagaatatgctaattctcacagtctcctttactgagctgtgatgaatgtaagtatctacggatgtaatatatgtaactgaaatcctagttgttagattacaaaacacgtattgtgcccatttgatatgctgttagactttttctctttcctttcttttcctatggagttgaattctcctaactttctttaaatattcaagaatagaagacttagaaccagaaagaggagataatgattcagtgaaaaggctgttgaaaggtaacaatcaggtcacatagtagctacttggctgaactgtagagatgagtcttctgcagggtggcagtcttgcctgagcccttgtttccagggtcaggggatccttgtaggctgtattataaaatgaataaaatcacaccagccagagagctccactatatttcctgcttatatccttttaatcaactcctcatgtaccaagcacccaatagtgaagagtcacaggtaacccagttctgttaacattatagtttccttagtttcctttattttccccaaatttgctctgttccttattatccaattctgcattcacctgactcctggcctctgaccccttgtcttattttgttttctgctgctataacagaatgctgcagactgggtaatttataaacaatagcaatatatttattagagttttctgtgctgggaagtccaagggcatggttatgtcatttggtaagggcctttttggtgtatcacaacatggcagaggacattacatgttgagaggtcaagagtgcttcaactcagatctctcttcttcttataaagctaccagtcatatcatgggggctccaccctgatgaccttatctaatcctaattgcctcccaactatatactgcctacaagagactcaagttcgcctgtaagaacatgcgtagactgaaagtaaaggaaggagaaaagatattttttgcaaatagaaaacaaaatagaacatgagtagctaaactcatatgatacaagataaactttaagtcaaaaactgtgaaaagagaccaggaaggcaattatataatgataaaggggaatacagaaagaagatacaataattgcaaatatacatgcacccaacatcagagcatcaaactgtatcaagcaaaaattaatagacctaaaagggaagatagactgcaatataatagtaagggacttaaacacctcactttcagcgatggatagatcatctagacagaaaatcaacaaacaaacattagagttaaaccacattccagattaaatggacctaacagacatttacagaacattctatttaacagcaccagaatatacattcttaacagcacagggaacattctccaggataggtcatatattaggctgccaagcaagttttaaaaatattttaaaaaaccaaaatcatattaactatattttctgaccacaatggaatgaaattagaaatcaataacaggagaagctctggaaattgtacaaatacatagaaattaaacaacatattcctgaacaaccaatgagtcaatgaagaaatttaaatatttcttgagacaaatgaaaatggaaacacaacatacaaaagcctatggaatacagcaaaggcagctccaagagagaattttatagcaataaatgcttgcattaaaaagtagaaatatttgaagtaaacagcctaacattacacctcaaggagctagagaaacaaaagcaaactaaacccaaaatgagtagaagaaaagaaatactaaatatcaaagcaaaactaacaaaaaggtcctaaataaattataaagctcaacaaaattaagagctttttgaaaaactaaacaaaactgacaaggcttctacctagaaaaaaaaaataatgaagtaaattattcaggatctataagaaactcaactcaatagcaaaaataaaacttgatttaaaaagtggacaaaagatctaaatagactttctcaaaagaagacatacaagtggctagcaggcatttaaaaaaatgctcgatatcgctaatcatcacgtaaatgcaaatcaaaactacaatgaaatatcatctcacgcccattaaaatggctattatgaaaaagacaaaaaataaaaaatgatggtgagggcccggcacggtggctcacacctgtaatcccagcactttgggaggctgaggcaggtggattgcgaggtcaggagatcgagaccatcctggctaacatggtgaaaccccgtgtgtactaaaaatacgaaaaaattagccgggcatggtggccggcgcctgtagtcccagctactcggaaggctgaggcaggagaatggcgtgaacccgggaggcagagcttgtagtgagccgaggtcgcgccactgcactccagcctgggcgacaaagcaagactctgattcaaaaaaaaaaaaaaaaaattctggtgaagatgtgtagaaagggaaatccttataaactattggtcgtaatgtaaattagtataagtcaacagtatggaaacttctcaaaaaaaaaaaaatagaactaccatatgatccaacaatcccatgactaggtatatatccaaaggaattgaaataagcacgttgaagagatatctgcactcccatgttcattgcagcactattcacaatagacaagatatggaatccacttaaatgtccatcaatggatgaatagagaaaaatgtgatatacacacacacacacacacacacaatagaatactagtgagccataaaaagataaaattctgtcatttatgacatggatgaacctagaggacattatgttaagtgaaataagccaggcgcagaagggcaaatatgatgtgatctcacttacatgtggaatctaaaaaaattgatctcatagaagtagagagtacaacagtggttaccaagacttgggtaaccactactggggagaggttgatcgatgggtatgaagttacagttagaagtaataaaatgtttgtgttctattgcgcagcagagtgctcagtgaacaataatgtattgtatacttcaaaatagcggattttgagttcataccacaaagaaatcacctgtttgaggtgatgaacatactattgaccctgatttgacttttacacaatatatatgtatgtatcaaagcatcacactgtacccaatacacatgtacaattattatatgacaaataaaaagaaaatataccttaaaaataaaacaaaagtaaaaagaaatcccacacaatgaaaaaagtatatttgtttaccatatgtctgacaagggacttatgaaaaactattacaactcaattaaaaaagacaaccaaatttttaaattggagaatctgtagacagttttacataaatatgtgcaattattatttgtccgttaaaaacaaaataaaactgaaaaacaaaaaccctagcaattattagcacttactatgtacatgatactgagttaactgctttacatgtaacattatatttaattctaacagtattcctttgaggtagatactgttcccatttaacagaggaaactgagatctagaaaggatagttaacttgccaaaagccatacagctaataggtagaggagccaggaattcaatctatttttgactccaggcccctggcaataccctgtcctatttctcaccagggaacccttggtgttgtgggccactttggtcagtgctccccagatttgcatatattctttttcataacttagaaacactcaacttctgaagtttaggaaatacagttcatcatgaacccacttaatctttgttaactgcggagaccaggtttttgaattttactcttaactcaagttgccaatgagtttgctgaaagattaaaagactaagtgctaccgttgtgtggttatttgaattaagcatcgaagtgtaacatttatctataaattctcaactctagtgcctaaaatcattttatttcttgtcatattcgaaaataggatttggttgctgaaaaaagtatggagaataagtgggaatttaggagaatctgcaaggcttgttggaaactcaagcagacgaagaccagtttggaagtgatgtattaactcctaaatgcattttttgttagtcactagcaaatatcgtgggtccccctggtgctttgtgagaagataaatttctcctgtaggtgaattaggtataattggaaacaattggactagaagcatcctgacgcgctctgggtcaaaagcttttcagcaaggctgtttttaggagcgtctgaattgatactgtttctgtagcctaccaatctccaaacagagtgacatattgtttttcttctttctccccctcctatgtcattgtggagaacaatatggcagtgcagacatagcatagagtctgagaacaaagtgcatatcagtcccagctatgtcccttagtagctgcgtgactcactgtaaaataggtcttgatgcccgccctcctcttcctccgcttaattatttttaaaaatacttattgagtgccaaccatgtgccagacattgtgttaggcactgtagctgcaatggcgaataaaacagacatcattcatgcactcctgaaactaaaaatttaatagattatatctgccttctgatcagtaagcctaccatgaggaataaataggcgtggtggatgtaaagtgcccaaaacatatttactgtgttcacaaagtgtgaatttcctttccttttcttcattttggcattataacgttagctgtagatggcatgtacatgcagcatagcatccggggtgtgtacatgcacacacacagacacgcacactcaattctctatagcttcacttattttagtctaagattgttgccattttcatgcacagctattatggtaggtgagtcagccaatcaaaaacagatttgattgatttgctttgagctacttgcctgccaacaaacgacaatggctgtatggatatagtcattgagtcaggtggctttatggatttccattggtgttagacttttaaatttagtttcttgctgcctgttatacacgggaggcaatgacaagctctcaactctctaatttgctgtagtggtgtgctaattaaaacacattcctaatacattccgttttggattcagagccagtgttcttataaaactataacactagtaagaaaaatgcaccatactatcttatgagaaatttcataaatgtgacaccccacaaccttattttatttttcagacattatacaagctatattgcaattttatgtcctattcgattcttctccacaaactgctttgccctgtgtattccaaatttttgtaagtgataccaccagataaatccaaaacctagaaaccagcctagatgtttcattctctgtcacccatctctctagatatgtcctatcccaaagttcccttgagtttgctccataaatgtatccccatccccactgccactacctcagttcatgctccagttatctcaaggttacagcaataacttaacagaattccttacctccaatcaatccctctcctccatctttcctactacctatactacagaataagtcttctgacacacagttgactgtgtcacttttctgtttttcgagtttttcagtcactctccattgtctgtgcagaataaagcccaaactcctgtgcgtgacatacaaaggtcagcctaatttgcccctctccctccagtttcaactctcatcaactgtatttattttctagtaatccaaaatatgtatagctccagaataaggcatttactcattcagtggatatttatgtgccaggtacttgtttagatactgggtatattgctgtgagcaatacagacaaaaggccctttcttcatagactttacattctgtgagagaaacaaactaaatggatacattatttctacaacttttttgtctttacatatgccatttcctctgcctgaagtaattttctcactccccatttctctaaaaattgcctagtcctctttcagaaaatcagcttgcaagtatgacatctaagagagatttcagcctgctttcatcttttctctgtatcttttcagagtttcactatagcttctgctttgctgttgtttctcattatttgcatgtcagaaccctccctcgtggcattctctatttaacaggactatatcttttctactctgtcttcacagtacttggcactgttgtagcacttagtcaggaaacagaaaagatgtttgagtccatgaaagcctggaaggcagggaagaagaaaggaggaagacagaaaaaaggaaataaaaaggagagagggatggggagaagaagggagaaagtgagggagggagaaaagtcaatttagtttcatttctccttggtttggaaaaggtataactagttttgtattatgacccagtaggattgcatagtcaagaaagtgccactaaattttgcaacttatatttccttaaaagtatgggagaaatgaatatttccctttgcggtttggtttattaatcattatcctacaagttaatattaaactaacaaattaaatgaaatctccatcacacacaggtgaattaatctttgccttcatatcttcttgctatgtaataattgtcagaacttgcaagaggtatatttttatgttattttaatcatgttcctgaggggcatcaaggtgaaatagaaagagcagagttaggagatatgaagtcgagtttgggttctgcaacctagtagctggccgaattaggggaagcattttcactgtggggagctttagttttgtcgtctggaaaaggaaggaaccagaatgactgctcactgtactgtttccagtttgcctcttctcattttagtttcctgcttgcaggaaactttacaaacatactaattgagtgatgatcagttatagactgccttagtttccatttcatctcctccacaaggtacagccttgtattctcctgtggctataaataaatcccatcatagccttatattctgtttactgtattttgtcttgacctttaccaagggatagattctgaaggcattatgcagttggatcaaatggcttgtattcaaaattgtggcttgagtctctccacccagatgtcatggatgttgatttccctggtgtcttaatccaccctccccgcaggactttccatcttctttaggcctctttccctttatccactgcctttctttgctgtagcctccttgtccagttttactttacttccctaaggtttctgtaacattggaagacctgccacctgtgacttctgtgtcacaaaacattgttttttcttaatggctctcctttttagaagatgagaaatttacgtttaaattgtgtgcattgagcttagtgtgcaatgattttttgtaagccaagaaaatcaggaagaaccgcaaagggtaagggatggagtcttcaacaaatggtattcgttaattttctgcccattaagggacataatctaattaaattcttatcctacaacatagacaaagtgaattcctgctgtattaaagagttaaatataaaagaaaatgaaatagtaaatatcagaataatgtggaatatttaacaattttggggggcagggagcaattttggggggttgtattagtctgttctcaggctgctataaggacatacccaagactggataatttataaagaaaagaggtttaattgactcacagttccacgtgcctggggagacctcaggaaacttaaaatcatggtggaaggcacctcttcacagggcaacaggagagagaatgatgactgctgagcaaagggggaagccccttataaaaatgtcagatctcatgagaacttggctatcacaagagtagtatgggggaaaccaccccccatgattcagttatctccactttgtccctcccttgacagaagaagattattacaattcaaggtgagatttgggtgggagcacagagccaaaccatatcatttcacccctggccactcccagatctcatgtcctcacatttcaaaacacaatcatgcccttccaacagtcccccagagtcgtaatccattctagcattaaccaaaactccaagtccaaagtcttatctgagacaaggcaagtcctttctgcctatgagcctgtaaaatcaaaagcaagttacttacttccagttacaatgggcatacaggcattgggtaaatacaccccttccaaatgggagaaattggccaaaacaaagggcctacaggctccacacaagttcgaaatccagtggggcagtcaaatcttaaagctctgaaatgatctccttagtctctcatctcacatccaggttatgctgatacaagaggtgggctcctacatccttgggcagctctgtccctgtggctttgcagggtacagccccctgccctggctgctttcacagctggcattgagtgtctgtggcttttccacgtgcacagtacaagctgtctgtggatctaccattctggggtctgaaggacagtagccctcttctcacagctcccctaggcaataccccagtgggaactctgtgggggtggggggaggctccgaccccacatttcccttctgcactgccctagaagagattctccatgagtgggtctgcttctcccagtccactcactcaaatgttaatctcctttagcaacaccctcatggacacacccaggaacaatactttgcatcctttaatccaatgaagttgacactcagtattaacgatcacaggggcatttaaagccaaagcagaaatcacaaagaaaatgactgatagatttgatatatcaaaatgtaaaacaaaaataaaaaccaaagctttcattcatcaaaacatcaaaaataaaaacattttctttaccactccctttcatgggctatagatatcaaagggacttctggattttattcagggccagcatcatgggtgtttggcctgtgtagtcgcacaggccaccacacatggaaggatcctgtgattggttcaatgctctgttgtatccatcttgacattcataattttggaacaagggacatttcatttttttattttgtactgggccccacaaattgtgtagccagtcctgagtctcttgaatcattctggaacctccctgctcatagtgaaatttttaatgacaggcccatttgaatgatgcttggtgaaagaatgcaagaaaccacttgctcaataacattggacttaaatgagaatatagacgggcacctggatgttcattaccttgtcagtgtaccagataccctgatatccattcacttattccttcattaatttagcaaacatttttcaagtccatcctttgtgtcaagcactgtgctaagcattggggatacagtggtgcacaagatggattcagtcagtgctctaaaggaggcaaggttgtaggtgaatagatggcaataccacatgatagaaagtgtaggagcccagagcaggggcccctaacacagcctgagagatgagtaagggagttgacatctaaacgaactgaaggggtaaaggaagtggaggtgagaggcatatcctggggaggccatttaggccaaggaaacagcatgtcctccttttgttctttcatcattctttcatcagcagggcaaggatcttaacctgccctgggaattcatcaggttaagggtcaggtgtgtatggaacagctggctggcctcttctcgggaagtttatgcccattccaagctacctattgtacttgtctcctggaataggtggtgatgtagtttggatgtttgttccctccaaatctcatgttgaaatgtgatcctcagtgttggaggcgaggcctggtgggacatgtttgggccatgggagtggatctctcatgaatggctttgtggtaccccccagccccataaattagtgagttctcactctattagctacctgcaagagctggttgttgaaaggagcctggcacccctcccgtctctctggctccctctcttaccatgtgatacaccagcttcccttcaccttccaccatgagtggaaacttcctgcagtccttgccagaatcagatgctggcactacgcttcttgtacagctgcagaactgtgagccaaataaacctattttctttacaaattacccagctttgggtattcctttatagcagcacaagtcgactaagacagctggaattacatactgtttgatgtctgaaatgtcctatggaagaagaaaggataaatatccactgtgccccttatctctaagacacctgatcaccccctctggatattttaaaaatcctagatttcaaatagacttttactctaccaaaatttctgtgatccctggaagacctagccactatttttagcttgcaggacatagaaaaatagtggggggtcagatttgtaccataagccattgtttgctgatttctgatttagaattaagttgcctcaggccacagatcctttatttgcattggctttccctctgcttggaaaactctccctcaacctgtttctgttgtaggcctcttctctcagtgaatccttctttctctacagacttgcctaaactgatttttctgctgctgtatgtctctgtagtatccttgggactttcttatcaactcctacattgtttgcttaatgtttaagtctctttatacactgaagacttaatggaagaaaaatttacagttgcctattatttgaacagttcaagtcagtctcctagcccactgcctggctgagtgtagctgctcaacaagtatttgttaagtgtacatatgagtgcagtattactgtccccatttttcagatgatgaaactgaggcatagctagctgattgggaccacactaaaagctattagatagtagaatagaaataattttccagttaactacactgcttttttaaacattcaaataggatgcttagaaataggacaaagaagacaaattaaataggactttcagtaagcaaaacactaaccatgaagattatattttgctactcagtaggctgaggcggaagtacttcttgagcccaggaattcaagactagcctgggcaacatagtgagactgtctaaaaccgaaaaagattgtgtttggtttatgttctccttgctctcatggcatatgcaatataataggggaggtcagataactgcatagcaaataagtctgacagcccaagttagtaggtggcaagtaccaagaaggtttatgtggggcatgtgttgctgtggcaaggtggggtcaaagagaaagtcagaggcaagtcctaagccaagccaggggagtcacataggccacatcccttcaggattcacttctgtggacattggctagtcaatgcaaagcaaacagtaacctctagagcaggtgtgaagggacactcatgaactttttcccaggtgatatgttcctcaaactgctgcaactgcagaatgctgagagctgtccacctgtgggaatggtcagagggtcttgccaggagtggcgttctaacagatgctcaagaagttagataagggtttttctgactcatgagaaaagactctaggaacctgaaagagtttaattttcctaccagtgggtgatttgggacagtctcctaatccatcagcaagtgtttcttgaggtccttactatgtaccaagaaagtcaaatggggattctatttctgatggctgcacttttttttttcttttttgttttttattatactttaagttcttgggtacatgtgcacaacgtgcaggtttgttacgtatgtatacatgtgccatgttggtgtgctgcacccattaactcatcatttacactaggtatttctcctaatgctatccctccccgtcccacaaccccatcacaggccccggtgtgtgatgttccccaccctgtgtccaagtgttctcattgttcaattcccacctatgagtgaaaacatggcggtgtttggttttctgtccttgagatagtttgctcagaatgatggtttccagcttcatccatgtccctacaaatgacatgaactcatccgtttttatggctgcatagtattccttggtgtatatgtgccacattttcttaatccagtctatcattgttggacatttggcttggttccaagtctttgctattgtgaatagtgctgcagtaaacatatgtgtgcatgtgtctttatgatagcatgatttataatcctttggatatatacccagtaatgggatggctgggtcaaatggtgtttctagttctagatccttgaggaatcgccacactgattcccacaatggttgaaccagtttacagttccaccaacagtgtaaaagtgttcctatttctccacatcctctccagcacctgttgtttcctgactttttaatgatcaccattctaactggtgtaagctggtatctcactgtagttttgatttgcatttctctgaggaccagtgatgatgagcattttttcatgtgtctgttggctgcataaatgtcttcttttgagaagagtctgttcatatccttcgcccactttttgatggggttgtttgttttattcttgtaaatttgtttaagttctttgtagattctgcatattaaccctttttcaaatgggtagattgcaaacattttctcccattctgttggttgcctattcactctgatggtagtttcttttgctgtgcagaagctctttagtttaattagatcccatttgtcaattttggcttgtgttgccattgcttttggtgttttagacatgaagtccttgcccatgcctatgtcctgaatggtaatgcctaggttttcttctagggtttttatggtttttaggtctgacatttaagtctttaatccatcttgaattaatttttgtataaggtgtaaggaagggatccagtttcagctttctacctgtggctagccagttttcccagaaccatttattaaatagggaatcatttccccatttcttgtttttgtcaggtttttcaaggatcagatgtttgtagacgtgtggtattatttctgagggctctgttctgttccattggtctatatctctgttttggtaccagtaccatgctgttttgcttactgtagccttgtagtatatggcagggcatagctgaacaaaaggcggcagaaacttctgcagactttaacgtccctgtctgacagctttgaagagagcagtggttctccaagcacagagtttgagatcagagaagagacagactgcctcctcaagtgggtccttgacccccgagtagcctaactgagagacacctcccagtaggtgcccctcagagacaaagctaccagaggaaggatcgtgttctgcagtatttgctgttctgcagcctccgctggtgatacctaggcaaacagggtctggagtggacctccagcaaactccaacagacctacagctgagggtcctgactgttagaaggaaaactaacaaacagaaaggaatagcattaacatcaacaaaaagtacatccacaccaaaaccccatctgtaggtcaccatcatcaaagaccaaaggtagataaaaccacagagatggggagaaaccagagcagaaaagctgaaaattctaaaaaccgagcacctcttctcatccaaaggattgcagctcctcaccagcaatggaacagagctgcacggagaatgaccttgacgagttgacagaagtaggcttcagaagatcggtaataacaaacttctccgagctaaaggaggatgttcgaactcatcgccaggaagctaaaaaccttgaaaaaaggttagacaaatggctaactagaataaacagcatagagaagaccttaaatgacctgatggagttgaaaactatggcacgagaactatttgatgcatgcacaagcttcagtagctgattcgattaagtggaagaaagggtatcagtgattgaagatcaaatgaatgaaatgaagtgagaagagaagtttagagaaaaaagagtaaaacgaaacaaacaaagcctccaagaaatatgggactatcgaaaataccaaatctacgtttgattggtgtacctgaaagtgacggggagaatggaacgaagttggaaaacactcttcaggatattatccaagagaacttccccaacctagcaaggcaggccaacattcaaattcaggaaatacaaagatactcttcaagaagagcaaccccaagacacataactgtcagcttcaccaaggttgaaatgaaggaaaaaatgttaagggcagccagagagaaaggttgggttacccacaaagggaagcccatcagactaacagcgggtctctcagcagaaactctcaagacagaagagagtgggggccaatattcaacattcttaaagaaaagaattttcaacccagaatttcatatccagccaaactaagtttcataagtgatggagaaataaaatcctttacagacaagcaaatgctgagagattttgtcaccaccaggcctgccttacaagagctcctgaaggaagcactaaacatggaaaggaacaaccagtaccagccactgcaaaaacatgccgaattgtaaagaccattgaagctaggaagaaactgcatcaactaacgagcaaaataagcagctaacatcaaaatgacaggatcaaattcacacataacaatattaaccttaaatgtaaatgggctaaatgccccaattaaaagacacagactggcaaattggataaagaatcaagactcatcagtgtgctgtattcaggagacccatttcatgtgcagagacacacataggctcaaaataaaaggatggaggaagatctaccaagcaaatggaaaacaaaaaaaagcaggggttgcaattctagtctctgataaaacagactttaaaccaacaaagatcaaaagagacaaagaaggccattacataatagtaaagggatcaattcaacaagaagagctaactatcctaaatatatatgcacccaatataggagcacccagattcataaagcaagtccttagagacttacaaagagacttagactcccacacaataataatgggagactttaacaccccactgtcaacattagacacatcacagagacagaagattaacaagaatatccaggacgtgaactcagctctgcaccaaccagacctaatagacagctatagaactctccaccccaaatcaacagaatatacattgttctcagcaccacatcacatttattccaaaattgaccacatagttagaagtaaagcactcctcagcaaatgtaaaagaacacaaataataacaaactgtctctcagatcctagtgcaatcaaattagaactcagaattaagaaactcactcaaaaccgcacaactacgtggaatctgaacaacctgctcctgaatgactcctgggtacataacgaaatgaaggcagaaataaagatgtgcttcgaaccagtgagaacaaggacacaacatgccagaatctctgggacacatttaaaacagtgtgtagagggaaatttagagcactaaatgcccacaagagaaagcaggaaagatctaaaatcgacaccctaacatcacaattaaaagagctagagaagcaagagcaaacacatttaaaagctagcagaaggcaagaaattactaagatcagagcagaactgaaggagatagagacacaaaaatcctttcaaaaaatcagtgaatccaggagctgggtttttgaaaagatcaacaaaacggatagatcactagcaagactaataaagaggaaaagagagaagaatcaaatagtcgcaataaaaaatgataaaggggatatcaccaccgatcccacagaaatacaaactaccatcagagaatactataaacacctctacacaaataaactagaaaatctagaagaaatggataaattcctggacacatacaccctcccaagactaaaccaggaagaagttgaatccttgaatagaccaataacaggctctgaaattgaggcactaattaatagcctaccaactaaaaaaagtccaggaccagacggattcacagctgaattctaccagaggtacatggaggagctgataccattccttctgaaactattccaatcaatagaaaaagaaggaatcctccctaactctttttatgaggccagcataatcctgataccaaagcctggcagagacacaacaaagagaatttaaaccaatatccctgatgaacatcgatgcaaaaatcctcaataaaatcctggcaaactgaatccagcagcacatcaaaaagctcatccaccacaatcaagttggcttcatccctgggatgcaaggctggttcaacatacccaaatcaataaacgtagtccatcatataaacagaaccaaagacaaaaaccacatgattatctcaatcgatgcagaaaaggcctttgacaaaattcaacagcccttcctgctaaaaactctcaataaactaggtatcaatgggacgtatctcaaaataataagagctatttatgacaaacccacagccaatatcatactgaatgggcaaaaactggaagcattccctttgaaaactggcacaaggcagggaggccttctctcaccactcctattcaacatagtgttggaagttctggccagggcaatcaggcaggagaaagaaataaagcatattcagttaggaaaagaggaagtcaaattgtccctgtttgcagatgacatgattggatatttagaaaaccccatcgtctcagcacaaaatctccttaagctgataagcaacttcagcaaagtctcagaatacaaaatcaatgtgcaaacatcacaagcattcttatacacacacaagcattcttataacagacagagagccaaatcatgagtgaactcctattcacaattgcttcaaagagaataaaatacctaggaatcctatttacaagggatgtgaaggacctcttcaaggagaactacaaacccctgctcaatgaaataaaagaagacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactaaagttcgtatggaaccaaaaaagagcctgcattgccaagacaatcctaagccaaaagaacaaagctggaggcatcacgctacctggcttctgatgtctgaacttttaactcccatctgctttcttcatcttgatttgcacatatgtctgatttggagatgaaaagtaaatatattcctgtgtctcttcattcttcatccatcttttcacaaaatgcacccagcagctgtgccaagcttctctgaataccatgaaatcatttatatgttttgatactgtgtcatggatatattaattgtttcttctcactacaacatggtctaattagcttggacaatacttccagtctcctgtttgaagagactgtgtgtggcttttgatgatttctctaattctgatttgataggttagatgtgggctgatctttctctcgctcttttttccttttcctttcttctcttctttccccgtaggcatatactaatgtcctaacgtgtactgaatcttgattacagtgtaattgatttagagcatatggggacttttgaaatcccttttaggagggatcattgactcttgataatctgacgaaagctatgaacacttcttccagaaatgtgtacttttacatatataatttatcatccagttacaggagtctcaagggtttagccaagtcttggatgcatgtccatagtatgtgaagaccacagaatttcagtgcttggacaaccctacagatcatcgaattcactggtttttgaaaactattttaaccagagaatccctggttgaaaagggtgggtaaaaagaagggagagactgagtcatgcacacccctacgtcgctcagagtggttcctgaggaggttctgaggaacacagtttgaaagctcatgatctaggtctaattcctgtatttctttatatgagaaaattgatccaaaaagagcagagttgactaactcaaggccatgcatccagtcagtgcacagctgagactggaacccatgcccttgatccctaggacagagtctcagccaaccctcacttctcttctaattgtaaacctcctacattcataccacagtaacttctcaaagatcctggacaaatgtaatttaaacccacaattataaataatcacccccatttgagcaacaggcaaaggaaatacagctgatttgtgttttgtcactccgtcaaggccttccttctttctgtcttatttctgctggttctcgtgtctttgtgaactgtttccattttacaacatgtattttattcaaatatacatcatagtcaaaagcatcctctttttcctcgacaaagtgccatcctgttggcctcccacagacacactctctgcccctaattcttaaagaagcagtatctggtgctcgccctggtatggtgcttgtttggcttcaggccactggcaaaacgacctaagctattattgggcttgtctccatcccagtcttccaaccttctttgtaattgtcaagaaacccaactgagcctcagctgaagtatctacctgttattgacctgactatgggcgagccaagcctagtctttcctggtctctctttcttgtgtattggtgcaggatgaggacattgcttcagagtaccaaagtggagaggaagaaacaaaccaacaaactcaagaaagtagaaaggcagtgcacagacccctttcttagggttagaggcaaggtggtctttagacttcctgagttgaagactgatgtttctttgggtggaatttctctgtgctacctcagaaacaaagatagttcatctgacaaaccagagacctacttagagataacttcagcctatccagggaactaaaaactaattaaaaattgccaggccagagtttcaaaccaggagagtggtgtggtgttgtggttaagagcacacactttgtatcctgtcggacatgaatttgaatcatggctctgccacttactacctgtgtaaccttggtcgagttaacttattcttgttgggcctccatgctttcatcaatcaaattggagaaaataatacccacattaggagagtcttttgaggactaaaagagagactaccaaacgtttgctattttgcctatcttcatcaggaccccacagaagactctgtattctgaatgttgtattcaccaccaattatctgtatccctgttgaacggagggaacacaggaaacatggcagggaatgggttaaggagcattggtttagccgataactgttgtgtgaaacatgatttagttccctcccgtctctatggactaattttccccactaggcaatgaagagtttgtgcttgagcacgtgttctttatgctgactcaggacctgagtgtgtcaaaattatcttaaaagttattttttaagtgtagatgtgcagttgcaattcccagacagtctgattgaggagatctaggggatagtcacaggatctatactatatgtccagtcgcccaggtgattctgatcagcagtcaagtgtgggaaccactgatgcagggagttgtaaagattctccctttcctccctgctttcagtcttggaacttcttatagtttgaaagtgtctttccattaatgaggcctatgacttcctacatcattcaaacatggtgattttcacacagagaaaataagaaaacgttgctagtggtcctcaaagacggtatttttccccacagaaaattcattttgttttgctttagtggcttgatatcagatccacaaggcatgtaatacagaatagggtgaacgttgagggatctgcttttaattagtttccccagctgatctctcagatcattttaaaaaatgcattctctctattttatgattgaattctaagtaatgaagtttagcaatatatgtaataaagtagaattatctcacaatagatcacaataatagatactgagtaacttctcagtgtcagttgctacctatatttccataatccttatgacaatatttgaaacaggcattaatattttccctaattttaaaacaaagaagataaaacttaaagagataaagtgacttacctaaggccacacaactggtaagggatttttttagtgttgaacagggatgaaaatggtatttaaaaaatgcaacttgaatcactttctgtcttaaaaattttcagtgacttattcattatgcttaaaaaattatctaaacaactttgtgtgggcagtaatacttgtccgttttggtcagtgctgtatcctcagcaataagaacagcgtttgtcatacaacagagactcagtaaataaatattcatggaataaattaagtgatgaagcctggattcaacccaagtctgtttgattttaaagcttgctcttcagtaatttgtatgctctctcctctctctctctctctctctctctctcgttaaatttacatactatgaaatgcaccaatatttggtgtaaaattttatgaactttgacaaatgtttataactgtataacacacatcacatccctaacaagataaagatatttccttcatcctagaaagtttctctttgtttctttaagtcaactgcctcaccctttccagagacaaaggcttttctatgtttatttattttttttttaccacatgttggttagttttgtcttttttagaatttcatataagtggaattatatactatgaactcctttgtatctagctgtttttcattcagatggtgatttaagatctgtccatagtgttatgtgtatcagtggtttctttttattgctaagtagtgttgcaatgtatgaatatatcataatttgcttatcattctactgttgatgggcatgtgaattgttttcagtttttggctattatatataaagttgccgtggttgtttgttttcaggtatttttgcagacagatgttttctttttttattattattatactttaagttttagggtacatgtgcacaacgtgcaggattgttacatatgtatacatgtgccagtggtatgctgcacccatcaactcgtcatttaacattaggtatatctcctaatgctatccctcccccctccacccaccccaccacaggccccggggtgtgatgttccctgccctgtgtccaagtgttctcattgttcaattcccacctatgggtcagaacaggcggtgtttggttttctgtccttgcgatagtttgctcagaatgatgatttccagcttcatccatgtccctgcacaggacatgaactcatccctttttatggctgcatagtattccatggtgtctatgtgccacattttcttaatccagtctatcattgttggacatttgggttggttccaagtctttgctattgtgaatagtgccgcaataaacatacgtgtgcatgtgtctttatagcagcatgatttataatcctttgggtatataccccgtaatgggattgctgagtcaaatggtatttctagttctagatccctgaggaatcaccacaatgacttccacaatggttgaactagttgacagtcccaccaatagtgtaaaagtgttcctatttctccacgtcctctccagcacctgttgtttcctgactttttaatgatcaccattctaactggtgtgaggtggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgtttatgttcaatgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttgtgttgccattgcttttggtgttttagacatgaagtccttgcccatgcctatgtcctgaatggtattgcctaggttttcttctagagtttttatagtttcaggtctaacatttaagtctttaatccatcttgaattaatttttgtataaggtgtaaggaagggatccagtttcagctttctatatatgctagccagttttcccagcaccatttattaaatagggaatcatttccccatttcttgtttttgtcaggtttgtcaaagatcagatggttgtagatatgtggcattatttctgagggctctgttctgctccgttggtgtatatctctgttttggtaccagtaccatgctgttttggttgctgtagccctgtagtatagtttgaagtcaggtagcatgatgcctctagctttgttcttttggcttaggattgacttggcaatgcgggctcttttttggttccatatggactttaaagtagttttttccaattctgtgaagaaagtcattggtagcttgatgggggttgcattgaatctataaattaccttgggcagtatggccattttcacaatattgattcttcctacctatgagcatggaatgttcttccatttgtttgtatcctcttttatttcattgagcagtggtttgtcatttctcttgtttatttacctagatgtggatttcctgggtgataatggaaaaagtatgtttaccatttcaaggaactacaaagcatatttctaaacaggctatacctaacagggtactagcaatatatgagagttgtgtatgcaccacatctttgccagccttgatatatgtagttttttaaattttagccattctagcgggtatgttgctgtattattgtggttttaatgtgtatttcctgatatttccatggtaagtattgtttcatgtcctattggccactcatatatcttgctttgtgaagcatctgttcaagtcttttacctattttttaaattgggttgtttgtattcttattgtatcataggagttatgaatataagttctttgtctggtatattttttttgaatattttttcctgactgtggcttacttaatctttttctgttcttttgatgtacagaatatttcaattttgatgatgcctaatttatcaatgttttattgtttatactatatcctgtctaagaaatatttgccaactccaaggtcatgaagatattcttctttgttttcttcgagagcctacattttaacgactacagcatgcatctggctttgccttacttgttatagaggatgcattagtccatgagataattgttatcagagtaagctgatgggaggcggagtactatagaattcaacaagacagctttgaagttcaacagatctttgttcaatttctgactccagtcccagcagcgtgaccttaggcaagtcacttgatctttctgtgtatcaattctctcatttgtgtaaaggagataataacaccaacttatgtcacaggatcattattaaataagcaagtatatgatcacttcttaacacagggcatagcacatagtaagccctcaacgagtggtgtctgttgtacttacaatacttttcattcatattataccagtttcaccaagagtttttagtgccagaagcaaatataggaagggttaccttttcttcccctactagacttcaaacagaaccattgaaatagagatgacccattaagaaggggtaggctatagttacaaacagttctttctgtatgtctaaaatcgcatctttattattttgagtaatactaataactgaatctccaagcacagacatgacagatatgattataaaactccctggcataaaggacaattttatcattgaaaactgaaattatatgaaggaatacatgtaatgcttttccagaaacacaatgtgctcattaaatgtgggtaaatgcagatgttgaagaggtttttaagtcagtgtacagtgaaaagagcagggactttgacataaaacaaacatagaacttgaatacaaggacatatgacttgattgctgtgaggctcactcctatcatctatcgaaagaggtttacataaatattggagaatatgagtgcttcaaagaatatgaacgcactagctaacatcataggcactcaaaatggtacttattggttaacctcatatttgtaatgacatatatgtaatagtaaactaaagtgagatatccaatttcaaatgagttacatccttaaaaaggtgaaagatagttttgtgggtttattttttgatagatttctcttctgtgttcaggaatggtactcacagaatatatctgtttgatatgtgaggtcattttgcagctcactcattgattcaatgcatttctgaatcatagaggaggatccctggctatttgtcatgtctgaatgatggaaacacatatttgaatgattctagtaatagagaagaatgtggaacttgctccatacatttccatttttaacatccttctgttgtaggggatggggagggagaggattgtgtatgtaagttgttttctgctaatgctaccactgctgttttcagagtcaatacatggacagaagcacaaaaaactgagtattccttttgccttatgcatcaaagtctctaaccaagtgtttagaactacatctactggtgttctcccaatgcaaattattctaggccctttgtgctctggtctcaacctgattatatacccttacctcttttcttgccacagcaaaccatttactatttttcaaataattccaatgttttactgtttctgcctctttattcatgctgttccatttattctgttatcttgagaagcctttcctcccatatctgtctgctaaacatatatccatctttactgagttgaagtgattccccctaaattcacatccgcttggaacaccagcatgtgatcttatttggaaatagggtctttgcagatgtaattagttaacatgagaacatactgtattagaatgggctgtaatccaatgactggattatataagacttataagaagtcacgtgaaataacagagacacgggcacacaggtgagaaggccatgtagtgatggaggcagagattgaagtgatgcagcaacaagccaagaacaccaaggattgttggcaaccaccagaagctaagaagaggcaaggaaggattcttctctagagccttcagaggaagaatggccaaaacaacagcttgattttaaatgtctagcctactgtactgtaagagaacaaatttctgttgttttatgttacccagtttctggtaatttgttatggcagccttaggaatgttttttacatccttcttcaaggtcaagctcaaatataatgtcttttccagatttcttcaactagatgtaatttctcttcttcacctctgtagcaatgctgtagcagaaaaaaagatcacaaactttggtgccagagaatttttggctgtaatcctggcccagctactgactggatttcttcacctgtacaatggaaataataatacctacctaatagagttgttgtgtcaataaatatgactgttccttacctctctaattcacccattctgcctcagattgcaataattttgtaataagacaatatagttctgtttttttccagttcagaggctggagggagcatagataggtaagcaatcagctttgtacacaataaaacaaaatgtgctatctaacaagggtagagacaagtattgttcacattgacagtctcaggaattcagttgtctacactaggagttccaactataagctaggaaactgatttataaaattgaaatggagaagcctccttttagtccctgaattccagaattgtaatatccaaggtagattttgtcttaatgcctaaaaatggagcaaaaattctggaaatgttagagccctctactgatttcacagctcctgtatatgacactggaacatgcttatacttggctgcacattttgataaagccaaaagttcaccacatggcattctggtctctcttcctctagggcatcttcccaaaggcctcagctctagaggaaatctgttttttcactcttgcagcctacactgcctggccaaaagtagggatttagcatgtgctctttatccttcctgagttttctttgtctgaatccccaggctctatgcccaccaatctttttaaaaaaggtcaacaagtaacatcatccccttatgttcatcatcttcttttccaggcatatcatcagaatcatctgagaccctttttatcaaagcatactggagggtttataggtgttgacctctaccctggataacgtggggaaggtagtaagcacaacacacctgccccttctgtgtgggtaagcccttgtattagtttgcatgggctgacataacaaaaatacaacagactggatggctgaaacaacagaaatatattacctcacagttcttgatgctagaaatctgagatcaagttgttggcagagttggcttctttttgaggcccctttccttggcttgtagatggccggcttgacttcttcctttgtcttcacatggtctttcctctgtgcacatatttatctgtttccaaatttcttcttttaaggacaggagtgagaatggattagggccccacccacatatggcctcattttactgaaattactgtaatttaaaggcctatctccaaatacagtcaccctccgaggtactggggtttagaacttgaacataagaactttgggtagtgacagttcagccccgtagttttgtgattaggatcaaattattttgcaatcacttggtgatggatttgtttgttatttggtcttgggctctgatagctgagacgttagcctcgtagtatacacagagaaattaactcaagcacaattcacaggtcttcctcatgacaggagaggcaaaagaatcatggaagtcaccacttggtaaacacctaccatgtgacaggcatggtaataggattttttattttttcttcacaatcagttagcaaaaataaatatttacacccccattttcatatgagaaaattaagattcagaggggctaaagtgatttgctcaaaggcataaaactagtaagtattggagttaagaattgaatataaatctgtctgactataaattcatgccctttcctcatgcatcctttatctggaattgaaaaaaaagtttttttttgctcattttaagctgtgacattaaaatgaaaaaacaattatatgaaagagtttctagatgttcacagtcatcgtttattcatatgtccatttatcatatactcatactggactagcattgcttcactttgtttttgagcttgccatggaaacttaaacaactgaagaatcaggaaatgatgacagcaaagtgattaattatacattgaaaaaacaatttgggggatgatggtgcagagagcccttttagccacactggcgtaatgaagtagtttagatttgtcctgtggcctctgcaatcgacctcttgtttgttttgttacaacaaattgctttacagtactgaaatggtctatttatgttcattgtttcttttgcagttttgttcccaaactttggaagttgttggagactgacagaagagccaggaacatcccagttttctgaacattttctatgattgtgacacattttaggatgctctttctacctagtgaatggtgcagtttgtaaggatagattatttgctgagaaagtgggtattgggtcctgtgacagaggaaatatatttcagagtattggagggccatttaaaaatgatgatggtgttgataatagcaatgcttcctgctgttgcatcatttagagtttacatggatcttctatatctcacttgattttcacaaaaacatattgaagtgatcagtcagggattgttatatccactttccatatgcaataattgagattcaaagaggttaaatggaggcaggacaaactcccacatctttgatcaccaacaactcccttgctaaattattctttgtaagtccagtacactgagttcattcactttaaattggtgcacattttgtcctcctggaaaaacattatgtcgaattgggaccattaataattgcttactagtttcaaatgtccagtgggatgtcaattgagatccagcggctcttttctccccagcctctttaagagaacacacagtgaattcaatgcgcagtgctttcctcctgctgcttgtacttcctaacaaagagcccccatttattggaaatcaatcatgtgctagatactggctatgtgttatttctaattgtcacaattgataactctgcaagagaggtattatcatacctaccttacaaatagggaaactgaggcttggagctgttaggtaactttcttaacatcacagagatggtgagtggcagagccagaacttcagcttatccagtctggcttcagaccattgctttaaaccaccataactctttaaattcagtacattgactttttaactgagttatttggaagttacagcttggaggaatccattccttaggaaataggttgacaaaaaaaatcataaagttaaaaaaatgcaaaaaactaaaaaaactaaattgttaatttatctatatcatctaatttggtaatagttttctacagttgattggaaagcttgtggtataagacaagcttctctgagggtaacctacagtcactgtaagtgcacagaggatgccttctttgctcatttctaatacaaaactatttctgttctcctatgtctctaatccactgaatcgtttttccatgtacctattctttttagttcatgcatagtcacttaattgaacacatactcaccaagataattaacaattattggctacttccctgacaaagggttaattcgttctgttggcaacccctgttaatactaaaaagccctggggcagtagatcctttcttctaggaatgacccccccactgttcattggagcaggcaggagtgccgaactaaccagtcctgctatctgtttcatctgtcgagtagacatttgactacctttttttgttgctgcctgtgactcaccctcattactcaagattgtggaggacagcaactgtgcttgaggagtagaggagcagtcctaagataaatcatcttaatgatttcccatgcgtttaggacttagaactttgcaccacaaggggataaatgcatgtcgcacgtagtcttcatagcaatgaagaataccattttggtttataaagatgtaggaaacaaaaattcaagccctccattatactacatgtctatcatgggatcctgcagattctaattatagtatctaccttttactaggctgctccttgtagttgcactttgacctcctcctagtgtagactgcttttatatgctcgacacctcacctcactccttctaccaccaagaagaacagagtccttagagcaatggtgaccaacagcttttgtggaaggtcaaactggtaaaaagaaaactgtatgagacaaatagtggacactcaatacataagtttagagagaaggaaggaaggatgggtagcttattattcaaattttatatcatcttttttctaaatagaaaaataccagtgagagaattgccacttctgtttagcaactaaaaaaaatttaatatctagtcatatttgagaaatggcaatacagaacctgctttttaatctttcagcctgaaattagcctgcctggttgtaagatgcatcctatgatctattggctgctcaagagtgctttagaggattttcgaacttgaggggcccttagaaatgatctagtctagtgattccaaaagttttcattatctaaggcatctttaattaattttcccctgcatactgtgttttgaaatatcaggcctactaaacaaattacctttatcacataataattccttctctcattttttttttctttttttttgctcagagccattaatgatctctcagtagagaatctggtcagcatgaaataaccagtgtaaccacaataagatgatataattccttcccaaagtgaaggcagtagatggttgagttggtctagggtcagcttgatcttagcaatctttacaaaccatctcccttaggcttattgaaatgttaaaaatagctcatggattcccatgatgaccttcttataatctttgtggacagccatttatcttatccttctgtagggaagaatggaggggaatcagatttaaaaagcaaagtgattggcccaaggtcacacagcaccttaatggcaaggaggaccagaatttgtgtttcctgagtctcaatcttctttctctacacacccaattttcatgtgccttaggtctaagagcttaatattgtataggcattccataaatctttgctcgatgagttggtagaacaggggcactaatacttaagtataggagatacaaaaaaaatccatgatgaattcattaaacaaccagtaaaatagtacaaatatccagttcccagttctgaattcgtacccagcctcctttgctttccttttcatgaatgatttcagacatctccctatagcgtatttcagctgctgttgctcttgaaaaggtttactcaggaagtcaaatagtgtccacttatcctgttataccctgtctccgagaggtgaaaatagcatggaattattctcagcagtgaaattcaccctcctcttttgctttcatcccctttacagtggtgatccttgctaaaatgatgagaatttgaatacctctactccaggatagttcattctcagtccttctagatgaagatccacttagctattcaatttttcttcctttctattactgttcaaatgtcctataattatccatgtggggcacattttagtgaatgacatttagtgaatgacatttttgacagacaggatacctacttccaagtaggtcagatattagagcttcagcagtgcatgctttatgtgattttcataggaattcatatttgggagctcctagctagctcatattctctcagtgaaatgttgaaatatgggctcaattgcagggctttagttgccgtgtactgtcctacatgcagggtgcacttcacatcaaccagaatgagttctgcatagcctgcaagactaaatgttgagttactacacattggacactggatctcacaaggggcctctgcaaaccctcatcacagaccatgggcagtgggagtgagccagtgatattctcaggcacagccctggggcccacccactgtgatgcccaggagaggaacagattgcccagtccctgatcaacagtccccttccatatttcccatggtacaaaaaagtatatatatatgcacagtatttcattctgatgaagagtttatagtcaatgtgagacaacaggtgggtttttggggggattttagtggagttgatataaattacatgagcaaagtagaatcttggatagtctaatgctttcagaaactatttgtcaggcccaaataaaatttttcggtcttgtaaatggcctagagcaatctctaagatgagaagttatgtgttaaatggcaaaacaaacaaacaaacaaaaaaaacaacaagatacttgaagaacacagtatacaaggagtcggcataatgagaatttccccagttgtatttttcttgtaatattgacgttgtttttccccctgttgtgaactaaagagatagaaaatacctttgtgtctagttgaaaatggattcttaattaactgtccagagatttgttgttagaggtaaaattctgggaagggttctttgtatggacaggaagaattagctctgtagcaagcataaaaagggcccatttcttcctaatggcttttccaaggaagtggggaaggagagaaaaaccgaaaaggacattctcttattgctcaaatgaccagatttcttggacccagaactgtagctcatacacagctaacctagggtcaaggtttgtaggctgcctctaaggcatccctttctttgccaaattgttatgcagatgtgatgtgttaaaaacacactccagccctggttgtttggagggcatctttcctaatggaggtgatacaatgtgcttattgagtcagcaggcactttgttccagagtagacagtaatgcaggagtaggaacataagatatggaggctaagttctgtcatttattatgtatatgacctggggcaaatggttcaccctcagcctctgtttgcttacctaagacatggggagaataataataccaacttccaaggcttgttgtatggatcaaatgagataatccatggaaaacccatctccccatgcgagacatatccttacatagtggctcaataaaagatagatgagcacgacagcattttgtaggacaaggaaaggctgggactatagactctgtttatttgaaaataatgccaatgagaggtctttttctcttgggccagtaagtctcactcagggaagaattctgacacaagtacatagactgcacatttaagctctatctggtgctcttccagattatggccttggttttgaggaactccaggaataaggggacttgatcatagacacactagtggagagggagcatcaggtgcctgtagatcagcagaaatgctacttttttttcagaggaatgagatgccatacatacaacctaatctggcttcaaatttcagaagcagggactttccacttaaatatcatcccatgaggtttgaggactttctttctgtgtaagactgaggattttgaaaggaatagccttgaatctgcaaattgcttagaacagtgtggccattttaataatattgattcttcctatccatgagcatggaatgttttccatttgtttgtgtcatctctgatttcttttagcagtgttttgtaattctggtagaaatctttcacctccctggctagctgcattcctgggtattttgttctttttgtggcaattgtgaatgagattgcattggctctcagcttggacatcgttggtgtataggaatgctactgatttttgtgcattgattttgcatcctgaaagtttgctaaagttgtttatcagatcaaggtgcttttaggcagaaactgtggggttttataggtatagaatcatattgtctgcaaacaggaatagtctgacttcctctcttcctatttggatgtcttttatttctttctcttccctgattgctctggccggaacttctagtactatgttgaataggagtggtgagagagtgcatcctttcttgtctggttttcaagaggaatgcttccagcttttgcccattcagtgggatgtgggctgtgggtttgtcatagatggttctcattatttggaggtatgttccttcaatgcctagtttattgagggtttttaacatgaagagatgttaaattttattgaaggccttctctgcatgcgttgagataaaacaatgacattattcacaattacaactcctttaaaattcataggaaatcaaaaaagtgcccaaatagtcatggcaatcctgagcaaaaaggacaaagctggaggcatgacgttacccgactttatactacaaggctacagtaagcaaaccaacatgatactggtacaaaaacagacacatagaccaatggaacagaatagagggcccagaaataataccacaaagctataatcatctgatcttcaacaaagccaacaaaaacaagcaataaggaaaggactccctgttcaataaatggtgctgggataactggctagccacagggagaagattgaaacttgaccccttccttacaccatatacaaaaatcatctcaagatggattaaagacttaaatgtaaaacctaaaactataaaaaccctggaggaaaacctaggaaataccattcaggacatagacacaggcaaagatttcatgacgaacaccccaaaagcaattgcaacaaaaacaaaaactgacaaatgagacatcattaaactaaagagcttctgcacagcaaaagaaactatcaacaaagtaaacagacaatcaacagagtgggagaaattatttgcaaactatgcatctgacaaaggtttaatatccagaatctataagtaacttaaacaaatttacaagaaaaacaaaatgaccccattagaaactaggcagaggacatgaacagttttgaaaaggacacttttcaaaagaagacataaatgtggccaataaggatataaaaaaaagctcaccatcactaatcattagagaaatgcaaatcaaaaccacaataacgtagcatctcacactagtaagaatggccattattaaaaagtaaaaaaataacagatcctggtgaggttgcagagaaaagggaatgcttatacaattctggtaggagtgtaaattagttcagctgttgtggaaagcagtatggcgatgtctcaaagaacttaaaacagaattaccatttgacccagcaattccattgttgggtatatacccaaaagaatataatttgttttaccataaagacacacgcatgtgtatgtttattgcatcagtattcacaagagcaaagacatggaatcaacctaaatgcccatcagtggtagactggataaagaaaatgtggtagatatacaccacagaatactatgtagtcataaaaaagaatgaggtcatgttctttgcagcaacatggatgaagctagagaccattatccttagcagactaatgcaggaacagaaaaataataacgtatgttctcacttataagtgggagctaaacaatgagagcacatggacacagacaggggaataacagtcaccggagcctacctgagggtgggggttgggaggagggagaggataaaaaaatacctatcaggtacttgcttattacctggatgactaaataatttgtacaccaaaccctcccgacacacagtttacctgtataatgatcctgcagatgtacactcctaaacctaaaataaaagttaaaataaataaactctaacatatgaaaattaaatttaaaaagctgaggatttgcaattcatggaatatgaagcaatatttgtgttgtcttagttttagcttatgaatacagggagaaatcatttgacttagggcttgttctgggtcagttgatctttggccttgtttccataaataaacccttactagcagctttggcaatgccagcaggaggccagactatgcctggtttcactatgtcctggcactatctcaaccaagagtgaaaatcttgggacaaatcaagtttcagattttgttgttgttgttttaggaaatggctttaaataccaatttctattctccaagtactttaaaagcaaagtaaaattaacattacatttaaagccaaccacctcaacatggcaaatgcctctcaacgcctaatggactctttccttgggctaaatggacaagttccttagcagagcttgtctaacccttgccttgcattgcaccccagtcccgcacaagaagctgagtagaaaaaactgcattgtgctctgcatgagaaacgtacctaagcatctaggtttagggcctagtttgtaattagacagtttcttggaagtacatcaagctcagcctcaaatcagaacatctcttggggagcaatctgtatttagatgtttcatttaaaaattcatcattgaataacaaaatattttgttgcaactcctacttgatgcattccaaattctctctgtcttttaattacaattatgttattaataatggatggaatgggtgggggcatgggtgagactatgccaggggctaagtagcaaacagagggtagcataagcagttaagtcatagttctttggggcggcagaatcccgtgaatcccaggccaagagctcgccactctggcttccttttatatatgcctgttatctacatcctacaactgctctgatttggccaggagaaatgttttttcaagtagtaggcaaggaatgaagttctaaaggtatttggcaggcagactaagtttcccccaaaagctggaagaaggacttactctttgtgtctatactgacagcctctacttttcccattatcttttcatgctatttcagccatccctccattgagactgctcttgtcaagatcaccagtgaactcctgtgtcacccaatcagtcttctcttttcacatccgtttggtctcctagcaccatccatctgttgactgctgttgggtgtggtgtagtccagggcaggaggagaagagggagaaaatgttatcacaaattctattctgaactacactatgtttagtaatatgcctatgttgtcaccctcatcctcatttatgttctccttgttcttcttcctcaatggccactccttctcagtctctttaattggcttcttcccacttaccattctctaaatggtagtttccttaagatttgcctctgggctttcttgccttcatctacatcctgctccagtgagattatctactccccatgctttaatctttatgcagttgacgtctatatttctatctccaatcctaatccttttagccacatgtattgtgctaaatcttctctctaaagcagaatactaaagggcagtcaactgattaatagccttctctttttctttttggccttcgattttttgtttctaaattgttcacctagagttactctttccacaaatattaaaagataatctatactgtgtcagacacagtgctagctgcagtatagactggggattaggaagttacaggtactgggatataggattccatgtgatactagaaaaatgtgtatacattcatgcagtcatacgtacatagctacatacaaatattcattcagcaaatgctaatggagaatgccaatgtactgggtgctatgccacacactagaaataccatgaggacaagggcatagctcctgcttacatgcagctagtggtttagttaaagtcagaaggcaatcaaaaggcagcaggaagtgtcatatagagataatttgggtgcagaaatgagtacagatgagggttcatatctagcctgtgtgtatttctgtgtgtgttattataagttgtattgaaaatattgatatttgctacatccttgccatctcgccccatgatatacacaaaggaacactctctgggtctttcgttctcaacatactgtgtaactctagccctagtgagctgaatttgacttgtaagaccagaagggctcattttgtctaaactcagtctctctgggtttctactaagctctataaaggagggggtagagatggactggagagaaaagaggaaacttcttctcaagaagaaagggggtccgggcctgcttttgtcatactagctatctaagagcaccacttgagagagatggcctggcactgcagggagatattctcacaaacagatataaaagaaaaaagccaaagtcacactcatcctcatttttgtgccacatatgcccagacctttaatcccttttctcaatgaagtataatctttaccctataacattctgaccgctcccctcactgtggccttgcggtccccagtgtggagggatgagggagaatggggaaacattaatgctttccctggagaccacaatatgtaagttttcacagaaattttcccacagaaggtgtgcttccgtagaaaggaatgcataataggtgctcaattagtatttattgaatgagttaatgaattatagagtgagcaggagttagccagaacttattctggtcagccattatgatggatgtttggggtacacaggtgaatgacatcaggtccctgctgtcaaggaactcagctcccagtctgatgcaagaaactgatatgctaacaagtaattaccatttggtgttatacttattataacaatagctaatgcttagtgagcccttactatgtctaggtaatgcttcatgtgcattatctcattttatccttacaattactctacttgatatattttgttattttctactctccagatagtcacaatgaagttaaataattttctcggagtcatccaaagtgcttttgatgttggcttgggtctgggctgaagcttgggggagttttgacagccatcagtaagattactaagggagagctctttttgtggagaaagaagcatccgagggatagaggtttaggaagaagcagtagaacattgtaggctctttggtctgtgggagcacaaccagtgtagactgtggggccttcgccccaagagatgattgagccttatcaagaattttgagataattcccctttgctcaagtacaactttgggaccttggaatcacccaatatgccttgtctttgtctctgatactaaggatgcctaagtgaccctgaagaagcaatggagagatgaagtttttacaagaacttcctgatcccacagcccagccaggctgtacatttaaccactggcatttggaagcagcagggcttgtaagtgtgcctcatgcacatcaaaataaaacacataccacatagattccattttcacatttttacgacattcttgaaaagacccaactataatgatggagaacaaagcagtggttgtcagaatatagaagagggtttgtgtgacttaaaaagtatagcatgagggactttgtgggagtgattgattgcaatggaggttccacagatctacacatgtgttaaaactcatagaactatacaccaagaaaagtcaagtttactgtatgtcaattttaaaagtccaaatataaaagaaataaagcacacatcatctcgtgtgctctatttttcacctctcaggctgtacaaaatgtgagcattcaaagcctttaatgatttggcagagttggaagaagggtaataagtggggagattacttgaacttggcacctgattcttttcaagtcatgagaagctaatttatcctcccttgtaccatctctgttgttaagctactgagtgcccttatttgagaaatgccctgtgggcaaaataggatggtgcatgatcacagtccgctctccaggaaactagtgtgaagctgtgtgaaagagcattttttttttcattttttccccaaactgtggcccgcaatcctcaaacgctcagcgtcccagctttctcacagtatttgacatgactgtagttcttgtttgtacttgcagcacagagcaagcagaccttgacttccagaggccctgacccattgaaggggccgcccaacaaagtttcctgcaaagagtaaagactctgaaacttcgattctgatgctataggacaggaggaccactcatctttaccaaatcagggaggtgtccatctcccctttcactcttttcctcctcctgaaatctttggggtgccctcctgagggcagggggagaagagggagaaaattttatcacaaattctattctcactagattatgtttagtaatatgcatagtattttttttttttccaaactcctctccttactggatgtgggacctttggccagacatttaaaacttttagattcttttcacatcctggatatatggctaatgactactgccttgcttaactcccagaaggactgagtcaaatgtcaaaatgctgggtacatttgtatgaggatgaggatcaattgaataggatttatgatggactggcttgggcccctacgatttattcccattagagcatatgttttgatttccaacctactaagcaaccaaatcacagatgcagttttgcaacctacagcacatttcatctcgtttattttcaaagctgtaagcagagagccatcctccatgagcagcacacatttgaaataaaatacaagttcccatcaagatattctgacatgttagacaagatgccaaattgttactgtgcttcagacttattaggcaggattgaaaagcagtttttagcatgatggcaggtcatttctgcttgcccatgaaatggccaaaccaagcactttttagatgtgatcatatggggaagaatgttcctcctccttatcttgatcagctttttaaggagaaggcatcctcatcttcctcttggttatgggtccgcttcctccactgaactcctatggcattttgctaggaccacttttacagctgttgccacattttgcctcatggtataattgttcctctacttgccacatatctgagtagtgtaggagcccctccacagcagccaagtcttgctcagagaactttgcagagttctttgtggattgctggaatctgggatttagctcttgaaagttaaagcaaaagaggttacaccgaaattctaagtaacctatttttttcatttagaaaagtaaaattgtatctgttgattatagaagattttgaaatattggttagtaagacatagaaaattaaaatcatctgtagttttcaacttaggatactgggttcataacttaatccagtttaatgtatacagttactatggctggttctgcaaatcgaaagatgactatgacatggtcaatgccctcagtaacctcacagactggtagggaagacagatacgtgaacttagtcctgcaggcaatggggagccagtacaagttttgagctggacattgacatgatgaaaatatttctggaatttttatctaaaggcagcatggtgtggagaaagctgggcctgaagcataaagaccaattcgcataaagaccaattcggaagccaatgctaaaaggccacacattttactgtttggccttaaggtaaacacaatgttattcaaccagagtgacctccttctcaagttagttacccttgggacttccaaaagtgaaacttagagattagctttgccctcatcacatttactgagcaacaaggcactttgacagcctctcactgtttgtgtttagagtgggggacacaactttttctctctccatctgattggctgagctcccagtctacactacagaacctgagtcttaggagacagatatttaaccccaagtcatgccactgggtgtccatgttaagaaatatcttagggaatcttccacaagtctgttgctgttctcctccaaatatttttggttttcttaaaaaattagtatgcccttggtcagaaaggtatagaaccaaagatgtttgcttctgcaaacctaaggatgactatgacatggtcaatgccctcagtaacctcacagactggtagggaagacaaatacatgaacttagtcctgcaggcagtggggagccagtacaagttttgagctggacattgacatgatgaaaatatttctgaaatttttatctaaaggcagcatggtgtaaagaaagccggtgacctctcttttacagacagaacagctagtctcctggttatacttgccctaggtctcacatattaagtggcagaggtgggcctaaaatttagcgttagacaactaacactggtcctccatgaaacacaaattgcttctaggctggaggagatataggtgtctctataagccagggcctgtagagcaggggcactagccataaagaccagacaacagcccaggatggctactgatcctagcagacacagttctataatgtaaaaacaaccaagaagcaaaccaacttaaaagttaacagacacacacacacacacacacacacacacacacacacacactacactcctgacatgtttttcccctttctattttcagttggggttatctttcagtttagttctgggaaggggtttctttttttgtcgttgtggttgagacggagtccctctccggtctctgtcgcccaagctggagcgcaatggtgcgatctcagctcactgcaacctctgcacacccccaccccccgccctcccgcgccgggttcaagcgactctgccacctcagcctccagagtagctgggattacaggcgtgtgccaccaggcccggctaatttttgtatttttagtagacacgggttttcaccatgttgggcaggctggtcttaagctcctgacctcatgatccacccgcctcggcctcccaaagtgttgggattacaggcgtgagccattgcactcggctggggtttcgttttaatggctcagtaaactgtgatctggtacaaaaggatgggattaatgggctcttttgctgcaaatggtactaagctcttccagctttatactctgcaccttttatcttcgtggcgatatttaagcttttaaggacgttgctgggagtgacgactccattggatccaatctcaggaacagtaaatggccttcaactctttttaaaaaagatgcattgcaggagtgaactgctgcaaactgctgcaaactccatggaggagtgacctttaaaatggggggtggggggatagtttgctgctggcttttcattccctgtagccacctaagctgttggggaatggacatgggaaacacactagctaaagggcccatttgttacaaactgagttttggtcattttttcttatttatatacttatttgtttttatctgagcacataaatctatatttgaatgctgcaaatcaccctttgttacactcttcttagtagacacatatgtatttagggtacagctgagtacagtacatttgaggttttgcaaatgataaattctgccatctccatattcttggataaaactagaaatacacaggcttttgtatacgaacagcagaagctgatgactctattcacatatagctatgttggatatgttggaggcctggagcaatttggccacagagagttgtttttaggattggaagaacactcagcccccaaactagataatgtgacatgttctatttttaatgagtttattttcttgtttcagcttggaggtgttagttcatcgttttgattcttgacaaaaggattctgcttagactctcagctccctggtgggttggagtttcacaaaaacatctgcgctaaagcaaaggggattcatactatcctagacagtgttcacttgaaggtttcccagaagcatctgtagctggaagagtccctgtcagtctctactccctagctgtagatgggcccacagccctgctgcctagggaaaagttgacagttattaaaaaaaaaaaacagcccttttctgtcatattcacttcagtaaaggaccaagtctgctattgcaaatgggctgtatccagtgcacaggtattctggtatctcctacagcacatagtcactattgctaaacattttgggtagttagagtcagtagtcccaaagattggccataagggccaaataagattggaattctgattatggtagaaaatcctttttaatgtattataattcataagaaatagacttcagaagagaattgatttcagagctgtattcctgctcatttcttccatcctttctgttcatttttcatttcctacagacaatcaattagtaaatgtaggatacgtgtgtacctcagtgacccaagttgctagggatacatcaagtgcttcagcccatagcagccaagggaggtttggggtgtctctacagctcttgacttttcaacttcaattataaatccatttggtcaagttgtggtttgaactgtgtgtgtcccctgtgatgcacttttggtaaacagctgcagtacagaagcagctgggcttatttgttaccatctctactaagccgccatataactgcatggggacggtgatacagcaagtgaaaacgggtagagttttacagcatagggtcttagattcatgatgagaaatgacactgaacaaatgactatttttgactttaaatagaagagattaaaagactttcagatctgttctcctaggtttttgttcatacatcttcatttttgcgatttctccggatttggagtctgttttgaaggggaaagttggcccatccagaaagcaccggatcatattttccattctgtatgcattttgctatctgccttgtttatgtgaacattaaaataaataaaaccttacaatctaaactttgcttttactaaataaatgaacacagcagttattaattgaattcagtcagctttcaaatagaatcattactttattacagtataaacacagtggaaagaaatcagacaccctagcacagtgcatgttttgctaggaatttaacaaatatgttggcctcaatgtgaacaagttatatatttttttcagacttgaggcttgttaactctttcaggccacttgctgctaggcaaccaataccctgctggcttgagtccatggttttaaaaattatcagtttcctgccagactgacttgaggacttttgaaaaagtaaattttgaatgcatgctgcgctttttaggcaaatctttattaaatgtcttctctggcaaagatagtactagaaatatactgagaagtgggagaaagggtggccccttccttccaagattttataatcttttgatatcaagcacacacacacacacacacacacacacacacacacacacacacacacagctaaggcagttcacaacaatggaccagggtgaatgctgtggactgcagttgctctagagtaatacagggaaaggatgtcttatctgtggactcatgcagccaacaaaggagctgtggaaaaaatagaggagtttgaactggactaagtagaaatgggggtatattttaggcacaagggacagggattcaggatgctgtcaaagtgaggcaaatagttgttgagggcctcttatttgctaagtgctagggacagagtgaggaatgagccaggcatcatctggcctttaatggagctttttagtatgaacacaattattttcattcttttttactggctaacttatgtgcaaatttctgtaagtaagttgagaacccatttgaactgctcaaataaaaaaaggagattatattggaagagtccatgattacagcctgcccctagatcttgtggtaggattcaacaactgaaagtttgagaacccaagattacttgtttcatcatcttgggtcatataaacttttgttgctgcttcaaagaccacttcaagcttatctcttctccacactaaacacacacacacagagagacacacacacacacacacacacacacacacagagttttcctcttctgctttcacacacttgtagtcacatcagcttccactttaaaactacttcctagtttgaggatccaacagagattgacttgaattcctgtgtcctgatgccaaagtcacccagctttggtcagttgtccattcttatccaatcagtgatgcctatttgggcaagttgtatgactttgagaagagaacaagagaaataaatgattgtcatttcaagtacagtcagtcattgttgagagaaagagcaaatcccaagcaggggcttaatatctgacctgaacacatgtgtttggtaaacagtagtgagacttgtatcactgaaaaccaggctttccatggaggggcatggtgagaatgaaaactggaaagatatggtgggtctatattttaggacgtcattttaagtgtggaaaagggaagtcttcatgtctcattgatattgaggcacattctgactggctaagttgcagagaaactgtagacaaaattcttgtcatcagtgaggaggtgtgggactggagtgagcattttctaagattgtttcccagcctatagttatttggtttgaggctcctgcagattcctttctgagaggaactttgtttattactcttttgctgtagggattatgctgccctctggggattgggagattcctgggatgtgagggcacccctgggtggggtctttttctttctgagagcaccgcgataacatcttcctgcaagaggagtgtgtccctcaaaggccgaaatggaaaagattcaaaaatctctaactctcacctctctagatataatgcaatacacatatagaatatacatgccctttttcttggagaaaatttccaaaaataagatatatatttttgtgtaatgcctattgcttactttaaaatatttaaattatttaattttaaaatttataaattatgtatttattaaaatttaatatataaattaaaatatttgctcagtctggaggattcaggaaagcacacaaatttggcatattacaaagtacatgtaaccctaaacatccaaagaagatcaaattggtattttattgtattctttttcaatgttttatgcatgtatgttatacaaaataaaatgattacaatactatacatacagttttgtatccattttgtcttagtgaacatttctccatgtcattaaatattcctggtagctatatagttttactgtaatatattttaatatttactaatttaggggaatttaattgtcctaaataattattccgataaatagctttatatgtaaatatttgatcacatctttatttctttagtccagctttcaaggcttgaaattattagggaaaatgatgtgaaattttaaggtcttgttatatagttccaatttatatagacccccagtctatggtagcggctgactacctcatccttgctggtactaagtaatagcatggcttgtagtttatatcagcttggtaggtggaacgcttctccatggtaaagaccatggcattttctcctttaatggtgttcagcacatatcaggcacactatgcaagtttgttaaataaatcatagtcaaaggagaaggtggtaagatctattacgaagacatgtttttttgttctaagtctgtggggaattcaagaagaaattagtttaagcttgtgtaggaggatgcagtagagaggtgggattgagaagcgaagggccagtgaacaatgatactgttaaatgcattgaaacttcaaataagcaaatggggccaaggagagaaacttgttaaaaatgaagtgtggtctatttcatggagcacagcataggtgactgcagagtagatcatggattgtttcaatgtaaaaaccagtgggttgaaccctagagcccagttggatgggtctatggatgggtctatggagcacagttggatgggcctccgactaagtgtgaactgtgcagggagattaggttgtaacaataaaagttacagttctacattcatttattcattctttcattcatccatttaacacattgtttttgaatttggcctgtttctgtagtgacgatggagctatgaagatagtactagagctttcatttgggtggtttgttcaaatgcgttaggtcggttggtgcaaggtttgtactctggccctaaataaatcatcttggctttctaagaggtgactgaataagactcacttactctgctctggccatataggcttagttgttgtatttttgtttttgtttttctttcttgagactgagtcttgctttgtcgcccaggctggagtgcagtggcgtgatctcagctcactacaacctctgcctcccggattcaagcaattctttctgcctcagcctcccaagtagctgggattacaggagcccgccacaccacaccctactaatttttgtattttcagtagaagtggggttttgccacgttggccaggttggtcttgaactcctgatctcaagggatgtgcccacctcggcctcccaaagtgctgggattacaggtgtgagccaccgtgcccagccccttgttttaaaaatatactaggcatgctcctacattagagcctttgcactggttgtttgttcaacatggaatgggcttttcttagatgtctattggaccaaatccttcatctcattcaagtctttgcttatcgctcacaatgtcaatgaggcccacattgatcatcctatttaataccacaacctacctcccactctggcactccttgttctccttattctgctcacatttttcttttttcatcaaattataccatacttttaattatgctacataatttacttatatgttatgctgattgcatactgtctgttttctcccacttcatgaaagcaagaatctttgtttgggtcatgctgtgtcactgaaccctaaaggagtgtcttaaacacagtagtgcattattatatttttgtggaatgaataactcatcatgtgcttggcaggcaacattaaagaggatcttcagatttttcagaagagcaagggagaactcccctcacctgctgagctgttggctgtggactccagatcaaagtctgaggaaccactcacctccatttcttggcagtggagagtgagatcaacaagagagataggagaaaatcatggggagactttgagtttagagggtcctgggcagctctctcacaataacagtaaggtagggaagcatctcagagctctttatgcaaaggccctcatccaaaaatcgagaccagatttccatgaccattgctgttgctgttcttactacatctgagctcttccatgccctcttttccctttgatcagtggtgtcagaaagcagatgcatactaacatttaccaattgtaggacatgtcccacaacgaagctcattctgccttcaacaccagagcaagagggaattatgggaagaatattcaccagggtagacttttggggaagtgatgctgaagcctcagtattaaaaacttggagcagtgggggatgtggatgggctttctgaaaaagttttgaatttattagtgaacctgttactcatcccttttggggtgtgggtaatggagtggagggagagccacagctgctttgtgctgagtcatacgcttgtgtttgtactttgccttgcatagaggaatccaaggttgcttcacaatgacttggttaaaattagcactgtcagagagctccgtaaagagtcttgtgaaaagtcttccaaaataaatcaaccttcctgttggggttgagtcatccccttctttcttcaactggaaatgattttaatgggaaggtaagccagtaagatctttttggttgccgattttgaaggtatcattgtgataacacagggtggtaaggcagaaagtgtcagacagtggtagggggtcaaatgttggctgtggcgtaacttgctgtgtgaccttgcatgagtatcataacttttcagagtttcaagtgtcccaaaagtaaaaagtggggctaccaacatctgctttgccgagagacaatagatgtgtaattaagtggagcaatgtatatgaagcatacttcttggcacataaagtccctcaacaaatgggaacagaaatgatattgatcactgctttccacatattcttcaaactaacatgtctcaaagcaagcttatcactctctgccctgctgttttcattgagacctgctgctacttgaattcattgtagctctcaggaaaccatcattcacccaggcatattgatatattgatggctgatcacttctcaattaccactaccaggactttaattctgcccttcaccacttcatacatagaatattttaccaggtttttttttttttttttaactttccccctacctcaaacacctgggagttcacctactagggtggtcccttggttaggatgtcccttacggtttccttcctattctgcttactgtgtggcagttgagtgagcatagcatactactgtatgtcattcagggttatggactcagttactcaattctgcaccccaaccccttgacacagggaagcacagtataggtgctctataaagactggctagaattgaagtatatgggaagctgtgaccaagacgtcctaaaggcatattaaatagtggttgtcaccatctaaaattaccttatttatttcattatttgcatatctatatgtccttgctgccttcattattgtccattttactcctgtatcatgtcacaagaggtagatgtccagacagctcatcattcctcaagtcatacctctaagagagcaggaactgtatctttcctattcatggttatgtctccagaccagagcctggtgcttctagtggccatcttttccaactgtgggaaaaacctgtctgacaatagagccaacacagagaaaagcaaagctgagagatggagaaaaaaggcagagtgctgctgatattgttcaaaccataagatcctggcatgcctgaagtgaacatacccccttggacatcccatatgtgagccaataaattcccatcattgctaaagctaatttgagtggggtttctgccatttgcaataaaaagcaaactgactaatacatcctctcctcagtacctcataaagcttcatgaaaatcaaaaggaactttccatttgcaacaagttattcattctagtatcaaagtttcaacatggttatcctttcctgccttactcaattcaggaatgcaccaataatgatgccactagagagagatttccttggtaatgggctgaagagcacctgatgtggtggtaagggttgctcctttaaataaaggaataagcatttgagctaacacatggatgatgagaagcagccatacatatgcttatctagaggaaaagcattctaagtagaggaaacagcaagcacagaggcccagagacaggaaagaagaagctgattgttggtttaagaactccacagaaggttcatgtggctggatctttgtgaaagaggaggagacatataggaatggagaagaagccaagggccatgtgcacttttcaggagaatgcatgaattcaagattgtctgacttgggacaggagtcaaatgggcggcaacaagggcagcaaagaaggcctgcattcattcagtgaaaatgcagggtggcttgcctggcactgtttcacgcagtgtagctgtacaagatggtgtctgcagggttgtaccagcaaatcaattgctgtactaccaacctagaaaagtcagtgaatcatccttatattttgatcatatagttaaatatattccgtttgatcctttagtaagttagtggagctgaaaataaatggattaggttggagaaataagttaacctctcacattcatcagagcttaatttagtgattgcctccttattgccctagatgggccagtagtatgacccatctcactgtgagtaccttactctgagaattttgctcagtttccaaaaggcagcaccatagatatgaacacacaatgttaataagctggtattatgaagcacatcatactgcaaaaattctgatggtttcatagaatgtgaatatagtagatagaaatgtatttttatttcaaagtcctgggacattatgcttgcaaaataccttgaaatcgtgtttattctctagcattcatagcatccctaaatcattaatatgcacatgttccaaataaggaaactgtctgtcatataggaatattttgtaatgcaatttaattcatctcatttcaacaaatatatatggactgtttgatgtggatttatggtgttgaaagtagactgctttttgtaaggagaatgaatggatgcaggctagagatgaagcggggcatcttacaaagaaatgtttctagtaccatgggttaagtgaaattctaccatgaactacgaaagtgacagtggaaatgaggaataggcaaatacagatatttaaaagcaaaaccatcagggcttggtgacagattagaggtgaagaaatagagaaggacaggaatcaagtatatgtctatgaagtcaactggaaatattgtggtgttcttgatagaagtgggaattcttgaggaactctagtttgggaagatgatgtctagtggacaattggaaggcaggcctagagctgagcagcaaattaagtcctgaagatggacatttttagatcacccccctaaagatgatgactaaagctatggaaatggataagctcatccagtaggtcaatgtagagagagactccccacagattgaggcgtgcagagccctatgcaggccaccttgacataactcaccatacctttccccatgagtgtgattggcacccttggggccattttgatttcggatataagccttgtgctatagaataggaaaatttatgaagacattcaaattctgccattgaaagccagtgtggtatctggataatggacatgttattttgagaaaaaacattgcttacactcaggatattagttagaaatccccaatttagtttcattttttttgtgtgagaaaatatggcagtggaaacattttcagaaatgggaagtcatttcttagagagatttatttggagcatagccagtagcaaaatcagctattgacaccttaagctacagacttaagatgaaaaacaatgatagagaggtcgttttttttgttgttgttgttttgttgtttttttttttttttttgagttccataaggagaacatgattagcctattcttctgattgttttatgtttgcgagttctgtctcctcagttaattttcatcttttctgaagcatgggttctacctcataatttttggatctccctgcagtgcctagcacagtgcagaactagtgtatcacacactcagatatctcttgtggaaaaaaatacatcacaacaagtagaattacaaggttagattcaaaggtccttgaaatgcagtcaagtctgttctcacgcctctgtgcaggatagcaatcaagctgccccataatattgactgtcttcttgtaaatcacaagatatgtttcttaggctgaggcaaaaaggacaagtagagaaaccatagtttcatgggctctttacagctggaagtcagaaataccacgaaagttggaagtaatagtgacaggaaagggtacatgtaggactcacactaaggaacttggtagcatttcttataatacctattcaatcaacattgtcagtaacacggtcagggctacattggagtaagaattaatactattaaaagaaataataaatatgcaaataacctgaaaaatatccgtagtatttaccacctgaattcacacagtgaaatgaagcctttacacactttggagttcacattgcacaacttctgcatggtggtagtgatgagtgcatgaatgttctaacccaattcgttttctatgacctcttaattccctctaggaacttttgtgaaaaaaatgtcatgctcagtagagattgcttttgatgtaagtaatacttagtggtttggtaggtaaatattagctaatttttgagtgctaactatgtacctggcaccagactgagacttttacatagattattttatttaatgctgataatggccctctgaagtaggttttatcatttgtatttttatagataagaaagtaaaggcttagagaggccatgtaatttgtctgagggtatacatgaagtaagtggcagagctagtggtcagctaaacctaaaatccatgctcttaagagaactaggctaaactgcttacataatatattaactacattaaaattgataccagttcttttgtgcatagttggccgagttcatagagacttgccaagaactgttgaaacctttatctacagagataaggtagacagtagagaagaccaggagcacttggaccatatttcccagcagttactctcacctcgctcgtccagtcctttctctatcattacaacattgaacactagtaatacaactctgtggcagagttgatagcacatcagttatccccatttaccttctgtgtgatagcatttcatggtattatatgaaattatctaaaggatgatatgatttgatgttgctaaagtgaagaaaaccaccaaaggtagacttgttctcatttaagaaaaagcctccataggttaacttgaataatcttcagcttgtcttgtgggaccatgtcaaattaatttcagctgatgctgtataggaaggaacaacctttatcatcatcattatcataaattcataccagtcattattccattcatagtatatgccaggtgagttatgttcattattttaatcaatcttacgaaaaaaactctctaaaaacagggatttttatgctgacttcataaaagaggaaatagatactctgagagattgacagtcccatgatcatatagctaattagtgacagtcatatgatttaaatgagttatgcttgacttcaaacctgttttttctattactattattatttaactatgatcacaaaataatttaaacatacagtgttggtgcagaaatattacctactctcacttgcctgctgacaagataaacaaatgtcatttggcctactttgcctcaaatctactctcccctcttcttaatttttaaaaaatttttattttgaaataactataaattcacagaagattgcaaacaaatacacagaaaagtcctatacaacattccccagcctcctccagtattagcatataacataattatagtacaatatcaaaaccattggtaaaatctttagagctttcccagatttcaccagttaaacatgagcccctttgtgtttttctgtgtgttgttttatgtaattttatcatatgtgttgtctcatgtaaccaccgtgacagttaacatactccactatacagaagactgttctgtgctactcctttacagccatattcatctcctctctcttctccctaatccctggcaactaagttgtcctacatatctacaattattatttcacaagtactagataaaagaaattatatagtatgtaaccttttgaaattgacctttttaactcagcaacaatttccttcagatgtatccaagttgttgcatgcagttgtgtcggtttacccattgaaagacgtttgaataatttacaatttacaaaatttatttatttttctaggataaatgcccaagagtgcagttgttgagtcgtatgataagttcatatttagttttgaaaggcactgccaaactatttttctgagtttttgtaccatcttcctcttattaatttacactttcgagattatatgtgataaagtcattagagctttctcttccttgaaatttccatttatataatttgcccgtctttttctaatgagatttttggcctctttcttgctgatttgttagagttcttttttaaattattagcactaatcctcgttaaatataccacaaatgttgtcctgtctgtgacctgttagtttgtacgtggtgtattttttcatgcatacattttaaattttaatgtagcaatgtttatcagtcatttcctttatggtttgtggtttttgtgatcttacataataaattcctttgcatttttttccataggtaagcccctagggaccaaacagcctctttgctcttaattgatacacagtattaatacttctgctgatctaatttggaagcacctcataagttagaattacactggaaggcataagggaaattctacagacagatactctgatggcaacaaatgatgatttttcaggccatctcaattaattctactttcttccagttggtcatctacttttggtcatccttcagtgctcaaatattaactcctctgcgaagcctttcattacattcctcaagacttgttttgagctcctgctttatgtttaatcatcatcttgtgctaccctccttattgtacttctcacactgcagtgtagctgtatgtttactcacctgtgtcccccaaccaactgtagattgcatgagagaagagactgtgacttgtttaatagttgtatccctcagtgcagtgtctgatggatagtaagtgatcagtgaccctttatcaaatgtggggatgaaagagatgcattcaaaataagcagacctaagacctcacagagcaaagcagccttagtgtgcttagttcaaaggcaaattcccttatagtccatgggtccattcctcatgagagaagcaggactggccagagctctgtagtctgacctgcttagaacagtgaataagggtctgggggccacaggatgcagtgtgggggatttgtgctcaaggcagtgaagaccttggtaataaaaggggttgtttaatcatgacagagtgaaggaaaaccaaagtccaattcccagagtatgtacgaataacaaggctcagtgtcaaaagccaagagctgcattaaaataatactgaagcacaagaaaacaggaaatcctatttttttttttgtcttctgtttaaagaagcagagaattgtgtcaattgttttggaaaggttttagtccaaaatggttaaactatctgttggtatgattcgtctccccatcataggcacagacacatgttctttccaagggagatggatcagactctataaaattcctagtacctccttatgtcagatgaagtaataatggacattcctttcagattcatcataactcaggaagattgttctgatggtaagtgagggaaaatagaacctcctttcgagtcaattcctgctgcttctggactttgccattatgaagcaaaaagtctgtttttaattagagacctgaaagcctaattttatgccatggtaacctgtgggatctgaaatacacacccccagatgttgcctgtagcaaaatatgttcatagcaaaggcaacttaaaagtaaaaaaaggaaaaataaagcataactccaaggaagcagaagatataaagaacacactttgataatctttagtgaacttgaagcaattgtccaaaagtgagctatcatttagaatttattgtaaatgataggaaaataaaataccttgagtgggacttgctgctcaaaaagtaaagtgaagtgtgggtgtcttagttagctggggctactgtaacaaaataccacagactgagtggattaaagaataggcatttatctcccacatttctggaggctgaaagtccaaggtcagggtgccagaattgttgagttctggtgagggctgccttcttggttgcagatcgctaccttcttgctgtaccttcacatggtgaatagaggatagtctggtatctcttcctcttcttgtgagaacagtaattataggggcttttcctcacaaacccatttaaccttaattacctctcaaaggactcagctcctagtatcatcacattgcaggttagggcttcaacatatgaatttgggagggatacagacattcagtccataacagtgcaggaggcaaaaactaaacgtgcattttcctaagtgttaggccacttagtaattcaatataatgctgctctctttttctttatttctcattttttttgcataattaatagtattatatgaacccacttacatagttatagtcagggtcagctttaaaacaaaactttcacgtcttctactatcttgctgttccctctctttccctcttttcccttcactcgtgctccctccatccatttggttttgtttgggtaatttagggataatctgatttagtaaaaacagctttggtccagaagccgggacaccttgactgtgccactaactcactatgtgaacttgggcacatttctttttctttgtagaaatcagtgttctaatctgtaccaagagtaggttggataacttggtctctaaagtttcatttgcttctgctcatattggtctcactgaaatatgatcagtactcagttgaatattgatgtgatacctgaatagcatgtagaatgtgatcagtctcttaggcgaagcagctttttttagagaatttaatttgttataaagcagttaacttgctctgccagtttcatattaatatttcactgaatgatatctttgtcaacatcagaaatagataatgagtttataatcaatatgatgtcttgaaagctggcctttttctgattcattgctgtccctgtctgatggtggtctatcaaaatgcagaccctttctttgcatcataatcagacatacctgtaagctttcccacattaaatgaagactgtttcttctttgatctagtttaaacagatcagggattgcaaatgagctcatttcacttgtcaactccaatcaattgtggaaatataacaggagtccgtatttagaagtattgtgaaaagtgttttgggcactgtgcactaagaattgtcagagtgtcccatatgtcaggagtttgctatcctagacttggagagtgagattttcaagtcatctcctgctgtcttgcaatcgactcactgcgaattatggaacagatgttgctctgtgatcaacaggtctcccaaagctctggaggcacctttatgcaacaccagcaggaccaattgaaaaagaaattacccaaacattacagagctgcttgctgttcatatcttgcagcttctaatgacccaaaacaaagatgtatttatataatttatttgctatggaatgggtaagaattaaatgtgatcagtgaaggtactaggaccagaagaacttagagaagccaacagagttcaccatttaaatttacctaccatttgttcaataaatactataagccaggcatttttaaagacactttagttcacatctaatccttcaaaaattctgtgatggaaatggagaggtttaagtagttttccaaagttcatatctcaagaaatgagcatttttacatctctgaagagggggtataaaaattggtgacaatgatgaagagaagaccatggacccgtcagcctgaactcttgaagatttgggattactcatctgtagatcccatctgacaacagatgttgataagacacaaatacctgttgaagctttagtggatcaataaataacaccccttcattccccatttgagtcttgaaaaaatgagggaaagtgtgaggtagataaaggtgaaaatatcacctcaatttttggtaaagctgcttgtagaacatagattaggtcggtggccaagcaaacaagaatgcatgctccttcaagcaagcagttagcaagaatgagaaaggaactcaatcgaatatgtccaatttcttcttccaagtttattggatctgataatgaggataagtgtcttaagtcagcttcttcctaaagtaggccctgagacaggatctgagttccagtggtttctttgggaggtgatttccagagcaccagtaatggagtagggaaatgaaacagggaagaaaggaatttatttaagccaatataaagtatattaatgagcaactggagctcagtcatcctgggaaccctaggaattgtgcagaacatgcctctgagttgaaaaaactggagtagccattcactaactgctatcagtcatggctaagggctcctcctaggaatgtcaactccctggaaattactaactctctagcttactctatgcccaggctgatcaagcttctggggccagagaatgcactctggcaggcagaaattgcaaataattgccataaagaattgtccatgtgcacaggagcaggcagtgccaagtggttaccagtggagtatagatggtgatacatttgtcatgggacctgaaacaacccagtggattttctaagataaactaaaactaactaaactaaacttggagcagttttcctactacttccttttctctgcaaggaattctcagcagggcctttccaacataagcatgggaggtctttttgtacaaataaaaaagattatttttccttatttcttatatttttctgtttgtaaggcaaaaaaaaaaaaaaaaaagtccaacacaagcttcgaaactagtgaggtcttggctgtacaaaacctttggaaaccattggtggttttggaagctgccaatgtgctgtcaggcagattgaatctaaagaaaaacgcagagatgaatgtttcccatgccatgaataccccaaccctgctgtctggggaatctgagaaggaaggcagcatgaagggctagactttcactttttgcaaatggtttcagaaagagcaggctgagaccacaaagttggagtaacatacagtgtgggatagctgcaaaataatggtaggagaaggattcatgaaaatgggatggggccagaaggattgtaatggtatttgtgtgaaaggcaatggcagctcggggggcacaagtaggaggaaccatcccatctagtatcctgttgcctggatctcaatactttattggccatgagctacttgctgtccaggggagtggtaagaggtgaggataaggtgctctctcagtaggagccttgagcgtaggatctctgagaagactgatgattgatttgtaattagtgaatggattttgtcaaagtcttatgaaaattttccatgatgttttgcattttctttatttttaaggcccggaaggggaggaattatctcagtggtggccttgccctcattaatgaggcattagctcacctggttcaagcacagtacaaagaatactaacagaataacagtgagagccttccctgagggttggtctggatgtaatcctggggtggagacatgttgtttctattaagttatttcatcctggagtcttatctttgcaccagaaacccaaaacaaaaaattcttctaatcataaggattggaaaaaacagtcaagtcatattattatgttctaagattgatgttaaaatactccttgttcgccctgatagttttctttccttccttccttccttccttccttccttccttccttccttccttccttccttccttccttccttcctccatccctccttccctccctccctctctctctctttttcttctcttctcttctcttttcttttctttccccttcctgacttgtttattgctgtgattctgagtaatctaattcaccaagttttcacaagtctaacagtaacccaactacaattgggacttctaaatagtagatgtggccgggtgcggtggctcacgcctgtaatccagcactttgggaggccgaggcaggcagatcacaaggtcaggagtttgaggccggcctggccagtatggtgaaaccccgtctctactaaaaatacaaaaattagccaggtgtagtggcacacgcctgtagtcccagctactcgggaggctgaggcagaagaattgcttgaactcgggaggcggaggttgcagtgagccaagatcaacagagtgagactccatctcaaaaaaaaaaaaaaaaaaaaaaaaaagtagatgctttttctttccaggtgcaagagaagaaaatcataacaaggtccttcccttaaaagtaaaatgatgctgtctggttacaaatgggtttgagatgtagtgaaattttgtttacagtttattgctgtggaatgatatcttgggtttaaatgagctgtctttgctaggggtttgttttcttttcataccaggacaacacaagagtgaaaacctggctttgaggaaatgtcagggccaaacactgcgtgcaaatagaggaagggtcaggatgctctcttccagagacttgttcaggactctttaaaggggttcattttccctggatgcagactgaaaactatccacatcattccccaacccccactgccattttgaatggcaacttcatggcaaagcagaacagaatctgggagtgagagttcgaatcctacatctttgcagttacataaatccatgatgttaatcatagctgcccaacagaatctcttgggagcctactaaaatgcaaataactgggtagttttgccaagctattgattcagtgggttttgggtagggcttggaatctgtgttctttaatctgctcgttaggccacccaattttgatcaacttccatcaatcttttactctaagttgattaaatagtgatatatttatagaagtttctaactctaattcagtagcatttttctttatttcctttgtatggacaactggcttgttaatatgccttcagagcccaagtctctgaagtcagtgttctcttctcagcactgcctctgatttgaaggatgacctttaacatctcaatggttgagtctttccctgtttcctatgtggacctaaccactcttttttagcatgctgaatgccgacagaaaacgattgtgaaaagttcaaaatgtaaattgccatggaaacattatagcactggtaaaacatgtattctcagtagataaaggggaagacagattggggtgaatgaagctatccattcatcaaccttggattaatcaatctctgcttgtcatcttaaacagaaggattttaaaggaattatggatttcaggtcagaatttgtctggtttagtattttttatttcaactccaaacatttttataaaatgtgccatgctacttctgggatatataaaaataccagtctccaagatagtaggaaagctgtttgctcagagaccaagggtgttactcccttttacttcaaaccaggaagctggaaggagctattctgttacgatatgtattggacatttccatatgcatttaagtcaaggaattattcctgagtatcttctgagacagggtgttattctgggtgtttcggaacatatagatgtgaggaatatgcagtctccactttgacaagtttacagatggttgcaaagttttgggtaaaggtaaattattagctgcctgtgatacaagataaaatatttgccatggagattcagagcagtgaaggcccttgcatgttgggagaacgagcaaatacttccaagtgggaaattagatttgagatagactgtttttttttaacttttattttaatttcaggggtacatgtgcaggtttgttatataggtaaacttgtgttgtgggagtttgttgtacgtattatttcatcactcaggtattaagcctagtatccattaattatttttcctaatcttctccctgcctccccccaccactctctggtaggccccagtgtgtgttgcccccctctgtgtgtccatgtgtcctcatcgtttagctcccacttataagtgagaacatgtggtatttagttttctgttcctgcattagtttgctagggatgatggcctccagctccatccatgtccctgcaaaggacatgatgagatagactttgaaaaacacacaggatttgaccagacacaggcattctcactacagaaaaaagctggaacaatggcctggaggtgcgctcaggcaaagtatgtatgaaattgtcttcaaaatctactgcaagactttcagatttccctggaaatgagataattgctcctttattgacataagttggggttcattttactatttagtcacctgaggatatgttagttatcccagcatcccagcacctcctttgcttgaaaaaaatccttagtgctggggcctttgagctgtgggagtgaatgaataggcatgggaccaaattgtaggacactggtaagtatcctgcactgggatactgacatagaggccaataggtttaggaaagccaaacaacctgcttacctcacagtataaatgaaaaagcctgggctttggaaatcagatcagcctggatttcaatcctggttcttgctattaatgttttcctaggcacattatttaatcattaaatataatgtctgtcatgtagctgatacagttggtatattataaattttcaataaattaattacctgggtcctgtgtgtagagaccatgtttcaaggagggatggtagatgctcacctgggtttccatagagccaaagtatatttctcttgctgttttatagcatactctgtctccttcaaatctcagctttttgcttggctctagccaagattggaatgttcccttaaatatttctgatctagcagaaagaccagcctttcagaacttgcagtggcttcctttgttgacattagattcatttgggacttctttaagttgatgctgccatcttcctatgctttggcctctactttgaactttctaatcttgctggttttgccctatctgcttgggaatttgaccacaacagtaccaaggtaccaatgtcacctctaggctaaactaatgtcttcttgtaacttggtcttttcatatggcacatcttgccaatcttatgggttgctctttgtgatcaaaaatgaccaacctgatcatgacggagggtattgggcaccagtctggggccagtgtgagtatttcttgagcttgaggtggactccttaaccttgaagactcctaacatgatgtccttatgtcctttagccaaatgcaggaagacctgtggtacatagcttgatcttgtctctttatactctaaacaagctggtgggctagattaacttcttcaggccatcctgactctctggcttttctttgaactgtctctggggcttttgagcagcctctggactccatgatggaatgggaagtttgtgatataagagctatgatacactaacttaatttttttttgctcctgtgtttcccagactcattagattatggcacactcctgctcatgtgcatgccaattcacatatatacccaccaaatgcctgctaacatattcagataatgtttttctctcactttggaaaaatgtcctagtttaatcctcataaacatgctgtgaaatggatttattatctcccttttatggatgcagaaatggagtttaaagaacttacaggatttgtccaacatcacctaactgtaagttgcagagttgtacacactaattagtaatcccgctgctctttgaccacactcactgtgcctgcatgcattagccctgctattggcccttgtgataaaaatgtcatgctagcacaaagttgggaaacaatacccttccatagggtggccatgccaatcagaagccaatgttacctctcttaatcttaaagcatgaatgggctctacttcaggtctaattgaactgagaccataaaaccaaattgagaaggctccatgggtgtgtcatttagtctcacatccaggagctttccattgggtctgctgccacatttacctctctctgggttttgggacattctcacatggaaggagccgagatcgtggcataattaccacctgctccatttgggtactctgtcggcttctacatctaccctcaagtctcccactccgggtgagagcaatggtagaggcttttgtagtgctgatcattatctccatccccgggaaacaggaaaacagcacaatagcaaaatccttttggctataagatttcctgtccctaagtcacagaggaaaaccacataaagacaactagaagctcagtaacccccagcaaacctagctatgcacatttagcatgtctaagcagccttaggttcaaattctggtacattgctgtgtttctctgagcctcagtttcagcattcataaaatggggataataatacttgtttccatttcatagtgtgattcaaggagataattgatgtactatgttctgtgtatgtctgatggacactctaaggcagaatttgaaataaagacattgcttcagctgaaggcagatgttaggaatagtttgttgttaatcccaccctttggcaacaaagacatttcaacatccagtatcaggctgactgtgactcacaaatgaattcagaataatagcaatacctgtgagctctcagactggcagtcagaaccctgctgaaaggattagcgcccgcagcacatggcaactctggtaatggtgacttgaagaagtagtaatgtctcagctctttaaattgtgtgtttttttaactaatataatttttaaaaacttcattagcagcacagaatgttagaactgaaggatcttccttatccctgcctctccttttacagatgggaaaactaaggaccctcaaaagggactgtacctggcttcaaagtgacagaagtaatagatgacaaaaatgagattctaacttgatctcttgtataatgtcaatattctgattttacatgctcattagataaaattgaaaaaaaaaaaaaagaaaatgatggccaggcacggtggctcacgcctgtaatcccagcactttgggagccaaggtgggcggatcatgaggtcaggagatcgagaccatcctggctaacacggtgaaaccccgtttctactaaaaatacaaaaaaaaaaaaatttagccgggcgcagtggcgggtgcctgttgtcccagttactcgggaggctgaggcaggagaatggcatgaaccttggaggcagagcttgcagtgagccgagatagcgccactgcagtccaacctgggtgaaagaacgagtctccgtctcaaaaaaaaaaaaaaaaagaaaatgattaagaagaaaaagatcaccaataatcctactctacagacatatacatcattaacattttggtgtatttgatgcaccaaatagcaaatacctctctttctgtcttctctgtgtgttcattttctttcacctgttcagaaacattaaaactcaggtcttctgacttcacgctcagtgctttctcttagcatatcaggctgcctttctaatcagcattcttatttgatatttagtaaccaagagttaggttttaaattctcaaaaccaagtaaagctgccagtgaaaccccatgtgtatatggctcattaagaaaacaggtgtaataatgaaatcatgaataaatagatcaccaaaatggcctagatcagagagccaagcatgatgctagacagaggtgtctcaaaaagcacagccacatccctgccctcaaggagcatgctcagtggcatgacctctatctgaaacaagggctgtctgcctgtgctcatcccagctcagaaatgaagcagaaaatgaaaaggccacatgggatgcttcctacagtcctgttaatgtcaggagtgcaatgcctaggccctaggcattttgactcagcttcagttctctctcccaaggctgaattactagaactccagctgcagcctgaactttaactccctgttctcttcccaacccacaatcttgttatcagtctgattctgatctgttagggagaggggagggggagctagcagagatgtgactaagggcaattgagataggtcagaatggccttgcagtatattctgtcttagtgaaggttttgctaaaccattgctgcactggggagagagtaggagaacccctgcctccttgtccgcattcccttagttaagctgagctaagatgatccctccaagcttttcctaacagggaatctacattctctgtgtcttgctggctggccacaattccttggggaggcaggagctaactctaccgtcctagccaacttgaataataggaaataaatgggatggagagccaggcagcctctttgttacacagcacgttagtgaagcagctatctatttttagaagagggggaaaaagtagtagcttactcttttgggatcagcaggtggaataatgatctgccaaattttaacattcaagattttttagctgggctacaaatgagacagacttttgtgcctgcctcagtgcaatgctgtcagtgtaatcgcacatccctgggcaactaaaacatgaacgctggggaaaggagatataggactccatgtcacagaactgaaggctgagggtgcatgctataccaatagcctgattgatttaattagaaaaaaaataggtggcctagtcaccaggagtattgaaacctcagatctctgctcaaatgttacactcagtgaggttttccttggcattctattaaaagtaacgcttgccgatgacgcttcttttagcctgcattattgttctttcctgtacgtatcgctacctgacattgctttttatctgtttattaatttttctattttctgtctcagccactggaatgtagggctcaaaaagacagaggcttgcctttgttcactgctatgtccccacggcctagaactatgcccagcacatgataggtgctcaggaaatatatgttgaatgaattaatgaatgaacatgtgaatgaataaacttagtatccaatagacaatgagtatgccaataaaaatgacaagagcaattaataattattgcatgctgcacattaactcacttaatcctcacagtaactctgcatggtacatactgtccttattttcattttacatttaaggaaaattagacttgggggttaagtgacttgcctccgtggcctttgggtcacagcatgaataaataatacagccagggtttgatcatcagcctggggacaatgattccagacatatcagactgagcattcacttaatagtattttgcattggttttttggaatttccttccatgattcttacctggccctgtaaaactctttcgataaaatgaccatatgagatggatgtttcatttccatctgcttaacctatagcatccatggacttgtcattataaactccaaccagaagagcaggatatgcctcattgttctgtgacaaaaagaacccattgaacattttttggcttagctgtggttcattggtgaagctagatcagatagagaatggtggtttcttccttaaaggtttaagaataaggattaatggctattctgacatgctctaatgtggactttctcccactggatccacgacctaaacaaccacgtttcccaacttaaagtgttttgcaaagccagagcatgtcagggcttcctggtcatgtttttagtcactttcattcacaaaagtgaaatttgtttgtactcccttctccccaaataaaatgcaacaaaaatacatcagaccacaaaatcacacctagtaaaagctgcccactgagctctctagggcagtgcatattcatttatacgtgcatccaaaagttgtcaaggtccccttagagtcttattgccttctggggtctcccatgcactgtcaaccacgtggcttagggagtatatggagtctcatttttatcctgagcatagtttatccacatggcaatatctggtatattccattgtcagagtagtcacattatcttgtgcttataaaaattaaagtctctattatgtgtttgtattataattacctaattaaatagttttattattccttttagaggagacctacatttgagtgagaggctctgttttcatgcaaaattcaaggggtcactgctctgttttcaaagaacaggcaagctctaggaccgtctactccatgggttctgtgctcagtaaggtccctgtcccaagaatcccagattttaggggaattctacgccactcaacccaatctggacatagagtccatctcagtgtacagaccactgccagatttcttaagtcattcttctttctttccgtcaggtttggtcataattgtacttacgtttactgtgagttaactgagatttcaaaatccttttcaatatttcatattgatttgcaggtaacgactaaatctctaatagaaagagtcctgacacttagattcctgtcacattagagaaaaatctattttttaccaagtttcactttcaacatattctactagttcaagtcataaattgtcaaggaagaaaaaaggcccatgtgatttgttctcttggagcgcgcatgtcccttttcccaactaactcagaggttctcatcctggctgcatatgaaactcatttgagagggcttctaaaaattaccagtgtccagcctccaggttctaccacaggccaagcaacttagaatgtctcagggtaaggcctaggaggatttaaatgtgcacccaagagtgagaaccactgaattacagaatttctaatgctgtccaccaccagagtttatttgtgcagccagtgcaagttgagcaccacttatctagaatggaagtgtcttaagggaaggccctatattttatctgttttcccagtgcctagcaaagggcttggaccctggtaggtgctcagcctcatatgtggaagataacagctattcgaagcaattcaatttgtgtcaaacaccttatgtcattgccagaaacatcaacacagttccaactacatttcatttaaaagatactgcccccctcgcccaccccacacaaccacgatacacacacaaattctaaatgtcatcctgggagttgcaaagtgcttctttgaaatcttatttgtgctgcttctgtgtatccatacttaaagtatcttgacacgagccactgtctttttgtgcttgaaattgtctttaacatattttactttgacattagtatttactaggtttttgttcatatatctcttttctaaagctctgggagaaagagaggcagaacaatcatatctgccaaatggaaagaagactttaaaatatatatatagctagaaactttcacctagagaatcaatctctatccatttatacatagtcaatcataactgccactgtggccttcctttgtttccccttcctacctaccatgcatatacacctgctcacagaagcattgttgggccagtatttgagacttgaggtgcccagaattgtatcattctgctattgagcagcatagaatactctattttgggggagaaagaatatgtgaaataaacagagcaaatatgcaaggtaatttagtttaaaataaatgctacagtagtcataagaggcaagaattttctcaagttttaatagagggagcagataccttgactctactataatagaactaagatgggcatagaggcctgggaaggcatcttggataagtggaaagcaagatcatgggtgtggagctagaaatgaggtggatatttgggaaaagtttgtctcaaatataatggtagttgtgtccgtttaatctacttgttggggtttggagacttcttatttggaaggagcagtgatcatgatgcagcctaaggtccacttgaaccactcctttctgttttgagaaacaaagataccaaccaccagtgaaaataagatgctttgaatactcaagagaaactcattctcagcctgacctgcaatgtggtagagatgcttggggagagtgctgggttatgccctgttaaacagttgtagacatctcgacgccataagaaatcattttcctggaccagattgattgctttcagctgatagagtatagttttattggttcctactcattttgccattttatatttttatagacttgtcagttttcttgtcttcctttctacaataacatttatccagtagtatatcaaccttaaaatttgattgttggcatattcagtaatgggaatttagaaatccactttttattgatgtcctagaagtttgtatgcaaggaagaatcattaagcttgtcctttgatgatggacaaaatctagtaattagtatttttttttcatttttaattgtcaactggcttttaaactttagatctttttttctccttgttcttttcactatgctctaaaacaatagctaatctcagcttctatgaaattgatctttatttaaaactaagaatgtttagtcaaatgtggtaatgggttccttaaaggcacttatacatgattttgtggttttacttaggcatttaggtgatgctgcatataatttgtattaaagagaggccattagcaaacatatatagacttccttcatagatttcaaaaaaccattacccaaataaatgtatttttggtatttaaatattcctaccaagagttttctttgcagagttttaatcaatatgattttgtattcctcctcttttatcctttctacttgttgttatcacagtgatagaaaaaaaatgaggaagtaaaactccaatttagattttgttcctacccccaaaatagctaaaaagttgatggagagaatgttaaaattattagttaaaatgagactgtgagagtatctgtggaaaggaaaacgttaaggggtgatcaaactgttagaaaaggagggatggtttccttcagagaacaagaagatcatatgagaacaagattgaattactcaaataagtgaaatataccctcactttgttttcaagcttataggccacattaagaacatttctgtattatacaaaatgggtgcaacatttatcccttgctataaccatcaaaataacctgtgttgagtgctttgctctagcagtctaacagaaatatctgacatccttaaatctgcaactcaacaggctaaaagaccggaaaatagatttctgcattaccagtcaaacactcagaaccataatcaaactttccctttctgttattttactggtttttcttaaaatgtcaggaagtatgattagcttcacaaatcttaaactattcagtttctctactctcctcccaatacttgtaaggaacttagagtgttttaactttgatctcccaattactacataccaaattattgtctgtcagtatttagttctaccttacttccacaattcctccattagccattatttcttttaatatttacagttagtgtttatttaaattcactagcaacttctttgcttgccgtttttttcttacatcctactccatgccttttgtttaaactacagtgtatccttttagtgaagtttttataagcaatgaactctctcagttttatttttttctgagattgaaatttcactttcactggtttaatgatgggttagctggatggagatatctcagtccccaccaacaacctcagtactttaaaaatactactccatttggtgctgatgagaagtctattaatacaagtttgccagggggataaatcatggaagagagaaaggaaacactttatatccaaaggctcagagattcaagagagtctaggtgcctggggacgaccatatcaatagctcctgtcaagtggaatgctataaacatcaaaggaataggtaatcctctgccctggcctcttgcacaggcacttgtgccctcaacacactgagctccccactttcccatgcaagtttcctgatgattacaaagagatgcaggacctatgggcttagggtctgtgacagaactaccaggcttgggtaaagttccagcaaacagccccaccgtgcgcttcatcatttcataaatgcgtatcagtccagatgctaaattctgaaactggagaggaaagaggaataaccaacttaaaaaaacaaaagcagttctagcatgccttttagcacatacttactgattatgtgccagaaaatatgctgaggatacagcagtgcacagaccacatccctattcatgtgtatcttatgtgccaaagtgaggagacagaataaatgtggaagccaatatacacctaatgtctaaaagtcatcaatgttctaaagaaacacagcaaggtgagtggacagggaataattggagagcacttctttacttaaggtggggtcgagttggtattaagaatgagacccaaatgataagaaggggctagcctcatcaaggaaagaggttaatgagtgatccaggccaagggcagaggaattgcaaagcctctatggcagggacatgttgattatgttcaaagggcagaaaaaaagcagtgaactaggggaagagtcagaggagataaggccagggaagtggccaggggtaatgtcatataaagccttgtaggccatgccaaggggtttgggttttcttctgcatgacatgggaagccattggacagttttaagtgagaggcaacacaatcagatttcagtttttaaaggcttgctctgatgattatatgaataattgagtagaaggggctgaaaatgcagaaggggagatatattgggaagctattagaatctagcagaggagtagtggcatcttggactagggttgtggctgtgaggatgatgagagtgatcagatttgggacctgtttttgacatagagctcatgggaactgctggtggattggaattgagggtgtgtgggaaggagagatacccagattctctactgtgttcctggatagtaccttttattgagatggagaagattaagagaaggaacagaggtggaaggatgagtataaagagttgcagttttgagggatggagggatgagaatggagatactgtgtaagaatggtttgttgaggagtttggacatgatcctgtctggatccctgagttagtggagttttagacattagtaagtgacatggtcagcttatggtatgtaaatgcagctgagagtccagtgggagcctcaaaatattgactggtgctcttgaatcacattacattttcaattagtaaaaagaacctgactgacttaccaggcctggtaggacatctcatcatttttagctttaattctccttccttttctcttctcccattttttttatctccaaaaccgagctcctttcatgagaataaacccagggcatatgcacatatactcacacgcatagacacttacatattcatatacgtacataactgtgctatttctaattttctgaccaaaaatgagtgacctcacttagggaggtggactagctagttgtctgcttcatgcttctaattgcaggcaatttcttgagggcggtgggaactagttatccatttattaattaccttaagaaaagctaaaaatattctttttggggtaaatacactgcatagaaggttcttttttggagaaatccaagatggagggcatcctgagctggtatcattcagttcattcttgtcttggcccatcatgtacatagttttgaaacttctttctctaattctggcagcttcctggtttgagatccagaaagcttttctgggtatgtgtatcgtggaccaagtagcctcagtttctcatgaaatcttgcaagcatttcaagaatgtcaactttggcaagcattctccccaagaaatggagagaattgtgccgatatggctggctttttgtgctaaggaaagggatgataaagtgaccttacccagcacctggaaggatgccccatgggatatgagtgcagggtatagtctggacagggtgctatgctgcacatgacagggggattgtaattggcttaacaaccatgacattgaaatttgtatttaaatacaagcttccatttccccatgtttctcctactcatgcatatcaaccttagcctatagccagtaactgttgagtttctacatgttcttataacccaacccccccaaaaaacacaagctttttttctcatctgagtctttccaatatgcaagccaaagcagcaactgacttagccttgaataaaagactaaataaaagctagagaacctgagaaaacatgagagacacagcattgaatctggtttctaattccatggacttgacggctggaatcgtgatggagcagggaggggaggccagtcccaccagtgtgaaagtaaacaccagaaagatttttcctcagtaaaaggagatgttccaagcattttagtgtgacaacctccttctgagcctttgataggggcatagaagagagaataagagagaagagaagggaggcaacaataaatcaccaaagagcttttgtcaattatttctccctcaaactgccaattgcacaggaaaggcagatgacgcaaattctctcctttccatctataaaattgctctaatattttatgaagatgttaaaagaaatgattctcttttttatcctctccctctcacgaatctcccccttcccaacaaacttggggcatttaatcacctctcaatattatttaaaccttctatgaaaaaaaatctatgaatgcttcaaaatagtaaaaggacacagaggggaaaaaagggagtctggacacattgactgaaggtgaaataattctttgtgtttctttttcaaagaactgggacataaagtgggtgctgggcctttcatggtccttgcacttacatgtttgcctcagtgagtgagtagaaggaaatgagacaaaagcatccattgaatccacatataccaagcgtctacttagcacgtggtaaattgcctggcctggcccccactagatgttcaagaaatatttatgaaccaactacttttagctttgaccctgtactagtcactgatgacgcataagtaaataatataggtagtgcttgcactcaaacaactcatacattttaggtagttaaagggtgtgcaatggaatgctgttcataccccctccctttctcctgcttgtttgcagctctactaggaagtcataatttgtattgttgttgttaatgtcagaggatgcatttttaaatagaagagcaaatatgcctcttgtagcgggagaaagatcccatggcatttatttaggcaagtgggatttaacttcagaggcagctgatgttctgtctaagctttgtacatgtggtgtgatttgtcagcagtgctactgaaagcctgagagggtgttccctgatccatgaggtgtttgtgagagtcctatgaatatttgacctcatcaagataaaacaaaggtatgggcttttgggttcctttatcacagagataataattctgattcagatctgaatctggaccagtgcccaggctgtgaagtgcattcttatgacaaattgccatggctgatcatgcaagccctagatgtggtgtgagggctgagactcatcaacctcatagtagtttggtggtgtgaactctttggttctgtgcctgctgtgctcagcttaatcagcaagtgtgcccagcctcagacggacccttaaagtcttccagatccaacacgatggaaatagtgctggcccagcagacagagatatgacaagtgtgtagcatctgctgtggctggctctgcttccctgatgcttcactggtaggtttttcttctagattctcaacaactctacctgatgtcatgtggccttagaacttgctcacataattgttcatagcagttagtgatcaacagaatgtgaaccattccaagactgagatccatattcacttagccaagcaaggctgaatagagtcccaggcccttccaatatgcaagccaaaggagcaacagacttagccttgaataaagaaaaaaaaaactgaaaataagctgggcgtggtggctcacctctgtaatcccagcactttcgtaggccaaagcgggcagatcacttgagcccaggaattggagaccagcctgggcaacatggcgaaaccccatctctacaaaaaatacaaaaattagctgggcatggtagtgtgcacctgtagtcccagctactctggaggctgaggtggaagaatgtcttgagcctgggaggcggaggttgcagtgagccaagatcataccactgcaccccagcctaggtgacagagccagaccctgtctcaaggtgcattttctgtcttgcctctgaagtggccccaacatgtacatgctacacgtcccgtgttcccacccccggaactttagactggatccaggatttaggtgctcaccgtcatctgccatcatctacgtgatctcattacttttctgtcaaatatgccatagctactgcagtggtgtcctgagggataggtagggcacattcagacagagtggcacaggtaaggttgagggaggcattccaggaaggaggaatggcatgtaaaagtgtcagatgtcgaagggcaattattttcccatttaacaaacaaggacactgatgtttagagaagttagacatcctgcttaagttaacatagctaaaagcacagccaagattcaagctcaagtctgcctaactccaaagcctgtttatttgtacatatgctgtcttatgaaggatagggtgaggagtttggatatatcttataagaagtcgggagccattgaatggttagagaggagacttagatgatgaaatcaatgttttatgaagattaatttggcggccatgtgcaggatggattaggaaagtgagaggctagaatagagactggttggtgaaagaaaagtataggtgaaaatgatttatgactcattattgtgtactgagctattgatatttaattcccctatcatagtatttatctcaagtatattttttaacttttattttaaattgacaagtagtattggtacatatttatggggtacaatgtgacgttttgagatataaataaaaatatatatacacacacacacaaattgtggaatgattaatcaagctaattaacatatccatcatctcatatacttaccatttttatagtgagaatatttgaaatttactattagcaattgtgaaaagtacactacattattattatagtcagcatgctgtgcaataaatctcacaaatgtattcctcctaattgaaatgctgtaccctttaatctttgtaccctttgagcccaggagttcaagaccttcttccatccccaacctctgataattcttctctctatttctatgagttcaacattttaaaatttcacatgtatgtgatatcatgcagtatttgaccttgtgtgcctggcttatttcacttagcctaagtttttcaggttcatgaatgttgtagcatgtgataaaatttccttatattttgtggctgaatagtattccactgtgtatatatgtcacattttcttcatctattcatccattgatggacattcattgactccttatcttgcctattgtgaataaaactgcaatgaacttgggactgaagatatcttttcaacatactaattttatttcctttggatatatacccgtgtgaaattgctggatcatatggtagtactatttttagtttctcaggtacctccatactatttttcattatggctgtaccaatgtacattcccactaacactgtacaaatctcttatctatgtgataatgaccatcctaacagatgtgaggtgattacctcattatggttttgatttgttgaataccttttcatatacttattggccaattttatgtctcctttgggaaaatgtctatttgaatcctttgcccattttttaattagatgatttggggtttccttttttgtttgtatgaattccctatacattttagatattaacccatcagataaaagtgtcctcacccttcctcccaacacacacatacatggtaactgtggatggtgatggatgtgctgatttgattggtgtaataattacaccatgtatacatatatcacatcatcaagttgtacaccttgaatatatcctgtttcatttgtcaagtatacatcaataaagctggaaaaaataggttgtcaagtaagggagcccaagaaaagtatcaggtatatttacagagccaaatcaggtgtttcacattcccagtatggatgtgtagcatgtttatactctgggttacatttattgatttgcgtatgttgaacctgccttgtatccgagggaagaagcccactcgatcatggtggataagcatttgatgtgctgctggattcggtttgccagtattttattgaggatttttgcatcagtgttcatcagggatattggtctaaaattctctttttttgttgtgtctctgccaggctttggtatcaggatgttgctggcctcataaaatgagttagggaggattccctctttttctattgattggaatagtttcagaaggaatggtaccagctcctccttgtacctctggtagaattcggctgtgaatccatctggtcctggacttttttttttggttggtaggctattaattattgcttcagtttcagaacctgttattggtctattcagggattcaacttcttcctggtttagtcttgggatggtgtatgtgtccaggaatttatccatttcttctggattttctagtttatttgcatagagttgtttatagtattctctgatcatagtttgtatttctgtgggattggtggttatatcccctttatcattttttattgcatctattggatttttctctcttttcttctttattagtcttgctagcggtctatcaattttgttgatcttttcaaaaaaccagctccttgattcattgattttttttgaagggttttttgtgtctctatctccttcagttctgctctgatcttagttatttcttgccttctgctagcttttgaatgtgtttgctcttgcttctctagttctttccattgtgatggaaagagaagatactacaggtcctttagtctttcctccgaatcccccgagacccggggcattttgaaatagagaacacttttgtgtattagaatggtaaaaaagttggattaataaagacagtaagtttcctcctggcagttcagataaaattttgctgcccaataagtccattcggctcatataataccacagaaatatgtcttttctatgtagaactttttggagtttggaattactaataacctcgtaaggtatggtagacctgtattataccaataataatgaatgtaaacatcatgaatagaaaaatatgagctctctgcttggctcattcagatcatgactctgattagtgcattgaggagcattttgtggacaggctggagtcagcattacaattgtgagtctgtttacccataatagctcctatttttgagcaatatgtgggtgtctatgctgggcactatacaaggtggctcaccttacaggttgcacaagtaattcagacttatttcacgttatccacctagtgaagtgttaccaatataggcttcaggtgaagcttttctctaatacctgtttttttttccttacccttaagtgattgatgacatgaaatcattctcggacaaaaagctcaactccttgcaggaggcagcatagcagggtgaaggaagcatctgagtggtcatacctgacttgtcatttattaggtgactcttgggcaagtcatttcatctctctaggcatcagcttccctatctttaaaatgggggtggtaatcccttccgagcccacctgacaagagagctgtgaggattttgatagataataaataaacgtgagggcaccttgtaatctccgaggcaccacttcaacataaggtggaaaaattataagcgcaaggacaagcctcgtgtatcaatttgctatgaggcaaatggccaaaatggagtgagaaggatatctcaaaaagcaaaggatctgggtgtgggtacagggtgaagggaagatagatgtcaccagggaaagccagtcactcataccatctgaccttttcagccttctcagttacctccgaggtccttctcatatccctgggagtctcttaattgtcccctttctcttctaatccctgtgcttcaaatgttgcatggattttttgagctgcctcggtagctaccttttgtagtctgctttgtagcttcttacaacatcaccttcatcttcctctctctccctccctccctccctttctgcccacccccctttgcttcctccccacttgtatctatgtattcctgggtcttggtgggtagtcactaaatattggatgggtgcattcttagggcactttaaaccttagaggagacaaacattcatgtagctaagtatgtctaccacccatatatgctccccttgaattctcaactaggttctctagaacccactatatatgagcccccatctcctcttcctggcattcgagggctcatctaaatcagccaaacttataactagaggctccccactaagcaccagctattcttggcagcctgatccctggtcactcctttggaggcttctactcattcccactcccagacctctatattagctcaagttgtttccccatctgaaacactctgcctcctctgcttcacttattgttaagaatcctttagcccttacctcctgcaaaaaaccttcattgacacagtttatacagatcttgtctgtatattacttgtctctgctgaccttctgtagcactttaccctctgtaccactaattccctacttaatctttctctgcttcttgtgatatacatatatgtattgctagtatgaattgtttgctttgtgtcagacactgtacttaatattttacatcaataacacaacttaatccctaccattcagtgttatccatttgcccattttataaggttcagaggggttgagtaactttcccaaggacacatggtttgtaggtggtgaaactgaggtttaaactcagttattgtatgaattcagcactgtataactaccacatatttgggtaataatctctgccctaaaagtgcttgcactctagatgggaagataagacttggacatcaactcttatttccctgttatagactgtattagtcagggttctcttagagggacagaactagtaggagataatacacacacacacacacacacacacacacacatatgtatatatagagagagagacagagattggagtttaagtattaacttacacgatcacaagatctcacaataggccatctgcaagctggggagcaaggagagtcagtccgagtcccaaaactgaagaacttcgagttagatgtttgggggcaggaagcatccagcacggaagaaagagggaagctaggcctgtctctccttttcatgtttttctgcctgctttatattcgctggcagctgattagattgtgcataccagattaagggtggaactgccttccccagcccactgacttaaatgttaatctcttttggcaacaccctcacagacacacccaggatcaatactttgtatccttcaattcaatcaagttgacacgcagaattaaccatcacatggactgaatgtgtttctgacaaattcatacatttcatgcattgaggtcctaacctctaacgtgaaggtgttaggaggtggggcctttgggaggtaattaggcttagatgagttcatgaggggtgagccccagtgatgggattagtgttcttataagaagagaaaccagagcttcctctcttcacaacatgaggatacagaaataaggtggccatctgaaccaggaagtgagccctcaccagaagccgaacatgctgacaccctgactttggatattcagcctccagaactgtgaggaacaatttttttttctgttttttgagtcggagtcccactctgttgcccaggctggaatgcagtggcgcaatctcggctcactgcaagctccgcctcccgagttcacggcattctcctgcctcagcctccggagtagctggaactacaggtgcccgacaccacaaatttttttgtatttttagtagagacggggtttcaccgtgttagccaggatggtctcgatctcctgacctcgtgatctgctcacctcagcctcccaaagtgctgggattacaggcgtgagccaccgctcccggccacaaatgtttttttaagccactcagtctatggtattttattatagcagctccagctaagacatgcctctccattttgtatcaagttgcacacattaacagaaatgacaacagcaataataccaatcacagaaacatacatccattgaaggatctccccttaggaccttagaatggacctaggaacttgttttatgctcagtatttgtgagttgatcccaaagcccaattgattggttaataagtgaggggctgctgaaccttagtaaaggctagcatagtgtatcttagtttggcacatggtaagggtactgaaagcattcctgaaatggtgtatttcaacaccagactgagtgagtaagcaaaaagaatgctaaaacttcttcaagtggcttaagctctctgtactttaattatcagtaaaataagaataataatagtaccttcctcacaaggttattatggggaataagtgaattaatgtatgtacaatactcaatacctggcaaagagaaagacctatttttttttgtcattggtatcattgctgttgccattgctgttaatgtgtgcaacttggtacaaaatggagagggctagtgttaataatgacaccaatgattcatatatctcaaggaaagagaagcactatcactatcttatatgtaactcggcactgtacttgccacataacaggtactacaaaaatatttgtagaatgaaaaagtcatggaatgatgtcaaaccctcacagtgctcaagtatctacatagaaaaagttcaggccgggcgtggtggctcacacctgtaatcctagcactttgggaggctgaggcaggtggatcacctgaggtcaggagtttgagaccagcctcaccaacatggtgaaaccatatctctaccaaaaatacaaaaattagctgggtgtggtggcaggtgcctgtaatcccagctacttgggaggccgaggcaggagaatcgcttgaacccgggaggtggaggttgcagtgagccaagactgtaccactgaactccagcctgggcgatagagtaagactgcatctcaaaaaaaaaaaaaagttcaaaagggagaggttgggtaacatattcctctcatgttaaaatgaatgggtttccaatatacactaacatctagcctctctctccattctgagctccgaaagcccgatttctggctcagtagtgcttattgcttccttttcatggcagacttttctctgttctagccttgatatacagttctaaacaaggatgccaccgtaataactctttgctctggcatatgaatgagaatgatttttcatggagctctctccatgcctgctgcttagagttatttgtcatttcttttatgggccatttcaagagagccaggctatgggatgggttgtgaaagccacctgtgttgtcttctctaagacaccagggagatttgatgggttttcattttctaagattctaaggagatgtttttatcttggacagactgcctgttgttacccttggggtttgccatggtgacaccaaatcaaaggatttttatttgcttgaaaggaaaaacaatcaaatattcttgctgggaggtctttttagtacatctggtccaaattcccatctaagggtggggaccatgtttgccttatttccttttgtatctctagtgcacatcactgtgcttggcatagagttgttatgcaacagacatgtgttgattacataaatattttgcagagggaagaaatgctttgtgttactagcctatttggatttggccattctcttctgtagttcagcaaagaaggccttttctctccccctacaccccaaccctggattatcctgctctcttctgcaccaacagacatactttgtatccaccattagagcactcacgatactgtgatatttgttttcgcctgtctttctgttcccactcctattcctggggctctgtgtctgacagtgctgagcacatggacatggttggtgctcaaaaaatattagttgaatgaatgattctaatgcccatggaagacagcaaaaataattacagtgtcatgcatcatatttatattgcactaaggacttcttgtggacaaagatatcagaagaatgatggcattcatgagattgctgctaacagaatggttgacgatagagtttcttcatttggaacgtaggcatgataatactgaattgcaggaaggttgtagagattcagcaggaagatcttttaaagggtgctgctgactcatgacttttatggtagcaggtggaatttttttttttttctttttcttggtcctatgagcaggtagaaggaagaagaaggaaaaatggcagtaacttgggaagcaagcaaagacaacacctcttctctctcctcacctccatcccctccccgccacccttgataagccaaaaggagtgctaaatgtcagctgccaaccttagggagcctgagaatcaccatcacagataaagacctggtgagcatgggtcttagaagacccaacagtagagcactaagccaggttccatgctaagctatagatataggtggctgggggctcaaatcctagaagtagaagagatagtgagagtccaaagacaagaaagttagtctcttgggatcataatgaaacagatgggtgctcacaaagactgaggtggagttctggccttctcaatttcagtatctgagaatattttatagtgcatttttcctgataaataataggacttgcaaagtgatattcccaagagcattggaatggaatgatacaactcaatggcgtattattattgatgtaggttagcaaatggccaaggttaacaaatgtagattagcaaatggccaaggcacaaaaaatagagtggtgagcaaggtagacatgggccctgccctgacagtctttatagtctagtaggaagaatgaaacaaccatacaaatgtaacataattcaagttccatgaaggagatatgggaaaaactataacggcaggagaagctctgaggagagaaagggccttttgagctgagaactgatggatgaataggtattaaactagaagggagaagaaggaggagagaaatcatgagagacattctattaggcagaggaagccaacataaaaaggcagtcacatttaagtgggataaatgctagggaaggaaaagagaggttactacaggagccactgctcagtctttaaataaccttgacagggaggcagggtaactatcatcatccccttgaatgcataagttgggactcagacatattgatttatttaatttatttaatgagtcattgtcaagcccctactagtttcaaatcattgtgctggggctggatgaacacatttatatattgtctctcccctctaggagctttcattctagtggggaagtagcgggagtttatctgtgtcacaatgctggtaagtggtagggccaaaacttgaagtcttttgacttcaagtccagtgctcttttcatggtgtcacattgcagctcaacaaggaagaggcctggttagttacatccatgatgacttggccggatgaggtagcttagcttttgttctaatagctgataaggatttccatagtgctaacttagcacggtgggaacttgattctattaaagtaaaattgaaacaaaaacagaatttgggtatagctcatctgtgtgacaatcatagctagcccttctggagtttgctgtgagctagacattgtacacatttcatatatttatttaatcctaataacaatcctataagtgaggtaaatacttgtactgatttgcccactttccgaatgagaatgctgagactcagggagataattatgcagcattattaagcttgctcagttagtaatttagggttataggatgcaaactcattcaatctgatgccacaacccatgatcttaaccaccatgcaacattggatctacttgccagactagaacaaagtagatgacactatcccagagacaaaggagcagtctgggataaaggccaaagtttgctcttcctggcaggactcccagtcatagttgtttaacaggtacaaaagcacaggactggacttaaaagtgactattgaatccaggtttcctaccatcgtatccatagtactttgtggtcataatttacaaggactttatatctgcctagtgtggtggagtttttttttccaagtaattaaaactatgaaacacaacgcttatacttgctgaattttagaggcctactgagaggccagatttacctcaaaccatgtgtattattgtttacagagtactttcacatccatgatctcatgagatgctcacaacaaccctgaggagggttattcacattttatagctgagaaaacaaagctgagaaagcccaaggtcatgaaactactaaggttttggagccattgctgtgcacctttactatgggaaatgggtgaaatctaccagagcttgcaattctgtttttgtgtcccaattgaaatgaatcagttagtaaaacatttggcttttcaaaatactaggatttctttttcattccagattcaaaagactgactccgtaagtattgactttgttcataaaacactgtattataaataggaatacaaaagtagcatgcattattttctaggtttcaaaataaatagtacataatggatgtctttagttaataaaagctacttggatttctgttcagatgcagctcattggggtgggggtaggggctttggtcttttttagaatgtagaacgcaccttcattccatttgaatgtcatttttgcacttcgtaagtgaaagtacattctttcttatagtgccttgtccctcatgaccggcagaattggtagctttaagtattttcattctcaaaacaaacatgactcataacccatgtggatgcaatgactgtacttgatttggtgaacatttgaaaatacgaagtgggaataaacaataccattaccgtagttatttttttaaagggaaacgaatgcactggaagtggtgtagatgaagtacagggaaatatatgaacattggaattatattccagttagctcaagcttagggtagaagaaattaaaattaaggaaatatttattcatctatttaacacatatttaatgaacaaggcattgctctagacactggagatacattggtgaagaataataataaagatgaaaattcatgccctgttggagttaacattcaagaggggccgtaatgggtggtagtattggcggggggggttagagaagccctcatggagaagatgacatctgaataatgaactaaaggagttaagggaggatgtaacgcagatacatgctcacagagagctccaagcagagaccttgcaatgatgatatactccaatgtggctgaagtagagtgagcaagacagagaataatgggagatgaagtcaaagaagtggccaggagttggctgacccatggaaagaagtttacaaagtaactggtgatattcaactgtgtagtggacactgttgatcccctttaccaggcagaggtacctatcccttagctacttggagcgttgtttgctaaagcttatagtcacccccttctctatagcagaagcactgggggcagcccacagccaatgactggctcaaccccttggcctcaaggtgagaccaatcctatggttccattcatggtcctgagcttctcctggggtcagttagagctagactccaggtgagaccacagccttgcttttttagttccttcatttccccttccttcttaatcccattctaccccaaataatccatctcaggatctgcttctacctaaggaacctgacctaaaacaacaaactttcaacaacataattttagaagctaatatgctgtatttttctctgcaagtgtcaactttgagttatattttattaaactaggcaccctgatggtaaggcagatcattcttgccagtctaaaggagctaggaaagatatttttgaactagatggctaatggtgccattttcgacatctgtgaatgtctttctaattctgtcactcagtaaaggggagcattttaactagggtctcaatggcatggtgttgcagcgattgattcatttttacattgataagtgaatccacaggaaggtcccattagatgcctccttttagttatttgaaatcctagtcaataaatatcgacttccttcctgtcctcttgcaattgtgtgtgtgaatgtagtatttgtccttttctgagataccctagtgctttatgtcactttgtctttacgtcatttaattgatgatatttctcaataatagccaaccaggagccaagacaataaaaagatattccttgtatcaactttaagaaggggaaataagctgtggctggaaaatctgaactaatctcaataataccaagtaacaaatttgacttttctccacttctcactagtttgggcaaatggactttgttattggggacaaggtttagagaacaaatactttgggtaacaggtgtctgcttataagtatgaactttagcaagcagtgtgagaaaattccaacaggaggccctctcccttgcatgggctctgaatgagcaaatccaagattgggaaaagctgctccaactctttgaggttctccactacccatctttggcatgtgatttgaccatggtcctgaggacatttgattctccctttcacaaaaccacttctaaggtataagaccagggaaactcatattgtataatatactccttttgtctggctctctatttctccaacacctgtagtagtccaaatggtgtgaattgccctgtctcttgccttaattaatactatcctgtgaattaggaaatggagtcacaattttttccagtttgcagatgaagaaataaagactcagagatttaagtgacttacccaagatcacaaagctagcaagtggctaagtcagaaatagaccccacgtcttctaactgctatacccttctggagaaagtgtcagggaaagataatgacttattttttagcattttgcttgttaatatgatcattttacttcttctttgtgtggggatgccaatgaatttccatttattcaagccaaatctttgttttctccaaataatttgctgaggtagtgctcttctcattaaagccccctgaagattggctgtgattcccacagagtggttctgtgagctctgatattctggattgtggctgtattattcctggatctcattttacattgcttttcatcagatgtaagacacctatttctttgtctatctctgttatctgctagcatatttgccaccttctttttattgtcttggctcctggttgactattattgagacatatcatcaattaatcccatacaccattgtatgagattttcagtaaccatgactctatacctccgcttcgtggtggcatgccttccatccccttaaagtgattgatcttccctccattagcctgtgcttgctcttctaaattcaaacttggtatcccagtttggacatgagctcaccttatgacctgaagaaaagctttcttttatgaggtaggatcacatgtactcgtctctggtcctctacccaatatctaattcccatatgttggctaagatgctgctgtatacaattctggctgacagagatgaagttgggctttacctccaaatcagaggcgattacttctgcaatctcaggaatagagaggaaatgttcacactaggctgaatttatttgtttggtgcatggaaaagttgcagtgaaatgagtgctgacactgcagcagaaaacttctttgttgaagctgatgcaaggcttggacagctgatgccaaagatgacaacactgtaatttgcttgatccatgtgtctgtgcttcttctttacatcatatctacttctgtgcctgacagtattccataggccagtggtggctgccactatcctagaggcagagaggatagacaagttttggggggcaggtttctctatcttttctcctagcctcaaagcctgtgatctagggcagaggttttcaaacctctgggatgaagagggaggcttgagggagggaaggggaaggaggaaatctagcagggattcctctttaacccttcctcaaacaagtttatgtattgagtttccatgcaagagtttgtttgaacaaagggttcggctgttgaagaaagtttgggaatcactggtctactgcactaaacaggttaacttctgtactgaaaccagcccaactgagtcctacaaaatgagagctgaggctaacagctagtttaccctggatggcttgagtttcctgaggtgtaaaatgaaaccatgcttcccttgatgtaacagcttacatagtggggagctaaaggttttgttggttatcctgaataatttggggctcctttgaggatggatgatagaagaaagttaattattttgagaaagttatttgattccaacctgataatgccaaacttcttctcataaaatgactgttaaatagaatcacgctgtacatcaactagacctaacaggcatatatagaacactccatccaacaacagcagaataaacattttttctcaagtgcacatggaaagttatctaggatagaccatatgttaggttacaaaataagtctcagaagtttaaaaaagatctaagtcatccaaagtatcttctccaaccacaatagaatgaaactagaaatcaataatagaaggaaacctggaaaattcaggaattttgaacaaccaatagccaaaacagaaatcacaatagaaattagaaaatacattgagattaatgaaaacacagagccacataccaaaacttatgggatatagcaaagggactactcagagtgaaattaaaactgtaaatacctaaattaagaaagaataaagatatcaaatcaataacctaactttacaccttgagaaactatagaaagaagaactaactagacataaagcaagcagaggaaggaaataataaagattagagcagagatttttgaaatagagaatagagaaaaacaatatggagaatcaatgaaatcagaagttggtcgtttgaaaagatcagaacaattgagaaaactttgtttagattgacaaagaacagagaagatacaaataacaaaaatgagaatgtaagtggagacattactaccaaccttacagaaatataaatataaagaggataatataaacaactatatacaaacaaatcagataacctagacaaaatgttcaaacttttagaaacacacaatctgccaagactgaatgatgaagaaacagaatatctaaatagactgacaacaagtaaggagatggaatccgtaatttgaaactacccaataaagagtccaggaccagatgactctgctagtgaattctaccaaacatttaaagaagaattaacaatgatcctgctcaaacacttccataacatagaagagaagggaacacttcctaattcattcactgaggccaagattaccctgctacaaaattggagaggaagaataaaactgttttttttgcatgtgacataatactatgtacagaaaatcccaaggaatccacaagaaagctactagagataataaacaaatagagcaaaattgcagggtgcaaaaacaacatgtaaatttggttgtatctctaaacaccaataatgaaaaatccgaaaaggaaattaagacaacagttccatttattataacatctaaaagaataacgtacctaggaataaatttaacaaaggaggtaaaagacttgcacacactaaaaactataaaacattgctgaaagagattaataacctaaattagtggaaaggcatcctgtgttcatgaatagaaagacttaataatgttaagatgtcagtactactcaaagtgatctacagattcagtgcaatccctatcaaaattccaatagcattttttacagaaatgtaaaagctcatcctcaaaacaatatggaattacaagggcctcctatatagacccctatcatgaaaaagaagaacaaagttggaggactcacactaatagatttcaaaattttctataaagtacagtaatcaaaacagtatgatactggcataaggatatacatatagactaatagcgtagaattgaggtttcaaaaataagcctatacatctaagataaattgatttttgaaagagtgctaagtcaattcaatggagaaacagtttctttaacaggtgctgcggagtcgactggatttccacatgcaagttgaacccatatctcataccatatgcaaaaataaactcatctagtgtttggttttctgttcttgtgttagtttgctgagaatgatggtttccagcttcatccatgtccctgtaaaggacgtgaactcatccttgtttatggctgtatagtattccttagtgtatatgtgccatattttctttatccagtctatcattggtgggcatttgggttggttccaagtctttgctattgtaaatagtgccacagtaaacatacgtgtgcatgtgtccttatagcagcatgatttataatcctttgggtatatacccagtagtgggattgctgggtcaaatggtatttctgattctagatccttgaggaatggccacactgtcttccacaatggttgaactaatttacactcccatcaacagtgtaaaagcgttcctatttcttcacatcctctccagcttctgttgtttcctgactttttaacaatcgccattctaactggcatgagatggtatctcactgtggttttgatctgcatttctctaatgaccagtgatgatgagctttttttcatacgtttgttggtcacatgaatgtcttcttttaagaagtgtctgtttatatccttccaccactttttgatggggttgtttgtttttttcttgtaaatttgtttaagttatttgtgcattctggatattaaccctttgtcagatggatagactgcaaaaatgttttcccattccgtaggttgcctgttcactctgatgatagtttattttgctgtgcagaagctctttagtttaattagatcccatttgtcaatttgggctttgctgccattgcttttggtgttttagtcatgaagtctttgcccatgcctatgtgctgaatggcattgactaggtagtgggagttgaacaatgagaacacatggacacagggaagggaacatcacacactggggactgtcagggggtggggggctaggggagggatagcattaggagaaatgcctaatgtagatgacgggttgatgggtgcagcaaaccaccatggcacgtgtatacctatgtaacaaacctgcacattctgcacatgtacccccgaacttaataaaaaaattaactaacgttaaccaatatctaaatataagatctaaaaccataaaactcttagaaaacataagggtaactcttcatgaatttggatttggcagtgggttcttagatattacagcaaaagcatgagcaacggaagtaaaattggattatatcaaaattaaaaatcgttgtgtatcaaagaacattatcaagaaagtgaaaaagacaatttacacagtggatgaaaatatttgtgagttgtttatctgataaaggcttgatatatagaatatagaaagaactcctaacagtcaacaacaaaaagacaaaagaaaattgaatggacaaaggacttaaatagatatttctccaatgaagatatacaaatgtccaataagaacatgacaatatactcaatatcattaatcattagggcaaagcaaataaaaaacaaaatgagagaaaattttcgcaacctactcatgtgacaaagatgtccagaatctacaatgaactcaaacaaatgtacaagaaaaaaacaaacaaccccatcaaaaagtgggcgaaggatatgaacagacacttctcaaaagaagacatttatgcagccaaaaaaacacatgaaaaaatgctcatcatcactggccatcagagaaacgcaaataaaaaccacaatgagataccatcgcacaccagttagaatggcaatcattaaaaagtcaggaaacaacaggtgctggagaggacgtggagaaataggaacacttttacactgttggtgggactgtaaactagttcaaccattgtgaagtcagcgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtaggggcagggatgaaactggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgttaaatgacgaattaatgggtgcagcacaccaacatggcacatgtatacatatgtaacaaacctgcacattgtgcacatgtaccctaaaacttaaagtgtaatgataataaaattaaaaaaaaaatgagataccacttcacactcattagggtgtatacttttttaaaggaaaataagtgaagatgaggatgtggagaaactggaacccttatgtggtgttggtggaaatgtaaaatggtacagtcactgtggacaatagtttggcagctcttcaaattgctaaatagagactcatcatctgattcagcaattccattcccaggtgtatatacacaaaataatttaaaacagggactcaaacagatatatgtatgccaaagttcactgtagtgttactcacgattagctcaaaggtggaaacaacctgagaatccatcaatagatgaaaagataaataaaaatgtgctgtatatatgcacaatcgaatattattcaaccataaaaaggaattaagttctgatacatgctacaacatgaataaagcttgaagacattatgctaagtaaaagaagctagttaccaaaggataaatactatgtgattccacttaggcaaattcatagagataaaaagtagattttatgctactaggggctgggggaagagaaggatagaaagttgttgtttaatggttacagaatttgtttgtggtgatgaaaagattttcgaaatagtggtgatggcttcatagcatggtgattataatctatgccactgaattgtacacttaaaaactatttaaatggctggtttcacgctgtatatattttaccacaataaaaaattcccattaaaaataaagttattcaaaagtggtttcattatttaaaatgaagcaaaagtgttttcacgtctttttctctaatagagaaaataaagatgatcacaaatgtgtcccttctatgaataaaaatgaaatgttcattaaaaggaggcttttttcctttttttttcttcatttcttcttaaaaaaaaaacagaatacatgtgcagaacgtgcagtttgttacataggtatacgtgtgccatggtggtttgctgcacctactgacttgtcctctaagttcccgtccctcaccccccaccaccccctgacaggccctggtgtgtgttgttccccacctggtgtccatgtgttctcattgttcaactcccagttataagtgagaacaagcggtgcttggttttctgttaaaaggaagcttttatatttcatatttaaaatgactttttgatggaagaaatagtaccgacactttatttgctttacttagattctattaagaaatttttcttttgttgtatcctttctgaggtaactaagtattgagataattgtttatctttatcatggtaatctttatagaccacatagagagatccatcttaaatattctggtccatcaccatagtttgtttcttcaaacttaacactcaaagtctcaaaatgacagcacatttggggctagtaaactctctgccagtgaatgcttagaggacgtagcataggtagctcagtatctcacaaggcctacggctgtgctcttttctggaggtcagcatcctcttctaagctcatgtgattgttggcagacttcagttgtttgtggcaataggaccaacatccccatttattgctggctgtcacacagggcctattccgagctcctagagacttcccaaagtcccttgccatgtggccccctcgtaggcctgctcacatggcagcttacttttttaaggcctgaaggtaaatctctcttttaatgctttcacttgattaagtcagacccacccagattagtgtgccttttgatgaactcaaaatcaactgatcaggggcatgaattacatcttaaaaatcactttacctttactatattctattggctaaaagcatatcagaggttctgcctacattttaaggtgagagggttatacaagggtgtaatccattgggcatcattctagggtgtgtccaccacaatgtggaactatcaccctgtattgttgagagatggaaagaagagaactgatttttacaatgaaaaaccaaagcagccatgtcaaacttggtaaaagaaatgggcaagtggtccctttatgtgtttcagcttcccatagtgtgcgtttgcttcaatcagggttctccagagaaacagaaccaataaagtgtgtgtgtgtgtgtgtgtgtgtgtgtgtgtgtgtgtacaagccgatagggagataataataaatcagactttcatggttatgcaggtatgcaagtcccaagatctgcaaggttagtcaacaagctagagatgcagaagagctgatttatatatctaatccaagtccaaacgcctgagaaccgggagagctgatgatgtaattctagtccattggctggcagtgctgagacacaggaagtgccagtgtttcagcttaagtttgaaggcaagagaaaagctgatgactcagttcaaaggtcaccaggcatgaagaattatttcttacttaggagaggatcagtcctcttgttctattcaggccttcaactgattgggtgaggcccacccacattatggagagtaatctgctttactcagtctaccgattaagaaaaaaaacactcataggcatacctagaataatgtttgaccaactatctgggcaccacatggcccagtcaagttaacacataaaattagccatcacattgtccttcagtaatcgcatgtcatttcccctaacaagtgacactaattcagttattatgacaaatggactcaaccagtttctgctattccaataaaccagtcaaggatgagtggcctccatcaggctgtttcctgcatctgttgctggagtacattacaggtgtggttacaaggttttaagctgtgtgtctccagtgaactgctggactgctgggagaagagaagtaagctgcactttctttcttttcttttctgtttttttttttttttttgagacagagtctcgctctgtcaccgaggctggagtgcagtggtgcaatcttggctcactgcaaccttcgcctcccgggttcaagtgattctcctgcctcagcctcctgagtagctgggattgcaggcacgtgccaccatacccagctaatttttagtagagacggggtttcaccatgttggtcaggctggtctcaaactcctgacctcatgatccgcccgcctcggcctcccaaagtgctgggattacaggcatgagccacctcgcccagtcacaagctgcactttctcaggagcagagaggctaatatgaagctaagtacagagagaggcccgaggctgcttgtagtttcccagctaggcatgcctattgcctcctctgtctatttgcctttgccacattctccattcattaggactgacctaagtatagatatcaaaaagagaaccaagttactcttctgctgaccaggaatttggtaaggagctcccaatgttccctgcagagaagaggaacttacagagaaatggcctgctgaaaaaggctgacaacccaaatttgcatgtaagtcagtccatgatcattgctgcttcttagatttgagtgtgacccatcctgctctcttgcccaaaacatctttttcaagcttgccataacttcacctaatgatcgctttgccagatagagacttgcgtcaagtgatgtcttgagtagcttagaatatctcatatatagtaagcttgtctttgagaggctgtcagttaaacaggtgttacaaaaagccgttggggaaaaaaaagagaagaaagaattgccctctaggcaactcttaaaggattgtgattattctgcatttcataggaactctaaaagtatctcttttaccactcagcaagtaagcatctaaattggctgggagataatttacgtggaactttttgccctgtctttcttgagtctaatcttaaattctacttaactgtccattaaggaagacgcagagagctgtccttagtatgagaattgggaaatggttttttttttttaattttactttatatatatatatatatatatttattatactttaagttctagggtatgtgtgcacgacgtgcaggtttgttacatatgtatacatgtaccatgttggtgtgctgcacccattaactcatcattttcattaggtatatctcctaatgctacccctcccccctcccccccaccccacaacaggccccggtgtgtgatgtgccccttcctgtgtccaagtgtcctcattgttcaattcccacctatgagtgagaacatgcggtgtttggttttttgtccttgccatagtttgctgagaatgatggtttccactttcatccacgtccctacaaaggacgtgaattcatccttttttatggctacatagtattccatggtgtatatgtgccacattttcttaatccagtcgggaaatggttttactctggctgacatttttgaagcttgtgaaaactggcatgtttcaatttctagaagacaccaataaacactccccaaatgaccagtttctcaacatgaatttaattaatgggaaaatcggaggcacgtcaggagagactcactgacaggggccactggaaaagacagggaggtaagatttgggaagcttgtgctgcctcccagtgtggacattactccaatgccattcaagaagaatgaattcacagctttatttcccctttgcgttagttttcctgttcccatgtatgacctacattatctttcccacgtccttattgctgctttgaaatagagattttgacagagcttcctgtgggactacaagaacttcagtcaataactagtgatttccatggcagcagaaggtttttaaattaatgtggcagtctgtaccttccatctgtgaaggaccaaaccggcactccctcacctctctctttccttctacctggtgtttttaccattcctccttccaatttttttctggccttatagtgcaggtctcctggtactgatctggaccatgaaacacaggaagccagagccaaattggccagcaaagcttcacgttttgtagaggatttaggcttctccaatactatgaaggccatgattctgagcattcacaaatattgctgggagttgtggcagcggagcacaaaaaaacctcaaaacgttctttttctccccctgtctaagttgcaaacaaattaagaagtaaaatgagaacagtgtataaaaagcaattggatagacgtaatcacttggccacagaaaatcctgagtgacagtagacccttgtccccctcttccacccctcacttgtcacaaaggccctccccctacaaacttaaggcataaaggagcagagaagaatgaatgctttctccagtgagctgactcccaaggagaaagtaaaaaggaaggagctgagctaggaatgctagtttatcttttgaaacctcaccagtcagtctaccacttccataaaagagtgaatcatgggccagagggaagccagcactgttatgctaatgcgattcatatcaaaaacagtatcaagaagagggaagaaccccctgccccatgtaagctctgaaaaaaattagaggtcatctggtcaactccagttgaggaaatctggattcacacagatgatgtggcttattcaataaggagtagagcttaggctgatttaggctgatctagaggacagaaacaagaatggtgtaggagttctagagaatcagtttttcaaggatgttgttttgcaaactgcccatcatcatttccatcactgccatcagtactctcctgcaatgttaatatttgccgggtacctatttgatcacattctacatagatagatttagtgcaatgagacaccacaggagagagctaactgtgggatgtctctcctccttgcccaaagagtagagttagctaatccacagtaattattttccgtttgtgaaatgtatatcccagggagttattattatcaaagggtatctatattaaatagtgtcattagatgctgcctgccatcagccattacttctgttcatcagagttttatattcctagtgtgtataaccagaatctaactacttcttcccaactacacaactgccactggtcctaactactgtcacctgttgcttagattatagccgtagcctcctaaccagtctccctgcttccatctttgcgccctgcagtctgttctctacatagcagcaagagtgagcctttgaacacataagccagctcacatcattcttctgcctgacactatccagtggctgcccgccagtcagaattaaagccagagctgttacaatggcctacatgagcagacttccttttacccttctggcctcatctcctacctctctcctcttcaatctctcagttcctgccatactggtctccttcattttctacaaaaacagcaattcacactcctatctcaggacctttacatttttgatacttctactggaaactcttttctcctgggtatctctgtggctcactcccttccgcacttcctccagcctctgcgccaatgtcttcttcttagtgaggacttctatattatgtagattaggctgaattatactgcaatagcagaaagctaattgacacattaggaacttaactcataaatagttatttctcacttaggtggatctagcagcaatttggagcagcttctttccaatcagtgactcagatacccttggaggtctcagcttaacaatttgtttactgtctctttactcctcaccaccctcaaatgtgtaaactatatgaaagcaagaatttttgtctgttccccccccatcttctatatactgtatgctttgaatagtgcctggcatacagtagatttccaataaatatttgttggaagaatgttgaaaggtagtgagatgagaaggaatggaaaataaaaacctcaaaggaagcttctttgtgtgtatgttttcttctcaggttaaatacagtgaagctgtgtcaattctgcatacaatatttggttattgttataactatagaaggcatgtggactttaaaacctacttaggttttcagtatcaagatttgaacatttcatttgttttctattgctgccataacatattaccacaaacttaggggctcaaacaacacaaattgattatcctacatttctgtaggtcagaaatcagacacccatctccctaggccaaaattaaggtcttggcagggctgcattcctttttggagactctaggcaggatctgtttccttgctccttttgatcctcagcacgattcaattccttgcggaatggagatctctgctttattgttggctgtcaactgagggccatccctggcttctagagactatgtgtactctttggcacatggcttccttcctacatctccaaagccagcaatggcaagctgagtctcttcaaacttttgatccctcctgcctcttctttcctttcatctctctgctccactattctaccttcctcattttattttaagagttcatgtgactacattgggcctacctggataatccaggctaatatcccccatctaagggtaaattgaatagcaaccttaatttcatctgcagtcttaaggtaacatagtcataggttccagggatttaggacatgggcatttttgaggaccattattcagcctttcagagatacgcagacaaatagaaggtatgggatagttggtaagaatgtaggtttgggaggcatgcagaccttgctttgaatcagctcttcatcttgatagctgggttaatcgggatatgttgtaacctctttgacattcagttttctctctgttaaatgtgaacatgggttgctatgaatattaaaaatgatatgtaaaagtgtatggtatatatcaagaactctactttactacttaaaaaaataatgtgacaattcctaatgttctgaatctaagcatcaaatgcagcttagagctcaatgtggaggacattgcctttaataaaacaaagtaggccaagtgctcttttgctaaaacctcaattaaccagctaggtttatagggaatgagaggggagttacatataagtgttgataattcatttatacctaaatcgttaaacgctattttaaggacatttgatgacttgaggctttcaaagaagtcgtaatgcctttttcttaaatagtaatgctgccaagagtaagcaaactaaaataccatttgctttgaaattcttctcaaacaaatttggagcgggttctaacctggcacaatatattcttccatctgtaatccctgcaaggacagcccccctgaaaataaacaccagcgctatttactgaatggggaattagaatctgtggcaggcaagaatgcaaagaaaagcacccatttagttggaatatttatttctctattagaattgtttaatggatttcaactatcgtaattgagagttatgttctagtgttttccattagctaaaaatgtgcttcttttaagtatctaaggaggacaaattcctccacagcaaataggtagagaaatgcatttcctggaggtgttgaccgtttgagcttgcaaattgatgaatacaatgttggggccaaattgaactaactgccttttgatgagcttgagtgcagcttgtgactaactagggagaggattttaccagtgcattctttaaatgaaacaagaggatccaaggactcatgtcttgatcaattggaagagcttctcctacatcccttcctgtacttcctccctgcttttgctactactctcatcagtggcacagccacatcatatggaaagccaggtagcacaaagccaaaatgtcatacacatacttcatatttcagaaatggttctgtagatcagcccacctattggtatctgcttcatggtttttgccaaaaggtcagtcaagatgggttgttaatgtacttgagtgaattttcaccattgttcctgggcatggagaaaagcatcaataggtgacagaagcatatatgatcacagaacgttggcaggaaggaaaagaagagcaccctacctgcttgaaaataaaagtatttcctgactaataaggtaaaatgagtttgctacttagatacttttggggggtggttatggaaagatggaggtgcacatgatggcattgatcattcttccaatcatataattttccagcaacatttgcactataattttttttgccgctagcactagaaccaaggaattcctagcggtcaactgagcctggggtggggtcttcgtgaggcagggagctctggacacatccctggaaatttcgggcaaccatcaggaccaaatttctcgcttgacccatgaaatttggatcagagattaggtttccaaacaccaaataaaagtgtgaaggggatagtgatgatgcatagtgcagggctcttccagcatgccatgtgaagaggtgtggtgttgatgagcacattttctaggaagacaggagtgtaatgcctgagaatgcactctatagtatattggtgaggaaacctcagtcctctgagctttaatactccaaaaattgaaaagattgagagaagaaaataggctttctctagcaatttagcctataatattgcctgagaaaggtgttaagatcaaaggctgagaagatttcgggcaagaaagtttatatgagtaactatgacatcactctgtgagcctaactggagtttctctactaattgttactaatgtcaaagacatatgtccagcctcacacacacgtgcatgcaaacacacacacacacgcacacacacacacactgggccccgctggctggaacaacatgcatagggcagtgagttttctagaaactttgcctgaaatgttggcagtgacctccataagtatgcatggaggaagaggcaaaatttagtgcaaaaacaatgcctggaatcgatatgtaaataatctttaaaggctgcctagataattcagttcctgggacactgtggccagaggcactttacatttaaagcaaagtgagtgagaccaaacatttttcaatgaagccagtcacatattgaacattttcatgaaatttcagacagcattttgaaagaaatactattagtcaatttgataatccataagcagtacagccatctttttctccactgagtcatctctcctactttggttagaaaactaaagtgaagttcgtgtgaggccttctctggaccagcagttataagtggttgaaaattttttgtgcgtggtgggagtggaagacaccttcacgttaacttgaattcagcttcagttactacttagggaggatagatagatagatgatagatagatagatagatagatagatagatagatagatagatagatagatttagagacagtgatacggtttggctgtgttcccacccaaatctcatcttgaattatagttcccataattcccacatattgtgggagagacccggtgggagataattgaatcatgggggtagtgcccccatactgttcttgtggtagtgaataagtctcagaagatctgatggttttataggggaaaagcccttttgcttggttctcattctttctcttccctgatgccatgtaacatgtgatttgctcctccttgccttccaccgtgatgtgaggcctccccaaccaagtggaactgtgagtccattaaacctcctttccagtctggggtatgtctttatcagcagcatgaaaatggactaatacagacagagtcttgctttgtcacccaggtttgagtagggtggcacaatcataggtcactgcagcctcgaactcgtgggctcaagcaagcctcccacctcagcctcctgagtagccatgactacaggtgtgtgtcactatgtctggctaatattttttacattaaaattttttttgtagagatgtggtctcactatgttgcccaggctggtctcaaactcctgcatcagcctctcaaagcccttggattacaggtgtgagccattgcacccaccagggagtacttaatacatagggaatagctatcatggggtaggcactatgctggatgctcccacccacattatcttgtttaattgttaaagtgaccttgttaggaattaaacgtcgagattcagtttggtcatctgtaagagataggaaattgacttgcacaaggtcatgttgtaggtgatgttctttccccaacctttagttgtgtttccatgtgtatatatttaactgatgcccaaataatgcttggcctcagaagagaagagaattgacccatacttagtactgactatgtgactgtgtgccagctattgtgcaatgtgcatctccaactttaatgtgcatagcagtcgcttcagaacctcgtgaaaatagattctgattctgctgatctggagttagcagtcctgcaagtctgcatttctaacaagctcccaggtgaaacccaggatgctgggccaggatttacacttaaccctagctatcatctcatcttatggttgaggaaactaagcctcaaggagtatacaggacttgcccaaggtcacactggtggtaagtggtggtgggggtgggagcggaactgtgatttgaaagcaggataggttgattataaggccgttgctggtacagtgcaatctgccacatcgcccaaggtttttgaaaccttcttcttaagagaggagaaaatccatttgaattccaggcttgatgaaggggcctggcactttaaagtcctagtttcttctaaagctctttcttctaagctcagaaaaacatggtctttgcagttaattgtgcatacgtttatgttttttctcttggcttcttcagatagacactttggtttgccacccttgcttcaccttgggaactctaaactactaaggcccaagccccactcataggccaattaaaccagaatctctggaggtggggcccaaacatgggcatgttattaaagctccccaggtgattctgatgtgcagctaggataaagaaccactgaattacagattcaaggaaacaatttctggaaaaatgtagcctcagtcccctttctcgtggatgtcattaaagaaggtccagtgtatttaactagacattcaccaacaagatttccaattagttcttggtaccattttattttgtgactgcgagcttggactgctctgagattgcagcctatataaagtttgaaatgattctgtacagaccctaagggtggggagctggtaaggagggatgagagtagaaagatacaacatcatagaccagctccagggcaaagacacatgttgtaggtcctgattttcttgctaacctaagttcttgggggggtattttgaaaaactgaatttgattttattcaattcaacaaaactggctagtcaagagatggtcatttttaaaaatgagaacacagtgcagggttggattaatgctatagaactctgagcagaccaccttggtgggtgaggctggaacagggcttctgtgtagagacgtgtgctgctgtgcaattttacacagtgaacagcgccactgcacaagagtacatactctagcctgaggtgtgggaagaaacgcaaataattggataatcatgagccagagcctgccctcagggaagagagaggagagagagaggagagagagaggagagagagagaggagagagagagagagagagagaggagagagagagagagagaagagagagaggaattttcactggagagagtaaagaaaggctttacttagagcagtaattttcaaccttggctctgtagtcaaatcatctgaggagcattgaaacctaccagtgctcaggccccagccaggtgtttctgttttaattgatctggtgtggcaacatgggtgttttggtttttaaaagtcctccaggtgatgctaatgctaaaccacaactgagaaccactggtttagattgcgttcgtactgggcagaggagaatgcatacaggcagagaaacctgggagagacaagtagcttgggagagtcgttctccaatctaagtatgatccttgaccagcagcatcagcaccacctgggaacttgttataaatgccaattctcaagttccagcccaaaccacctcaattagaaactcctgggtgggggtccacagtcagtctcaataagccctctaggtgactgtgaggctcacttaagttcgacttggacatgaacgtttatggaaagggagtgcaatgagctaaagctataagacttgaacctaacaagctgatgtcaactctcctgatggtaccattgagatgtacagcaataaccagtgttctaaggtggaatgtactcctctctagtcttaccatatctttcttatctgtttgaaactgtagcacagaaaaaagtatatgtcattcatgcaggggcagaatacttctggaagaagactctgcttttctggtagaagctgcacttttcttcttagtggacctatttctgtcttcagcagggggatctatcctccctggccacatgggcctttggctgatggaaaggctgggctttgaggaagctgcataggtaaggtgaaagagggtcccccaacctcccctttttgcttctcgttcccacctgggccaggacttcggttggctgggccccacctgccattcacagcaggcccctgaggctactcacagaatgccaagtgatgccactcagtagagaaagtctttgtcctatgctgagtaaagaccccactgatgtgtagcagtggtgctttatgttttgccagtcagaggctttcttttacctgggaggttgatgtgcacaccagtgcattcccctctcttcctggtctgcattgtatgggccaaactctccaaaatggaatagctgagtccttgcaggatgctgagcatctttgagggtcaaaaaagtgtttccaggattggagctaactcttcacaaagaggtttgtaggacaaagggactttacccatcaagtccagtgattctcaaataaggcaattttgccttcagttgtcagggcggggattggggggatttgacaatgtccggaggcattttttgttgtcacaactttggggagcagtgccactggcatctagtgagtagaggctagggatacagctcaacatcctacaatggacaaaacagcccttcacaacaaagaattatcaggcttcgaatatcaaaagttccagtgttgagaaaccctgacctagtctaaaccccttatttttgaaatgaggcagctgaggctcacagaggtgaaattacattctaaaggttacacagaaagcatcaagtcagggtgaggctcctggttttccaactaccagagtgcattgctcaacagtttcatctctggcagggacagtgtttcctccattgcagataccatttactttgtgcctactaggtgccaggcaatgggctagactcttcatttattaccgcttcatagcacacaccttcaatgtaggcatgactatccctagaagtggctcattttgtgcatgcaaaacaactgtatgaaaagtgttataggccattaagaaagcaaaaatgattgcaaaagagactgagacatggttcttgtcctgggagcttacattcaagtagtggagaaaagatatatgtcaaaatagtgatcatctagctttttacttaaggcccatgataataaccaaaaacctgtcccgaggcaccacaagataaatttcttaaaacgtatgtggaaattgagagttaggagagggagctgactgtatgccttagcatcatgggaaggctacataggtcaaagagaattatttgtgtgtattatgagtaagcactatcctagatcccacatataaatggtcaatgagacatataatgtctctgcctcagggggcttatattcttgtagggaaagccagacaagagagaaatacatacatatataagtaattatagactgtgacaaattgaaacctccctaacgtggctaaaagggcatctctgaggaggtgacattttagtggaaccctgaaggacataaaggggccacttgaaggacataaaggggtacaaggccttgaggcaggagaaagcctggcatattctagatactaatggaaagctaacgtgagccagaagagaggcatataataaaattgaggaggtgaggggccagcatggtagggagtttgcatttcattctaccatgaaaagagcaagttagcctgaagaaacataggatggatgaagacctagtaatgcttggagaatgagggaggttgcaaaggagaaggtaactgaaatttccaaacattgaaaagttgtttctaccttgaacaaattgaaagaccattagcattgatctgttccattcagtgaattatttacttaagttactcatgcacatttaaacctgctaacttcatagtgtccatggtggcagtaaagcttaaatcttatatagagataagtagatggttagctgggaggaaaaatggaggtcttgagctaacacatcctgtggttgaatgcacttttcagcatgacaggtgctcagtgacatggaagagtcattgctctaattaccccatttttttttctctctttctgattaggtaaggatgtctgataatctgtatgttttgccatattttctgtttcatagattttttaagtattttattgttggagtcactaatatgtgtctaataattttgattggtagtcccattgctgtctacattgctgtggccttggtgatctcagatttgctttgatttaaaatcatgtatcattaattatgttctgttatctttcggaagagttaatttaaaggcaaacagcatcatcatcaaataattgagggcttgttaactgcttccagcttgaagccagcaaaccttgcgaattacagtggcctgctgagggggcagatgcctctgtggcattgtcaaaacagtttcctaggctgtctctggttgcttttctgtctttgaataagggaaaaagttttttggagacaggggtagtcttgaaaagtaaaaaatactgaagaacccaatagctatctaatatattgatgcttttacaaagttgtcttactttatttatttatttaatttttttgagatggcgtctcactctgtcgcccaggttggtgtgtagtggtgccatcttggctcactgcaaccttcgcctcctgggttcgagcaattctcctgtctcagcctcccgagtagctgggattacaggcgtgtgccaccatgcctggctaatttttgtatttttagtagagatagggttttgccatgttggccagtctagtctcgaactcatgacctcaggtgatccacctgccttggcctcccaaaatgctgagattacaggcgtgagccaccacacccgacaaaagctgtcttactttagacttgttgacaaacacactggaatcctggctacatgataggctttttcaataacttactatgtgacttttaagaagttgcttcccctcctgagttttattttccttatgttttaaaacaaaggagtggcattaaattatctctaaagaaattttgtttgaaatgacatagaggatttcatcatagtgtttgtcacgtactaaatatttaggtagctgttttctgaggccaatgttatgtctattgatacaacttttatagagtaaaccaaaacattctaaatataggaaagataaatgattaacttatttagcttcaaatatatttaaaggatacattgcattggaatttttttattctatcagagattaaggtttactataagattggttctttctttacctctagtttgaaatgggaatactgtatttctgtgaacatgagtacgttaggccaggtcagcaggcttagactctgttaaactctctcctcttaccatgactgctccctgactgtgtccttaaccttgacaatggcagaacagcactgctgctgctgagaaaccaaacctagatgcaagcttgcccacctgatggttagtcaatggaaaaacatttgcaatgggaactagctcttttataaaagttgcttataaccatcatcccaccactaaagtcacttattcttatcacctctgtgtctgagtatgccacctgtcagtgtctgtgtgtctgtggatgtgtggatttgcacatgtgcacttgtgtcctcctactctgcactactcctgtgagacttcggagtcctgaatgggagggctgtgttttcgaggctgggggcactgcctatatgggcaaaatttccccccaaaggcctgttctttggcagctattctcatggggctcagcagcctttcaaaaagcatggggcttccagatccagaaataaaccaggagccacttttaccaccttatctgtcttgaagagtcaagttgaatttctgaaatcggaggaagctttgtataaatctaatgtctacctaatcactggaattttttgtccacctccaagactggataaatctatttttgggtagggcagcaggagtcactgaatgaaaggtggacaaatggttcagatgaacagtggcaagagtggttgtcagaggatagaggtcatgtgcaagaagggaatgtaccagattgggtaaaatggcagaaaacattgcattaagccagggaaaaaagaaacccattcccttttcctatcttaatgggctggattctttgcaggtctccttttcccttcataaagctggtaccccatggacgcattgcatcctcatcactttcttagggaatcagaacaaagctacccacctatcttactgctggagtcctgtgggaagtcatctttcattctttctgctgtcaactgcacatacagccaccatcctacttgagggagccctgggaataagtgcatttgatataacagttttaattttccatccaaaatatctcaaattaaagagattttataagccagcgtaatgtgttgcctatacagtgccacttctggtttaaaaaaatcagtgtttctagctcttttgccaacataacatcaagctactgttggttgactactctttttttttctgttttgcttgaattgactgacatttgaggtattgaggagagacagcctgagacccaaagctgacccattaactcccagatgttcacgatttccgaggaaatgttctgtgcctatggttactgttctgatgactccttgaacactctcatcttggcaccttttgcacttgctaaattcaatttgaagaaagaacaaaagacagggaaaattttgtggaaagcaattatcctgcacttttatgaccttcatgtttttcccatcatgatgaattttggggttagcacttgtatcagtcagcatgtagctttcactagaattttgttgtgtgttacagataaccagtcgtatctaattaaacaataatgatgccagtacaaggcattttctgggaattaatgaccagctgggaaaagctgatggctggagagtcagccaaaggctattagcttcagtccactattaatctccagaaatgtcaatttgtgacatcattgttggtactgagcaatgaaaatggaagacagtttactgttatctgtcacgtacttctgaataacaaattccttatgcattgtcaaaaagtcattttttctcttttatcctccaattgtccttcagtcttataatatgttttctatacagcagtgggtgaaaatggaatttctcagtttccatataatcatgggtgcttctttttttaaagagttccaatttggggagttttatttaaatattttggatggtaaaactagaatttgtcttcagctgtgatgctggaatttgatgagtgtctatattatcataactatctgctcatggcaggaaatggttacaaatgttttgaatagcagctgttgctagcaaagatgtgcattcaacaacgagattctaagaagttatagtcgcattcctagtagatgaagggaactctctacggaaaaagctatcgtggtgtgtctatgtaatatttttgattgctgctgctgaatgctagagggaaatagagaactgactaaaatatcagcatcaccatcttgcataatttaatgagttataaaggaagacaacaatccctcatagagtcaatctattaagaacttgttctaaactcataatactaatttaaaagttatgttggtttttatactattttttccttgacatgaaaggaaattcttaaagccccttaagatcccagccaatgagctaggaatgttttacccaacacagaagcttcatatcccatctaaattcagccaccatttgtttatttatttatttttttttttacaaacaccacggcattattcaccccacaagaaatttgctagtagtatcagtcctcctacatgcgtgttaagtgtatgcatttcgggtagtagaatgagtcagctcgtcattaatcaaagctttggaggcactgactcacttctggtgaaatggaatggcctcattgggaagggtgtgaaagaaaacaattcatgctggggtcagttccctgtttctgaaaatgcagatcaaatttgcacctattttcatggaaggttttcagaatagagaatgtagcagtgaaccctataaaggcaaatatcttgcttttgcagggaataaaaataatagtgatacaaaaacactagtgatacacttaggaagcatataaagagcctagaaagaaaaatgtggactgagaggatcctggtgtatacctaaggccaaaattattaaaccaggcctggctcttttacaatccaacaaggtagtcctttgaccaagcgttgtttcgtaggctctcagctggaatctcttgtcttcattaaggggttttgaacatctgaagaatgtttgcaacagcttcagttctctttggaaatcaaaagagtaaagagcagtgactgattcttctgtctgtctccgtgtatactgcttggaagtaaggccctcaccaggagcagaccaagaaaagaaacagaagcaaatttactgataattggtggatattagccagtttaacctatgaatacttatattgtactcaatctgaaacctataagttctacatggtgtttatttagatacaacatgagcatccatattaaaatacgtttttgcactttgggtatgatttaacactgttttcattgtactagcaacagaggtatatatagtcgagtagctatttccacggctttagtattttaaactaagcccattaaaataaaatcgccaagctattagatgtttttctttgaaacttttcttagggctgttgtttctttagtcttccctgggagtatatttgatttaagacattcgctgcttttctgaggctctaacttgagttcattttgttatgtggtgaccacagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaa

SEQ ID NO: 5907 - DNA, 346013 bp, human; identical to SEQ ID NO: 5906

SEQ ID NO: 5908 - DNA, 2073 bp, human; identical to SEQ ID NO: 5133

SEQ ID NO: 5909 - DNA, 62894 bp, human
ctggtggggagacagcatgccactggtaagtagctgagaaatattttgtaaaatagatatccagactaagatttttaaagcaagcgacatgttttgagggaatagaataatgcaaaattgtgtaggaatctctgattctaatcagcagcattgggaaatggattaattaaattctaaatattccctggtcatttttctagtttaaagcttgtttcttaaatgatggagttgctaggaggcaatatagaaactttccccttgtgattcttgtaaaatatttcctaaaataagatttaatgaagatgttactaaattggagaattgctttcagaattgtacctcagctttacgatatttgtatttgacgtgatgaaatgggttatgattcaagatgttctcaaacctggtttattttctcagtgctgggagagcataagaaaaatattactttgcaatgcagaaaaggatacgatgcctcatttttttaaattaagaaagtcgtgtgacgggatgtctgtactagagagaaaatgaggaagagggcagtttgtaataatgttcagattgattgcttcatgtgagatatgaaagtgtattcaatgagaaacattaaaatttgactttaggatgaaaaaatcatgaaaaagtaataatgaatattatgatcgtgctttcattggaaaaaattaatttgtatttttggacagcgatttatacagtaaagacaagagtgttctcggtgcttctttttttgaaaagggatgtgagatggatagcagagattcttatcaacgaagctttaatgtttgtttctgaaacattcctgaaaacagagcttttgtagctctgtttctgcaagaaaaacgaaaaaaaaaagtgaagtggtggtttattcctttgaaattcaaactggcccttgaacgtgaggaaaagaaaaatgatagataaatagatttcgtttttgagttagatgacaaagcagcagcaatcaaggaggaaaaataagaatgaaaaagcttaaaagaaagtcctcaagatgggccattttcccaagttgaacatgtctgctggtagcatgttttgcagagggaaagggagagaacatactggaggcaaagggagggggtgttgaacagagcactgcggcaaagagagtgactgacgcatccagggacatgtgaccattctctggtgtagcgaagaaaatttgccaggactccatcttgtataagacattctatacatactgacatgcaaataatgctataatctttctgtagtacataatgagctcgttttgcgtgatcctccactggtgtatattggtattttgtctttgcttctacgccttcctctctgtgcttccagtgcttttatacacttactaaaatattaaaaatgatgttttcccctttattataaaaatatcatagtcattgtagtaaattttgaataatgtaaagatgattataaaaattacccataatcccgtaacttagagataattactattaatcttattactgtcagtctcttttctctgaatatatgcaaataaatgcatagaaatatatattttatacaaaatgaagatcacatgtacatacaatttttagcctgtttgatccattaaatatatattgggagcaattccccatattttaaaatattccacaagaatgtggtgttttgtggatgtataattttctatcatatagatgtcccactaaatgtccaattattgaatgtttatatgtgcattatttttgctgttataaataactgaaggaatatctttccatataaatatctgtgtgcttttctggttttttctccctaggaaaaattcgtagacatggaattcctggatcaaatggtatgaaacaatttaaggtttcttccccccaacacctatcacctaatttatttattatatgtggtataaacattattttccagccattgttttcctattaatttttaccatttatggtggtgattttttgatattttacagttttacatgttagatttccatatctgaccattttaagtgttgtgatttttttctttcctttgattagtgtattcacctgtatttttttctagttatttaattgcttcattttttacaattaactccttaatccacctagaattcattttgatatatggtatacagtaggatttaattttttttccccctaataggtcaccgattgtttcagcatcacttattgaataatccaacgcaacaactgttcttccattagatagggtgtagctttccacaggtcggccattttctctttacccaagatggttacattttgcaatggtactcctaccttcctgcagcttctgacagcatactagagcaccatgtttgtgcttgtgcgtttcaaaaatcctaggcacatgcagattagggcagtattttaaacaggattttttttttcattttaaatatgttaagtttgtcacattcttgttgcaaattaaaattaaggaatccaaatatatgaaaccacggtttcaggtgtgctattcctcttaggcgcacctgatatcccaattgtgtgttaaaaaaaaaaatacccccggggttaaagttcctccttcaacctcttttttttttttttttttactcttcagatactcaaagagttaaagttggctcgactcagttcttggaattttctagaatgatataagagggaaatacaagaaatgtatgaggagtagaagtaaataatgtttgccagcctgttgctggccgtagtctcatgtagggatttaaaggagctagggtgagtcctaacccatgccaccactgccactacctcttctagatagggacacaccccagtgagccacctcttttcactgcaggtgtaaggctcaagacataaggcaaggagttttttagtaggagatgggttaaatattgcccagagaaatctgacaattaaaatcacttgctacctattaccaaccctctcccgggcccccaacgaagctttctctctctattgacttctgcaccgggcctcttagctttactgattctgggggggaaaaaaaagggcggggggaggatggcgcgtgagtgggaggctgccttgcctgcggttattgcaaggggctcctttggctcacagcctcagtcccagtagtttcctgacttgccgcattagactgtgttttgtttatgaggaggctggtttccctggcaatggcagctcgccagtgcatgcgcatttgctccactgcagtagcagaatgcggctgtggggccaggggaggggtcctgagggccgcagtggctggagttatttggcagacatgacgtcagtttttctgagctaaactgccatcgttactgtatatggagcatttttttttttttaaataaagcttggaaggcttttagccactccttttctttcctcccaaattaactgctctctatatgctcaccagtgaccacgaaggctttctaaggtttgaggccaccgatgccctcagggccccgaggggaatcataatagtatgagaacaggaaacagactgcctggtttcagacctcggctgcttgctagttgcatgactgtgggacgggttacttaaatctcttcgtttcctcagatgtaaaatggggatgctaacagcatgtttagaacagtgtctggcacatagtaaccattatgtaagtgttgtctattattatttgtagatactaagggggacttgcctggaagcagacttgtgtccgcagtatacaaactcaccctttaatgcacacactgaccagataacacaaacacatttacccccacagcacctagactcttctcacagtacacacacttgccttccagtacacagacatatccaaaggcacaccgacaagcaccacagcaaaaagatgttccccagaacacatggacaccccaatccccgtatcattagactctcccagaggcacgtatgtactgcttaatgcagagactcacctgaggcacactgatgcaccccgcatgacacagacttgcccccccataaggactctactatgacacacagacaatcccaacatcacacactgttcccacatcacacgaacccattttaggaaacacacagcatacagacttaccccatagaacacggcttccccgacaagcacacatactctcaaggccagtagactcaccccacagcacacagactttctctagagtgtacagcttcttcccacagcaaacagactctccccagggcacacagacacccctgacatcacatactctcaccacagaccatagactcgtcctagagcacagggactcttgccaatgaaacagactttcccgagaatagactcatgagacagcttgaagacccgcatcatgacacaaagactctcccacaacagacagactcaccccattgtgtacagacaagcaccataggccacagaccatcacctcaggacacagacttgcccagcaccacacagacactctgcagagcacgtagagtcaccccgcaaagcacagactaaacccatactacagagactctccctatagctttcagacaagtttaccccaccacagagacatgcaacggtacatcttacaacatatatcactccttgatgcacacaattgtgccacagcacacaaacttgtcctacagtgcacaaattcatgtcacaaaagacacactcaccacacaatacaaatacttgctccagccggacgcggtggctcacgcctgttatcccagcactttgggaggcctaggcaggtggatcacctgacgttgggagttcgagaccagtctcaccaacatggagaaaccccgtctccactaaaaatacaaaattagccgggcatggtggtgcatgcctgtaatctcagctgctccggaggctgaggcaggagaatcgcttgaacccaagaggcggaggttgcagtgagccaagattgtgccactgcactccagcctgggcaacaagggcaaaactttgcctcaaaaaaaataaaaaaataaaaaaaaaaacaacccagcaacaaaaacaaacaaaaaaaaacaattacttgctccagagttcactcatttgccctaaaatatctagaccttaccccagagttaccacacaatgcatgctgtgtccctgcatcaccaaaatacaactcaaactcctcagacacactctgataaatagacatacctgacaatgtacagcttggcatcatagcaggaaaaactggctctacaacagatttattctacaacagacacactcaggctgtagagacacctaatctttctttaaggtattcagacccacccttttgggcacagtcacagatgtgatccaggataccctcacccatcccacaatactgatgcaacccacagcgtacaaacacatcccacagcataacactctaagcccacagtgctcagaaatgtcaggcacacatttgccatacagatttacttcacacacaaaaaacacagccaggtgggtggctcatgcctgtaatcccagcactttgggagtccgaggcgggcggatcacaaggtcaggggttcaggaccagcctgtccaacatggtgaaaccccgtctctactaaaaatacaaaaaaattagccgggcatggtggcacatgcttgtagtcccagctactcgggaggctgaggcaggagaatcacttgaacccaggaggtggaggttgcagtgagccgagatcatgccattgcactccaccttgggcaacagagtgagacttcgtctaaaaaaaaaagaaagaaagaaagaaacaaacaagaaaacaacaacaaaaaacacttcttatagtgcctatacaatgcaaacatgtatcccaaaatatatgaaactatttgctatgtcactcttaggtttaccccaaagcacatagaccgttttcactgctcaagctgctgcctacaaaacaggagatgccaagccatgcacagaaattcaccaaaatgcacagattcacctatcaatatacatacttgcctcacaactcacacaaacaccaccgagcactgagactcaccctaaatgtacagacaagcccttcagggcacagacttactctgtaacatactaaatcacatcccccatacttagatgtgccttatgattcacagtgatgcgtgtaaacacatagattgcttccacaatgcacagaattgcatcataacacagacttactctacagtgcaaaactgacagtgcacataaacatttcccagtcggctagacacacaacacacatattactcctacaatgtaaagatttccatcacggtggacagacgtgcttttccatgctgttgagctacaactctggcctacaacaacagaaatacagcttgtgtaatagttaccagcaaggcctctagacccatactaactgggtttgaatcaaggtcccgtcccttgctgattgtatcaccttgggtaagtatatttctttgttctttagtttgtgcaactgtaaaacaaagataagagtagtgcctacttcaaagagttgttgtgagtaataaatacgttaagatttgttaagtgcttagtacagtgcctggtacatagtgactattagaattgttaatgtatattacaaccatcactatcattactaccaaaacaaaaaaggcctaccccagatatctagaatcatctgacaacaagaaggctcaccatataatatatagattagccctagaacgtctagaaacactcgacagcacacagacaccccgccatagtacccacataccctacagaccagaaccctaaccagatatcactcacaacacacagaattgcatcactagtaacaaatttgtgcacaggcttgctctataacacatcccacaatacccagactggaagccaggctgtgtgttgtacccaacctcaccccacaaggcacaggcccacaacatacacacacacacacacacacacacacacacacacagacacacacacatcctaacctcatagatatgccctacatcatacaaacacaccctatcacacatatttttgtttcacaacatgtggatacccctgctcttcacaaacatgttcctaaatacatgctcctaaaattggcagcatcacatgataacacagagcccccattccacaacatttttttttttgagacggtgtctcactctgttgcccaggctggagtgcagtggcgcaatctcggctcactgcagcctccgcctcccaggttcaagcaattctcctgcctcagcctcccgagtagctgggaatacaggcgcgtccatgcctggctaatttttttgtatttttagtagagacagggtttcatcatgttggccaggatggtcttgatctcctgaccccgtgatccacctgcctcaggctcccaaagtgctgggataacaggcgtgagcgaccgcccctggccacaacgcattttacacttacctcatgcttgtcccataaagaactacatgccccacatcgcctaagttgcccataaatctgacttaccgaacactgccacacgtatgaccaggccccataccacacagatttgctctgtaatacctagataagtcctaacatgcagagatcacccctaaacacaaaaccatcccaactgcacagcgtcatatcacaacagacacacacactcatcccataacatgcagacttgcacgaaaacacccagactcccacaaagcaaacccacgcccacaatgctaataccacacaacgcccagactggcacaagacaaagactagcctcaactcatctagtctcaacccacatgatataaaacttgctctacaatggttaaaagcttatattcaggtctcagactgtctgagttccaatcccacatgcatcacttactagttgtgtgacctcggaaaggtttcttgaactctctgtgccccagttttctcagctacttgttaggaataataatgtaataggggtacttacctcttatagctgttaagagaaataaatgggctgggcgtggtgggtcacacctgtaattccagcactttgggaggccgagacgggtggattagctgaggtcgggagttcgagaccagcctgaccaacatggagaaaccccatctttactaaaaatacaaaattagccgggtgtggtggcacacacctgtaatcccagctacttgggaggccgaggcaggagaatcgcttgaacctgggaggcagaggttgcggtgagccaagatcatgccattgcacttcagcctgggcaacaagagcgaaactccgtctcaaagaaaaaaaaagaggaataaatgagttaatgcctataaagtgtttagagcaatgcttggtaaagagtcagcgttattggtgttacctgatcaggttgtcattgttgtcattactccacacgaaattggaccataaaggtaagactcaatctaaaacaactcgaatcaacccacaatgcatagaatatccctcataaagcacagaattgcatcatagtgaatactctcaccgctcttttcctataacacccatcccatattgactgcacctattctttttttttttttttttgagatggagtctcgctcttgttgcccaggttggagtgcagtggcgtgatctcggcttattgcaacctccgcatcctgggttcaagcaattctcctgcctcagcctcccgactagctgggattacaggcccgccaccacaagcggctaatttttgtacttttagtagagatggggtttcgccatgctggccaggctgttctcgaactcctgacctcaggtgatccacccatctctgtctcccaaagtgctgggattacaggcatgagccaccgcgcccagcctgactgtacctattccgtaacgcctagaagcatctatcatatagagtttctgcataacacctagacttatcacacaacagctagacacgctacaatgcacaacatacccaacaaacagaaactcattcatgaaaagactcatctcagtttaagcaaatgcactctatcatacacatacgtgctctacaatacacatactcaccccagaacaccacattggctccacaacacaaggaactcacttcaaaatctctagaaacaatccacaagccatagacttctccaatatgcagaacagcatcacaccacataaacttgactacaattaacagacaagaaaccaggacatgtgccataacacatacattatccccgtgacataaatactggtccagcaaaatactgtcttccctatacaacactaagatgtgcttcataaaatacaaacttgtttgacaacacaaattaaaatatttcagaatgcacatatatactccataacacacagacttgctctacaacacaccgacacaccccatatcacccagatgtgacccaaaacacacagcaatacccgataaacagtcactccttttttttttctttgagatggagtcttactctgttgcccgggctggagtgcggtggcatgatctcagatcactgcgacctctgcctcccaggttctagcgattcttctgctgcagcatccccagtagctgggactacaggtgtgcaccaccacgcccagctaatttttgtatttttagtagagactaggtttcattttggccaggctggtctcgaactcctgacctcagctgatccacctgcctcggcctcccaaagtgctggaattataggcgtgagccaccacgcctggcctcagtctctccttttaacacacagactggccacacaaaatagcttcttcctgccacgacttccctcacagcagcacatcccacaaaggatggtccacatacagagaaacacaatgtgcagatatgttctgcaacacacagccttcctggacaagacctagactcgcccggaaacacccagatccattttacattttaaagactcacatcccaggccaggtgtggtggctcacgcctgtaatccccgcactttgggaggccgaggtaggcggatcacaaggttaggagtttgagaccagcctggccaacatggtgaaaccctgactctactaaaaatacaaaaattagccgggcatggtggcgggcacctgtaatcccagtactcaggaggttgaggcaggagaatcgcttgaacctgggaggcggaggttgcggtgagccaagaccgcaccattgccctccagcctgggcgacagagcaagactccgtctcaaaaaaaaaaaaaaaaactcatatcccagattagtctgccaacccatggacatgctccacaatgcatggatagaaccacaatgcatggacatgccttacaacacatggaactacacaggctctacctttaacacacaaactgtctccataaaacacttccttgtctcttcaaaacttagtttaaaatcagaagaaatgctcaaaaatacacatagactcaacaaggcctggacataccccacttcaactagccttgtcttgtaacactgagactcatctgaaacatagagatacattatgccacacctagaatgaccccccagaaaccagactagctccagaacacccaaataggagccacagtatatggacataaccctacatatacaaatccttcctacaacataacgactaatcccacaaaacactttcttgctccataacaccaacacttacctccctgtgcatagaatcgctggacaatacagacacttcttacaattacagatatgattcacaatactaagacttgctgtaacacatgccaacttctccaagccacacagaatcacaacattgtatgtattatcggacatgtccgtatattttggggacaactgaacttatcccatgacacccaggccttccccaaaatacatggacgtgtcccatcatacatataatttccagacaacaaagactggtcctgaaaaataggttttttatttcataacaccaacgcttagctgagagcacgcagaagtgctgagcaaaacatgcgtaaaaccccacgatgcacagacatgccctacaacacccaaagtcacttcataacacacaatctcactgcaacacaccaacccagggacttaccctgagacactcagactaacacatcacatccagatctacccccacctaaccctaattgccccatgtcaccagacttacgttgcaatagccagacttgacctgcaatagtctgatttgtcccctaacaactagacaagactatccacacaatacatacaaagacccccaaaatgtttgcttgtctccacaacactgacagtttcttaagaacacacacagatgctggaaaatacacaaccaagtcctgcagcactaagatatgtgcctgtaatacctagatttgccacacaacacccagaatggccctgcaaaactccagaatgcaccacaacaagaatacatgccttgtgacaccagagcacgccttacagcagtccccaacctgtttggcaccagggaccacttttgtggaagacagtttttccacggactgggggtgaggtgggaggggtggttttgggatgaaactgttctgcctcagatcatcaggcattagattctcataaggagtgcacaaccctgatccctctcatgcacggttcacaatagggttcacactcttgtgagaatctaatgctgtagctgatctgacaggaggcagagctcaggtggtaatgcttgctcactcactgctcgcctcctgctgtgtggcctggttcctagcaggccatggagtggtactggtccgtggcccaggggttagggacccctgccttacaccacatggcgtgctccataatacacaaaccatcctaataacatagactgactctatacttacttgcctcaataacattaagacacaccttagaccacataaaaatgttagataacatacagaaaaaaacacataaataacagacatgccctataacacttacactcgcctcatagcactcaggttctcctgtgacagctggatttacccccaaaatacctagacctaccccaaagcacccagacatgccccacataaccagaaacatcacatatcactcaaacaccttccaacaatcagacttgcctggcaacccagactgtcctacaatacacagtaatggcccacagccaagagacttctcacaacttacagactggccacaaaaagcatctttttgctttcacaacatcaagactttccacacagcacatagaaacaatggacaaagttcagaaaaccccagagtgtagtggtatgcctcataacatccagagtcaccccataacacaggacctagactggcccgataagatagaattaatacccgcaataaacaaacatgccctctaatatatgaattcatcacacaacacgcacactgtccccacaaacacctttttggtgtcaagaagaaaaagactagcttcactgaacagagaaatgctggacagtgcacctgcagttaaaaaaaaaaaaaaacaacctcacagacacagcattcatcacccgaatctgttacaaagtaacaggcatcatcttctgacacacatatttaccccccagcaccagagtagctccataaaataccttcttgcttttacagtgcgaagactcgcctcatagcacaagtctgacatgctggagaacactcagacaaaatccttaacatacataaatatcacccggattccctccacaacatgaaatctaaccccatgaaacccatgatagtccacaaaaccagacacgccttatatcacccagtctagcttcacaacagccaggcataatgcaaactcgcccccgcaactcatgaaaatactccacacccaacaaaccttcccccaacacagaaacttgccgggcaaaacaaatgcaatggctcatgcctgtaatcccatcactttgggaggctgaggcgggcggatcacctgaggtggggaatttgaaaccagcctgaccaacatggagaaaccccgtctctactaaaaatacaaaattagtcgagcgtggtggcacacgcctgtaatcccagctactcgggaggctgaggcaggagaatcgcttgaacccgggaggcagaggttgcagtgttgtgccattacactccagcctgggcaacagagggaaactccatctcaaaaaaaaaaaaagaaaagaaaagaaaaaaacttcatgacactctcacaccaagacttgcttcagagcacacacaaaagatataaaaggattgaaaacatacagaacaactttgcaatgtgcagatatacagcagtactcacctcaaattacagaaagtcatacaacaagatccctgctggttccatgatacacacattccatacacagacacagacacattccatacacacacacacattccatacacgtgcacacacacattccatacacacagacacacattccatacacacagacacatattcgatacattccacacacacacacattccatacacacacattccatacacacacattccatacacacacattccatacacacacattccatacatacacacacattccacacacacacattccatacacatacacacacattccatacacgcacacacacattccatacacacaaacattccatacacacacacacattccatacacatacacagacacacattccatacacacacacacattccatacacagacacacattccataaacacacacacattccatacacacacacattccatacacacacacattccatatacacacattccatacacacacatagacacacattccatatacacacacgccatacacacattccaaacacacacacacattccatacacacacatattccatacacacacattccatacacacatacatacacacacacatacacagacacacattccatgcacacacacacattccatacacacacacattccatacacacaccttccatagcaacagacacacgctccatacacacacattgcatacacatacacacacattccatacacacacattccatacacatgcacagttacccattccatacacacacacattccatacacagacacacaccatacacacacacagacacacattccatacacacacacattctgtatgcacacacacacattccatacccacacacacacattcgatacgcacatatattccatatacacacacacattccatacacagacacattccatacacacacagacacattccatacacatacacagacacattctgtacacacagacacacattccatacacagacacattccatacacacacagacacattccatacacatacacagacacattctgtacacacagacacacattccatacacacacacattcagacacattccatactcacacacacactttccatacacatacacagacatgcattccatacacacacacacagtccatgcacacacacaaacacattccatacacatacacacattccacacacatacacacacagacattccatacacacacagaggcatattccatacatacacacacacacattccatacacacacacattccatacacacacattccacacacacattccatacacacacacacttccatacacagagacacattccatacacgcacagacacacattctgtacacacacacacaaacacatattccgtgtacacacacttccatacacacagagacacgttccatgcccacacattccatacacacacagacacatccagtacacacacacacagacacattccatatacacacacacattccctacatacacacacagacacattccatacacacacccatactcattccatacacacagagacacattccatacacacacgcacacattccacacgcacacacattccatatacacacacagacacattccatacacacacattccatacacacacacacacattccatatacacatacacattccgtatacacacacagactcattccatacacacacagagacacattccattacacacactcagacacattccacacacacacattcatacacacacacattccatacacacacacagaatcattccatacacacacagacacattccatacacacagacacacatttgatacacacacacattccatatacacacacattccatacacacacattgcataccaacacacacacattccatacacatacacagacacacattccatacacacacaaacacattccgtacacatactcagacacacattccatacacacacacacattccgtacacacacacagtcacacattccatacacacacacattccatacgcacaaacacattccatacacacacacatattccataaacacaaacacattccatacacacacacagactaattccatacacagagacacattccatacacttacgcagacacattccacacacacacacattccatgcacacacatagactcattccgtacacacacatagacacattccatacacacacagacacattccatatgcatacgcaggtatgtccccaaagaaatagattgtctccatcatatgcacattaacccaacgaaatacttttggagctctgtaacacccaaacttgactcacaacacacatgaacactgaaccacacaaatgaaacctacactacccagacatacccattgtttgaagacttgctgcaaaatacccagccttacgccatgatatacagacttggcccattgacctatacctaccttgaatcacagggactgatagagcaacactcagatgtggcccacaaccacagatatgccctaccaaacaactttttgtcttcataacatgaaggcttacctcacagaacacagaaaggatgaacaacacagacaaatcagacaacgcagaaacacatcccatgacacccagacttgctgcacagcattcagactcacactatgacactcatactcactcaataacactgattgcttcacaacatacgcacatagcccaaaacacacaaacatcatccacaactaacagacatgtcctacaatacaggggcatgccacacaattcacaaactttttctacactgccaacacttgtctcacataacacacacaaataaaaaaaaaccacaaagacatgctccatagcacccagactcgcttcactactttcagacttaccttatggcacccacacgtaccttatatcatacacatttaccctgcaacactcagcctggccacagaatatatttacatgtccatgccccacaacgcacgcacatgccttccaacacatggacacacccaaaatacacaaacgttttacacgacatacactgaccccaaagaatggcatcataatgcacaattataaccaactcagatctaccctacagaacaaagactcacctcccatacttatcacacaattcctaaatttacaccaaacactcacactcatcccaaaatgcataaacccaccccagaacacatgcagcacaacacgtagatttgccctcacttagaataaattcacagctcacacttgtcacccaatggccagacacaccttacaatgtacagacaactctttcacaacgtagacattgcctaagcaatgcacagaattccataacatcacgagctcttcctacaatggcgacttacctcacagcaccccagattgcatcagagcagacactccacccaagatatacggcttcttccacacctcctggatacacctcacaatacagaaacatgccttgtaagatatagatttctcagaaccatgaagtattgcataagaacttataagcatttctcaaaacatatactccataattaatggatacacaacatctgctcacattctcaaacacagacttgccttcctccccatcacccgctgccagcatagtcttgtgcagcaggtctaagatgtactgcagaaaacagacttgccccactctgtatggagttctacccaactttcaaattcattctacaatgcacggaccttccctcttacctatagcattatcccacaatgcagagacttacccacaaagcaaatgattacctcagaatgcacagagccaccagacctgcacccaaacacacagacatgtaccacaacaccaagaaacactccacaacatgcatatgagcccacattggtgtctccataacttccacactaaccactcaacacctagaccaacttactatgtcatacatgctccatgacataagactcccagcacagcccatggaaccccgtcacaatgaacaattattatttttttaagatggattttcgctcttgttgcccaggccggagcgcagtggcgtgatctcggctcactgcaacctccgcctcctgggttcaagcgattttcctgtctcagcctcctgagtagctgggattacaggtgcccgccactacgcctggctaatttttggtatttttaatagagacggggtttcaccatgttggccaggctggtctggaactcctgacctcaggtgatctgcccaccttggcctcccaaagtgctgggattacaggcgtgagccaccacgcccgaccgtgaacaattttacctcacagtgcaaaaattcacaaaatgccaagacttaccccacagctaatccaatattaccgtaacacctaaagttgcctgaagagccagtcatgtaccagagtactacacatattcctcacaatgcctacagtgaacctacaagaaactgacttgccctgtattgctcatactcacaccaggacatgccctataacccacagataagttccataatgcaaaaatctccctaacaatacacagcctcactctacaacagacaattattccactatgagaagaagagatcccaaatatccagccttacccatgaactcacagtcttgccacaccacattaagacatgtcttacaggccgggcgtggtggctcacgcctgtaatcccagcaccttgggaggccgagacgggcggatcacctgacattgggagttcgagatcagcctgaccaacatggggaaaccccatctctactaaaaatacaaaattaactgggcatggtggcgcatgcctgtaatcccagctactcgggaggctgaggcaggagactcacttaaacctgggaggtggaggttgcactgagctgagatcacaccattgcactccagcctgggcaacaagagtgaaactctgtctcaaaaaaaaaaaaaaagaaagaaagaaaaagacatgttatcttataatgcacaaactaactccacagtacttagatacaacttacagaggacacatgtaccctatgacagaaaggttttcctacaaacacaaaattgcattctgatgcacagatttacccccaaatgcacaaaatcactctgcaatgcaaatgccccacaaaaaaccatgtgccccccaacacccagaattaccccaggactcacagacttgcaccacaggatcaagacctaccccatattgtacggatacgctcctcaccaggcatgccttttacaatgcagcctcaccccacgaggtacccttgactgaaaccctagatacagcctacagtgtacttacccccacaacaacgtggaaaactttctaatgaaaggtgtgtccttcaatgtacaaaatatcttgcaaattcatagacattccccacagtctcagaattgccacatcattttcagactttcttccaaatgcagacttactctaaaacacttagaatcaaattagacatacagactcaacccatgtgagattctccccacagtgcactaacgtgctccacaacactcagactctcctagaacacacagaatctcatcacaacctcacaccaccccacaacgccaataagtgacctacaaaacataaaaatgtacgtgacaattcacaacaagcatcacaatgtacagatttgccgcacaacactgagacacacaccctgtcatccacagacacatcctatcacatgaaatcaccccacaaaacaagccatcacacaacacaaaaacccacagttcaagacatgcttaattataacttgacataccccacaacacacaaaattgcattataatgcaggctgaccttgtagcacacagagcggtcctatagtattatacaaacacaaccttcgcctgcaccccagaattgcctctaaccacccacattctctttacaacaccaagacacacctcatatcacatcgagaatcagcctgtatcatatagtattgcccgaaaatgcacagaattggaccgcaagttccagaaatgccatactaggtgcagacagagcctcattcctgagggactaccaccctcagaaaaaaaaacaaaccacaaacacatagatttcctgtaacgcagagacacactataaaatgcaaagattgccccatcacatggagatttactatagctgtccagaatcaacccataaaatatatagtctcaccgcatgacttcaagacatatcccacaatatacagactgtcatgtatagaccacaacacctggacatgccctacaatgtgaggacatgatccacactctgtagactacccgagcactgcatataattgaatccagaaaatcataatcataaaagtcacagcacctagaatcactcccacaaagcatgctcaccccaaaccagatgccgatgaccaactgggtccatgctttatagagatagcctatggtaaaaaggaatttgagaggtaaaaaggaatttgaggagaaaaaagaaaaaatatatagaaatatacgacaatccacagctttcccatgtgccatttatatatgcctcttcttttcttttttcttttttttttttttttttgagacggagtcttgctttgtcaccaggctggagtgcagtggcacaatcttggctgactgcaacctccgcctcccgggttcaagcgattctcctgcctcagcctccccagtagctgagactacaggcgcacgccaccgtgcccaactaatttttgtatttttagtagagacggggttttaccatgttggccaagatggtctccatctcttgacctagtgatccccccgcctcggcctcccagtgcgctgggattacaggcatgagacactgcacctggcctttatatatgtctcttttaatgtagagaacagcctcgcagtgaagacatgtatcccacttggcacagatcggcaccacaagaaactccctcacaggacctacacttccctatactttgaataacccacatacttgatcatcacccactttcctatcagaacgactcatgccaaaacataaagctcattattccaaaacacatagaaccaactcccaatgcaaagagacttcccttgtaacaaaaagatgttctctgccacactgagacttacctcacctcaccagacttgacccacaacatctagccttgcaccactacacagagacatgtcatttcaccgagaaactagccccagaacactcaggcttgcctcatggtcgttatatactcataccttagactcatatcatgatgcggaacaggcatatacagggaaaatgtaatccacaacgcacatgctcagtccacaacgcatagacttgccccatatttcacagctagctcccataattcccagacttgttacacaatactcggaaggccttacaacacctagaaaaagcagcatgataggtatgctcactctagaacattcagattcacttcataagggacaaactcagtcagttacattgaatacccaacaccatattgtttgctccacagaatatgagagagggcctacatgctcacacagagctttgacaagtgacttcatttctttctttctttctttttttttttgagatggagtcttgctctgctgcccaggctggagtgcagtggtgcaatctcggctcactgtaacctccatctcccgggttcaagcacttcttctgcctcggcctcccaagtagctgggattacaggtgcgtgccaccagacccagctaattttttatatttctggtaaagacggagtttcatcatattggccaggctggtctcgaactcctgacctggtgatccacctgccttggcctcccaaagtgctgggattacaggcattagctagcacgcccagccaacttcatttctttgagtctgtttacctatttgtaaacatggatgcaatatttacttttagactattccaaggattaaatgagataacttcaggaaagaatcaaggttcagaacatagaatttagaggcagacttgcctgcttccaatcctggctctaccactccctggggctattacctgggcacattaggtattgaaatgctctgtggtagagcacaaggaatatgagtttggtgtctgtcagacctggttttgaattctgtctctgccacttactggccatatgaccttaggcaaggtactttaattcaccaatcttcagctcctcacttataaattggggatgatggtgttccctgccttcgaggctgttgtaaggattaaatgatgcctggcatcttaatctaacaagcaagaatgtacaggcacagacaccgactcacacccaatgcgtgaatatatgtatattatgtacacatggatacatagacatgcagaagctcacagagatgaatatttgcaagcagtaaacataaggacaaaacgtccacatggacacagatgccattttgtatgcctggactcgtgcagagataaatacaggtgaatacagatacagtcccacaaacttacatatgtacacctagacatggctacagcccccaaacaagacaggatttcacccacttaaatgatgacacactcaaaacccccattacaggcaaggcgtggcagttcgtgcctgtaatcccagcactttgagaggctgaggcgggtggatcacccgaggtcaggagtttgagaccagacaggccaacatggtgaaaccccgtctccactaaaaattcaaaaattagctgggcgtggtggcaggcgcctgtaatcccagctacttgggaggctgaggcaggagaatcgcttgaacccgggaggcagaggttgcagtgagccgagatcgagccattgcactccagcctgggcgacaagagtgaaactccacctcaaaaaacaacaacaaaaaacaaaaacaaaaaaaaccattacaggcccatgcataaagagctctataaatgtacttgcatatatagacatttaaatgcacaggcagatgtacactcagatgccatgtatacccacacagaaataccgaagcagactacatcctaagcatgtaagagacatacacatatatctatagataatacctacctaaacacactttagacatgcatatgtacatatagacatccactggcacacaaatgcacagatgtacagacttgcaccctcacgtgtcaacatacacacacgttggcatgcacatatccacactgttctacaaatctatgttcgtgacatacaagtcctaaatgcacattgaatatatgtatatacacgtatacatgtgccagtgtaggtatatggatgcatttatagacttaatcatgccacaaacagaaacagatttacacacgcacagacattagagacacatgcaatttatacatatgaaaagcagagacacctaaccacgaagaagcacctttacaaaggtggctatgacttttttttttttttctgagacagagtcttgctctgtcatccaggctggagtgcagtggcgtgatctcagctcactgtaacctccacctcccaggttcaagcagttctctgcctcagcctcctaagtagctgggattactggcacccaccaccacgcctggctaatttttgtatttttagtagagacggggtttcaccatcttagctaggctggtctcaaactcctgacctcaggtgatccacccgtcttggtctcccgaagtgctgggattacaggcatgagccactgcgcccagccgaggctgtgacttttaacgtgtccttgtcttagtctcttcaagagagaatgaaaattatcaagctcctgctaaatacactgtgtaaaagtagatgtggacattaccagaaggatctctaaaagattttgagttcacatgtgagtatgcacacacctcacaaacccacgtgcacatgcgctttcgcgtgcacagaatcagagatatagcatcacatggaatcacagaaatagaaacatgtgcatagccacatatagaaagatacatggacagacacacaccccactgaaatgtcaaactgtaatatttaaatgcatgtctattgaagttaaaaaaaaaaacctgcatttttatcccagctccatcacttactagttcaatgatttgaggtcattttcttgtcttctcacctgtaacatgagagtaatattagcacctatcttttagagttctttgaagatgtagtgaaatgaagggcttagcccagtgcttagaatgtcatagatgttgctgcttattgctgttatcttttggttttggtacaaagtgcttagctagataggatttggtttttgtggtcaaactgcatgattatatcatagagatgtattaatcaactttttttgtaaaggtattaataaagaataatttattaatgtaatatagattacatccacaaacaaggtcatttctgaaattctcagcggtgataagggattattactgtctctggcaaatggaaagacctgaaacaaatatttcctgctagtgtggtttgttgttattactgtcgttagtattcttttcctcttttcaggaggagatggaagattgagagcagagtgcaagaatgggaagagggcttcgtgccctgtgcacgtttgccacctagtgaccaaactgagtaagtaccgtatttgtggattgctcagaaacgtccctaaaacttcactcattgcaaggttgtgtaaccaccctggtgaataagcacgtatacatcaagttatagcgatttctgctacatatgtagaaatttttaaaaagtcataaaataaaaagaaatctttctctctaacttttccccctgccgtcccaaatttccccgtggaattcattgagaccgtgttctatagcagtgatctttgtactttctaattatttaccacctaacatcattttggaaaatggtctactccatcacacatcttgaagtgaacacctgaaatttcttatcataaatttaagtatttgtaacatatttccagcatattatgaatactccgacttttaaataaattggtttcatcaaatttttgcatgcaatgaaataaaaataccatacccatttgatattcataattgttgatttaaaaaaacatgaacaaggtcttctttagcagtcagaaattttacgtaatgtttctatctccttgaacttgccattccattcaacttccctcacataatgtataataatgaatacattttcaatatttaaaggccccttattcgtcaccttaccatacatgcctgcaaaaagcatacaagaattgaaaaaaaatttctgtgactctatgcctcaaaagattaaaatttttatcataaatttattagtagtacacaatcagaagaacttaaaatattacacatttggtaagtaatcagtaaaatgaaaagtaaaattggttggaaatacatcttttttttttttttttttttgagacagagtcttgctctgtcaccaaggctggagtgcagtggcgcaatttcacctcactgtaaccgccaccttccaggttcaagcaattctcgtgcctcagcctcctgagtagctgggattacaggcacgtgccaccacgcccggctaattttttttgtatttttagtagagacagggtttcaccatgttggccaggctggtctcaaactctcgatctcaggtgatccgctcgcctcagcctcccaaagtgctgggattacaggcatgagccaccctgtctggccaaaaatacatctcttaagtgaatatgattttattttccccaaactaatttttgaatcggagaatgactcttacttatttctaatgagccagacttcagttcctgtccttcatttttatagataaaagaactcagaaaattttgttcccataaataatcatgtagtgacctgtcatcaaaaataatttttaatgattaaaaaaattttaactaaatttttgatgtttaacagacaacttgattagacccatctttaattctgtgaaagcaaagaaaccctctgatttactaaaggatttgttgttcagtcactttttttctgtttctgggaagtttactaaaatggctttccccaaatttattacataactattatatgttatattttcatttgaggcattatttaaaattcattatacacataaaaggttgtgaaaatcaaagtacttagatcaatatgtctttgccaatacgataattttgataaaatggtatttatttatttatttatttatttattgagacagagtttcgctcttgttgcccaggctggagtgcaatggcgcaatctcggctcactgcaacctctgccttccgggttcaagcgattctcctgcctcagcctcccaagtagctgggattgcatgcatgtgccaccacgcccaactaatttttgtatatttagcagagacggggttttccatgtttgtcaggctggtctcgatctcccaacctcagatgatctgcctgccttggcctcccaaagtgctgggattacaggcatgagtcaccacgcccagcctttaatttattatattctataaatataagaacttgaggctacagatttgaattaacaattttataggaaatattcataatttatttggcaaaggcagtattcatataaaaataatcaacaaaatcagatttactttcagaaaaagtgtctgacttcatttttcaaggaaaaaatattaatatacgttttgaggtgcattattaaaaccatggataaatcaattatggagcaccttgttaaataactagcaaagtaaatatcatattaaaataaatatgaggcttttatccacttcaaaataaattaagaaattaaataataactttgtttctgatatataattttaaattaaacaatgtagtatgtggttaccattataagtcatacatgaaacaaggaatctgaaggtaggcagaatttctcatgtaaatatgtatgtatgtgtttttagaacattggagttgaatttcttggaataattgactaagaatagcatatacatttttttttcaaatccataaacttcattagaccatagaattaaagttttctttttcttttcttcttcttctttttttttttttttttttgagacagagactcgttctgttgccagcctggagtgcagtgagttgatctcggctcactgcaacctccccctcccaggttcaagctattctcctgcctcagcctcccgagtagctgggattacaggtgccctccatcacgcccagctaatttttgtatgtttagtagagacggtgtttcaccatgttggccaggatggtctcgatctcctgacctcgtgatccgcccatctaggcctcccaaagtgctggcattataggcatgagccactgtactcggcctagtatcaaactttttaacgatattttatgaaagagtctaaaaaatacttgctaaatataaaactagcatatcattttatttttgataataggaggtagaaagtataaaggttatttataaaatgaaatgaagattgatgcttttttcttttttctttttcttttcttttttttttttttctggagtcagagtctcactcttttgcccaggctggagtgcagtggtgcaatctcggctcattgcaccctctgcctcccggattcaagtgagtctcgtgcctcagcctcccgagtagctgtgattataggtgcgagccgcgacacctggttaatttttgtctttttaatagaggcagggtttcaccatgttgcccaggctggtctcgagctcctagactcaagcaatccatttgcctcggcctcccaaagtgctggcattacaagctttagccaccgcagtcggctgaggattgattttaattggaaaagatattttacgatacagtctgagaaaacaggttctaacaagtttaatacaatgatcacataatttctgaaataaattacataatttcttatttaatttttaactttttaaataattttgatacatttgtacatacttatgaggtacatgtgaaattttgttacatgcctagaatttgtaatgatcaggtcaaggtatttagggtagctatcacctgagtatttatcatttctctgtgttaggtacatttcagctcctctcgtctagccattctgaaaaacacaatgcattgttgttacctatagtcaccttactatgctatccaacactagaacttattccttctatttaactgtgtgttcgtatcaattaataagcctctcttcatccctcccctcctgcctatacagccttcccagtctctggtgtctattattctactctctacctccatgagatcaacttttttagctcccacatatgagtgagaatatgtactgtttgtctttttgtgcctggtttattttacttaagataatgacttccagttccatccatgttgctgcaaatgataggatttcattcctttttatgacccagtagtattccatggtttatatgtaccacgttttctttatccattcatctgtggatggacacttaggttgattccatatctttgctattgtgaatagtgctgcaataaacatgggagtgcatgtatctctttgatatattaatttctattcctttaggtaaatacccagtggtggtattgcccatttctatacataagttttaccaaagtctaaatattttttagtactagaatacagtccaattgtgttgaaaagaatcagtgtcagcaatatatactgcaactagttaggagatgctcttttttttcccagttgatgacacacgtttgtgattaatgttgagaatagatggaaaataatgcttaattttaagcatgtgggaaaaaatggtgttcttaggtagattcattttaagagagaatacacgtaagagttgagcacctgaaagtggattcattgatactgttcctactcacatacttcttgaaaagaatttgtgtaacagtagcctagtgtgaagaccaccgttctagtctgtctcctgcaagattgttccagaacaatatattgttgtaattgttggaataacccatttattgtagtttatgttcacaaccatgcaatggaagtagttgtcacttttgaatttctgccagatgcttctgtgagtgatcatgtttgagcaaaatgtcctggaagggatgtttttgttttgttgataaatacatattttgactaaacttgttttgtccagtttgggagccacaatcacatgtggctatttaacatttaaaatgtggctagtacaaacagatatgctgtaagtatagaatacatactggatttcaaggacaggacacataaagtatttcactaatattttatgttaattacatgttgaaataatattttgatgatatagaattaaatagtacatttcactaaaattaattttacctgatttttagacttttaaaaaatgttgcaacaagaaaatttaaaattacttgtgaagctcacattgtatatattatatgacagtgctggtctaaagtttatattggaaatctctctaagtttccctaaaaccacttctatggaaaaaattgattttccactaatctggttcagtatactgctattctgatgtaacgtgtgccttttactagtttttgggtttccatattgggggatttttagtagtaagcaagaaaaagtttaaaaagtaatattccagtaagaatattggaaaaaacatctattagtacctagacgctttcccatatgaactttgaaaggcttcttggtggttacatgtgaagcttttcagactcttcataattccagtggtggataatgcattctattgaagacatgaagtatttaatcacatctgatttctttttttttctttttgagatggagtttcgctcttgttgcccaggctggagtgcaatggtatgatcttggatcacagcaacttccgcctcccgggttcaagcgattctcctgcctcagtctccctagtagctgggattacaggcatgcaccaccacgcccggctaattttttggatttttagtagagatggggtttctccatgttggtcaggctagtctcgaattcctgacctcaggtgatctgcctgccttggcctcccaaagtgctgggatcacagccgtaagccgccacccccatccacatgtgaaacttttttatgtaattatttttatgtaacattaagagaaaaatacacttccagataaactatgatgtaatgctttcatattcatagaattttaattttatacttactaatgagctcttttagacttatttagatatatatttttattatgtatcatgatataacaacagccgtgaccaaatttgagcataaacagacaatgtctacccctattcaaccaccttctggcccacagtgactgtaaaattccattgattataagatccattctgatttcagtaatatgaagtgtgattaaaaaaaaatatgcatcctagaattgattaaatacaccaagtcatttatcaagagaaaaggatcatggagggcagaaagtcaaactggaagacattggcctaatgaaaacaccttttctatatattatcgtatttacaaaacttaaaatgtgattctctttaaaattttatcagagtcctcttaaataacatttcattatacatctcctcataattggtatttcatggttttcctggcattctgttctttgtttcctggtttggaagtgggagggctagggaagaatggtgacatgtggggccagggctgggacagaccagatctctccagactgaaaaggtctagtacctccattgggagaactgcttagcactgtcttgtgtgaagctatgacttcaatgactctgtttttcttcataagtaagctgacagatggagttctcctcgtcaaggcttagtttagtcttaacataatcagtataccttttcttgactgaagggtctaagaagggaaggaatgaagattgagcagcttctctagtttttgttttatattatatttgggaggtcagcaggatgcatcaaaatttcacaggaagtacattatctcaagaatcaataacataaaatcgagatttgtcaaccaggaattatggcacatccctgattctaatgatactcttgatgatatgagatttacaagaagtaacaaagtgaatgttttttttttgcaacgagaagaataagagaaccaatgacctgttttctctcttgtccctacagtgaaaccttacattaagacttaggtatttcttgagggtttagaagcaaggccaacttcatgagcaaaaggggcttttgcacagggccccttgcttacaaaggttccatacttggcttaatgctctgctgtcactgtcttgaaattcttaataatttttgaaaaaggggccccacattttcattttgcactaggccccaccaattatgtagctgattccattcaaaaggagatacttgccagtgaacaattaactgaagatgcaaaataaaattagaagcattcctcatgtgcactgaattcttgctgtcagctcataacataggattcataagctattattgctgctattgtgttgttaggaatcatagttgtagaacaggggtagttagtacaactcaacagtaccttatattgactccttatttttccatgatacaacctggggcatcttctgtgtttctagtttctcatctataaaatgtctgtgacattacacttgccctgcttaaccccagataaggcaattgttagaatcaaattgaaattccagtgaaagtacattgtgacctgcaacagttgaaacagtaaaggttgaaacagatgtaaaagatgatttattcctctctagagcttggagcctacgtggcaagcaccagccaggggctctagggatctgaattagactcagtagtgaggctgctctgacccatgaatacagagtaaatattccagtgggtactagagccaggaaatcatgcctttaaaatttcaagagtccaaccagggcatcccactgttgtcaaaagggctgggttgaggcacctggatgcaaattgcagaaatgcacatagggttagagggtttggaagagagaagaggaagtgcagcttgaagagatcctctgagccactggggcatggtcacaagcacttgtcttggacaccaagatgaaggagggaatggccaagggtgcccgccatctcagactaacagaagttttcctgttacccagaagagaattgtattcagagctgccattacctgagtaaggaaaggactcttttgtctctattgtatgagggaactcattttcttggttgtaaaggggaatagctcataatagagaccttggggaagtcaggaaataccagatggctccaaatgcaagaatgcctatagatgattgccttctgtagtacatcctgaggtcttaaacaattacagcatcttgctatgaaatgcaatggacagaggtgaaagtagcagttcagatgaggccacagaaaatgccagttgaaagatgatttgcaaataatcttggcaatgctttttctcactgatgggagatggcgaacaacagtttgctttatttcacactgtcccttcggcattgctggcaaaatgggcagtgtgctcctccctgtctctcagctctcatcagtcccaggtaatcaacttaatttaacctcactgcatctttgtagggaacttctaatctatctttacagtaaatagactgaatatattggttacatcttacctaaagaaagctttcccaggggcactttgttttgcaaaagtttattggaaaatttttgtgtaagttggattatggttaaaattattgagtggagcttattaaaaggttttgtgctgaatatcttgaaaaaccaccaattgtacctgatatatattttttaatatgtagggctcttagcttgattagtgtagggtacactcttgggatttctatgagagaggaaggtcaaaatcttcaagtaagtgactttcctattggcaaagtgaggattattaattcacggttaatttgagctttgctcttagatttgtacattgaatccagggtactcaaaagcggacagaaacacttttatttttcctgcatccccccaggtagatccaagtagacaactttttaactttcctttttctgtactatattttgccctactgaaatgtggtctcttttgcaagtacataaaaaaaatcaaactacttaaatcccctaaagagagagtatgcattcaggcagtgattctatatcctgagatttgttcatattcatgtaggcagaaaattccggcacgacaacaaggtatccctctaaaatacgtatatggaaagcaattagtgtgactttgagctgacaaaacactcggtgaatagcagaaagaatatttcttggtaaggccttatggtagaaggtgatagagagagagagagagagagagagagagagagagagagaggaaggaaggaaggaaggaaaggaaaggaaaagggaaagggaaagggaaaagaaaagaaagtggccaggcgcgtattggctcacacctgtaatcccggcactttgggaggccaaggagagcggatcatcagagatcaggagttcgagaccaggctagccaacatggtgaaaccccgtctctactaaaaatacaaaaattagctgggcatagtggcgggcacctgtaattccagctattcgggaggctgaggcaggagaattgcttaaacccaggagacagaggttgcaatgagccaagatcacaccattgcactccagcctgggcgacagagcaaaacgctgtctcaaaaaaaaaaaaaaaaaaaaaaaaaaaaaaaaaaaagaaatagagatttatatctggtaaaatgtcaggtatttgttattaggtcattttgattagacagggacacgcagatgagagacggagaagtaacaggaagttttgacaaacttcgacacttggaatcagggcttaaggatgatagccgcaagcttatcagcttctgcagtaagagagtttttttatgtttattctgctttaattgcacagtagtgagacaatccctttctaccctgaatagtaatgcatttcacttgtccaactttatattacccaacatgagttgcgtgtgaatttttacaaaaaaaaaggtaaagacagccttcccaactaatgatacagttataagacattaaaatatttgcacagagaaagcaagaaaatctttattatggggcttgcacagagtctagttaatctggcagtattcatgtaccatattgtgaagatacaagcacgtgaccctgcgagcagttacatcaatagtcattttgaaggatttttgctgttaggtacagggaagccttccccaaaagaaagtcgagaggctttccctccacctcctcctcttgaccttggagttgctaaaatttttaggtgttgctactgactgtgtagacctgggaatatcagaaattgctgaaattgtttcttgtacgtgcagaaagaaggataggaatgtagtattttaggagtgagcattcatgaaaaggctgtttcctggctaaaatgatacagtatatttggttgcatatttctgttgggaaatgaggaagaggggtttattgcattgtgtcagaatgcaagggtaaggtaggtaggagtatttgcatcattttgatttttttgcacctgagtttgtacactaggttcaggctgccacaagggctgcaaacctggcaaaccaatagcaaagagccaacttctgatctgttactggttcagatcagagacttccagctgcttcacaacttggcttggggaggatgagtcacaatctagatcagttagggagataggaggtaaagatgtggttggacatctgcatttgtggtaaagagagcttgagcattacttctaaacctgtgcattttgagaggctttcatcacaaaggagcccacagaggggagttgattgctgtgcagaggtcttggttcaagcataaagatgcttgtatgtgagaagctggtagtgggaaacattctctggagggctttgtgagctagatggatgattgtcatctgtgcaggtgcctataggtaaattaggtcaagcccagctctagtttggattagagcttttttttgggggggggggtggggggaggagatggagtcttgctttgtcgcccaggccggagggtagtggtgcgatcttggctcactgcaacctctgcctcccaggtgcaagcgattcttctgcctcagcctccctagtagctgggattacagatgcacaccaccatgcccagctaatttttgtatttttagtagagactgggtttcaccatattggccaggctggtctcgaactcctgaccttgtgatccatttttccacccccgccccaacccggcctcccaaagtgttgggattacaggcatgagccaccgcatccagctggaccagagcttttttaagctacctgcagcattgtctaaaatccctgctgtgttcccagaccaaccaagagaggccacacctgtcagcgaaggtaggttgaaagctaagcaatgacctcacttatgatataggaaaaatttccagtgcttcccctagaccccagttgagaccgaggacaagacaagggaaggtgatgatatagtcttaagagttgcaaacaacccttaaaggccatttagtgtaatcgctatatctcagttttgaaattcccaataaaatatctctcctacctctgcttgaacatctccagtactggggagcttggtgttttctaaggtagcccattcagtctctggccatattcattagataactcttcctcacattgaactgaaatctgcctcctttgatagaggttctgatctcttgggcaagtcacctcctgcggatatatgacccttttgatacttgaagacagcacctatgtttcatttaactctttgcttagctaagtttttctcaatcctcatttgacaattttgaggcttctgttatccatgctttttcctctcaacagtccataggccagggtaccaaagtctgacatagcattcctggtgagtctgaccattcattccctaagctgaacatcatttctctattgaccacatgacatggtcagattgcattgtcgattcagccgtagtttccagacagtctaaacccagctggaagatgccccaatgctgcttcactaagaactacagggataaccagtgcttccaaccaaaagtatttcactactgaatgtaggtcctggtgacacagcaagtaataaagtggagggtagaaagttatctggttatattttttgttgataactttagtgtctatttttcttccctatattatccctagtttatccactggtcatttcatatgctgcctgggaccaggcccaagaaaatatggaaaaatgcaacttacataagattgaggaattttattagtcatatacactgctcacaacaaatcaggagtgaacttgaaactgcctttctctcttcacgcctccctccccagccacagtgttaggaatgaatgacactgcctgcaaatagaggaaaagagaacttggtcacttaaaaatatagcattctaattttttcttccactaggttagaaaatatttatttgattaacaaactgtagtagtatatatttatggggtaccatgtgatgttttgatatatgttgacattgtggaatgattaactcaaactgacaaatccattacctcacatacttaatctttttcgtgttgaaaacatttaaaatctactcttttaactacttaactttttgtggtgaaacatttaaaatatacaatgcataattatttattacagtcaccattctgtgaaatagatcactaaagcttattcctcctgtctaactgaaactttgtatcctttgatcaacatctcccctttccccgttcctctagattttaactaagtttgttcactacatgggctaaaaagtgcgatatattctttatctaattaactaaataataatccccagtagaatgtaaagaaaatgtgatttggcagatttatgcttcatatagttggatgagagagggatccagtgtgaagttacattttgagaatattcacattcctgatggatttgtacaagtagcacacatcacaatgatcactcacttacaatcatgtaatcaacacttcatacaagggctaaactaaaaattataagataggtgacagctactaatgtatttatggaggcaacagaacaaactatttggtattagaaatgtgttgagtaaaaagagccgtgtgcttgctgggagcaactaatgaagagtttgcttacattgtcccatatttatgattatgtgttctatcaccctcccactccacccgtgacatttactatatttactgttctaactcctttcctgagactggagctcctgcagtatctaccttacaaactgcatttcgtcacacacactgactcactccaaagccagtttcaaatatggttccttcttttggccctaagatttgaaagacagggcatgtaagtttctaaagcacaactgaatccatcttaacaaggaaaggtaaatacattttccctgcagtttcaaaattttccacaataaatgcataggagttttcttagtaggaaaaataataaatgcaacaaaaactttgttgtatttggaagtgttctgaaaaaacatttaggtatggggtaagatgggctggaatttgcatttttttcaaagtttggaaatctctgaactgatgaataaagaattacatcgggctgggcacggtggctcatgcctgtaatcccagcactttgggaggccaaggcgggtggatttcctgaggtcaggagctcgagaccagcctggccaacatggtgaaaccctgtctctactaaaaatacaaaaattagccgggcatggtggctggagagcctgtaatcccggctactcgggagattgaggcaggagaatcgcttgaacccgggagaaggaggttgcagtgagctgagatcgcgccattgcactccagcctgggcgggaagagccaaactccatccaaaaaaaaaaaaaaaaaaggaattacattggccttcactgaattctggcctggcttttcatgcagaacagtacaggcattgtaaacatgtgaagccaggtgtactggctttgatttttgttttcctccagctggcagtgggctaggatggctgtgcccaactatcttcactaagagttgccttatttttgaagacgtggaattagctatggaaagcaaaattcctctggctgtgcctttggtgccttgacctatttggccacatcccatccctgccctggactcttctctcctctttgtccaacagtttttttctgagacagagtttcactcttgtcgcccaggctgaagtgcaatggcgtgatctcggctcactgcaacctccgcctcctgggttcaagtgattctcctgtctcagcctcccgagtagctgggcttacaggcgtgtgccaccatgcccagctaatttttgtatttttagtagagacggggtttcgccatgttggccaggctggtctcgagctcctgacctcaggtgatctgcccgcctcagcctctcaaagtgctgggattacaggtgtgagccaccatgcctggcctatccaacagtttctaaggaccagagtagacagtggatgacaacatcttatgcagttaaaggggcatttcatgatcctttacagataaacaaactgggatagaagaatataaaatattaacttccaccccaaaagaagccacctcatttttgttttaatgaaagtttgttaaagtgatgaggttacaaattaatataaatgtttgggaaaatatgcttcttgtttagagaaagtgggaccataaaccagcaaaagtatttcactgaatttcactttaatggctgcaggtgaacacttgatctgagagtggtacagatctctttgtctttctattcaccctctttctcttccctcaacctaatcagttaaaggtcagctctctgacataattgcaatccattttattcagacaatgaaacatcttattattgagtgccagataagtaccccattgctatctaccatcaaacaggaagtcagaaaataaattcaacatctaactccactattaactagttgggtgatctttatctcattgccagttttctcctttttaaaatgggaagaacaacaatatttgctgtggcttcttcacagggttattgtgagggcaagtgagaaaataggcataaacacacattataaaataaaatatgatatatatattttatatatgatatattttatctatgatatattttatctatgatatatatattttatatatatgatatatataaaatgtatataaaaatatataaaataaaatatatatattttataaactaaaatatgatatatttatatattgtgaagtattataattgttaattgtaataataagtataagtaactttttagatgtggaagacaatattgcatttaatattagtggcatttattggtccagtgaaattattacaactgtagattttagtgtatacttctgattctcagataaaatttgcagacatgttttgatgtactttatgaagataagagtaattcagctgaattagactctagctttttcttacaactggtcacttttcatgagtgtaaaaacaggtggtttatccaattctgaaataccttttaggtgacaaccctgtaacatttcatatgtgaggcggttgtctagatgttacattccagatatctatagtttaaagaatataaaactttttaacattaggaatttgccaaaaacattctgtaatcatcctgagtaacagggatgggaaagtttttgtgatacgttttattttctctaatcttgaagttaaactaattggtccaatttttaaaatagtgaataacaaagactggaggagccagaatagaggagcaacttgaggctcagtgaactgcccagatatcaaggaagaaggaggcacacagtatgcagattctccaggggagaagacttagagtctctacaaattataagaagtaggggaggaggaaagacagtgatggaaggaggaagagaagtaatgtttgtgggtaactacttgacaagtattttaagttttgcagttttaatttagtttagtttaattgaatttttgagacagggtcttgctgtgtctcccaagctggggtacagtggcacagtcaaggctcactgcagccttgacctcctggactcaagtgattttcccaccttagctgcctgagtaattgggaccacaggctcccatcaccttgcctggctaattttaaacatttttttgaaaagttttttgtagagacgaggtctccctgtgttgcccaggctggtctcaaactcctgggcgcaagtgatcctcctgctttcgcctcctcaaagtgttggtattacaggtgtgagacaccacgcctggccaagtttggaagttttaaaaacatgttctacaagtccatcaatgaatgaatagataaagaaaatctggtatatatacacaatagaatacaattcagccataaaaaagaaaatcttgtcatttgggacaacatggatgaacctggagaacattatgttaaataaaataagccagacatagaagataaatactgttttgtcttcatatgtggagtgtaaaaaaagttgaactcatgggagcagagagtagaatgatgtttgccaggggctggggtaaggaggagacgtttgtcaaaggatccaaaatttcagttagacaggaggaataagttcaagagatctattgtacaacatggtgaatgtggtgaataacaatatattgtattcttgaaaattgtcaagagtagattttaagcgttgtcaccacaaaaataactatgtgaggtaatacatatgttaattagttaacatatgtaatatgtaatacatattaaatgtattacatgttaaaatgtaatacatttcacactgtatacatgtttcaataaagcatcatatacacaataaatatatgccatttttggtcaactaaaaataagttaatttttaaaaaccatgtctattgatagaggactgttttttatttcaatagcttttggggtacaggtggtttttggttacatggataagttatttggtggtgatttctgagagtttggtgcatccgtcacctgagcagtgtacactgtacctaatatgtagtcttttattgctcactctccacacatcctttcccggtgagtctccaaagtccattatatcattcttatgcctttgcatcctcatagctcagctcccacttattagtgggaatgtacaatatttggttttccattcctgagttacttcacttagaataatggcctccagctgcatccaagtttctgcaaaagacattatttcattgtttttatggctgagtagtattccatggtgcatatataccacatgttctttatgcattcattggttgatgaagacgtagattggtttcatatttttgcaattgtgaattgtactgctattaatataaatgtctgtgcatgtgtctctttgtataattgcttattttgttttgggtaaatgcccagttgtgggattgttggatcaaatggaagttctactttcagttctttaaggaatctcaataccgttttccatagtggttatactagtttacattcccaccagcagtgtaaaagttctccctttttatcacatccatgccaacatctttttttttttttttttaattatggccatttttgcacaagtaaggtggtatttcatggtggttttaatttgcatttccctgataattggtgatgttgagcattttttcatatgtttgttggctgtttgtatatccgatagaggactatttaatctgggaaataatcaccgtgagaccaaagcaagatgcatatgatataaaataagacttcataacctaaaccgatctgccagtgggaagaatacattttgaagaggcttcagtgtctttccatggctggatcaacaatctgctgaggtagaatttcagaggaaacaagaatagttttgtagtcaatgcagggtattaagggcctcctgaagagattaaatgaaaaccttattgtagtccactactactttattaatgtggcaggcatattttgcttttcaaatttttcatttaatcttgtatttgtgaatattactaaatgtcttgggattaaggacttttaaaaagccttgtttacaaagcccgttattcagttccctgcagcaactcagaaaggagtctatatatccaccctacaggcctccttattacatagaagtttaaaaaaggaaaaggagagctggaagttttaggaggaacttggccaaaaggaagagagatgtttgcaatcgctccttcacctttgccacaaccattttcatatccctctcccttgatcccttggtgatgattatcttagggacaggacacagtagtagctccccctagctctggcttcttccagttctttaggcttttctcccactctgactgccactgcctttgcctgtggtgctgcttttcctcaattgggctgtttaaagcccatcccatctgttaaagctcatctcaaatgcatccctgtcatcccttccaccatgagcaagaaacaaatttttcagcaatctctgctatttccacgtctgaatagtcagtagcgacatcacaaaatcctgtcaactccaaggtctggaggaggagggagagggaacaaagcccctagatgttttgtgaggaagggcctgtctgtctctaacatcaacaatacttcacttgtctattgggtccaaccaccaggcatagtcatttgcttatatcttcacaatgtggtacatgaatatggccaggttaactgggctctgtgcaagccccatggtaaagattccctggctttctctgtgtgaacagcttgtaaaagtatcattgattatgaggctgtttttcactttttttgtaaaaaactcatgcccaaatcatatcaggtaatgtaaagctggacaagcaagaatgcattacttttctaggggaatggaaattttctcaccactgtgcaattaaagcagaataaagagaaaacactcttgcttcagaaactggtaagaccttagctttcattcttagtcctgatttcaagtatttgagtttgtcaaaactgcctgtcacttgtccttccctcatctgtgtgtccttttctcacatacatctactcaaaatgatataatgactacattcaactgggagcctcctgagttaattcggccctttagccatctcatgcttagtgtgctgaaattgatggttgaggaggcatcaaataagctatctacatcaaataagcctgctacaaccagaaaaaaatcccaacaaagtaagaattagttattttaattatttaacataaaatgtaaagtttctgatatatttggctagatgatatgattaaattgctgataacataattttgtttgttacatacataaatagaaaaggaagatcagtttctttgttgttttcaggattaaatactttttcgaaaattaagaaaagggaaaattaggacagatgccaccttttcaactaccagtctctttcaggatagtgagagcagactaagattccagagtctgtactaattagagtctatgctactaattatcagtataatttgggataagccttccactcttgggcctcaattaccttgttagtagatcaagacattggaccaaatatctatgggcactttcagctttgagtgtttgtaacttcgtgaaacatcttcgcctttatttttttatacagggccatgttggagtgataaccaatagggaagtaacagccatatacttttggggggtatgtctttgagcataatctcatggtggaagagtgccttagcttctagagctgtgttgtctagtaccgaggatgtgctatatatggaaaatacgtaccacatttccaagacttcttctgaaaattttataaaatatcccgttattttttatctttattatatgtggaaatgataacattttggatatgtttcgttatatgaaatacgttataaaaataatttacctgttacttttcactttttaaaatatgctattccaaatattgaaaatgatacccatggtgcctatatttcttttcttttctttctttctttctttttttttttttttttttttttttgaggtggagtcttgctctgtcgcccaggctgaagtgcagtggcatgatctcggctcactgcaacctctgcctcccaggttcaagcagttctcctgcctcagcctgccgagtagttgggattacaggcgcacgccaccacgcccggctaatttttgtatttttagtagagatggggtttcaccatgttggccaagatggtctcgatctcttgatcttgtgatctgcccaccttggcctcccaaagtgctgggattacaagcgcgggccaccgcgtccggctagctcctatatttctattggacaatcctggtctagacagttattcctgttatatttgacctgagttccagttcaaaaacctcccaaggttgaaaccatccaaactagtggcacttagtcttggatgcacactggaatcacactggcatattatgaaaaataatgatcccttcctccccatggttctaattaaactgactcacagtgacctttcttatgtgctctgaattttttccataaggccatgggtggtgtaatcataaaaaaaaagactttgttatatgaatgccagaaacttgtgtacatccaaattggacagctactggattaagggggcatgaatcactgaagcaggctgagccctgactcttaaccagtctcaagggcaaaactgtttctctcttcagtactcaaaaatctagcaaacagacaggaaatcgtaccttgaattaattctgtcttagctgctgcttcttgtttgagtttctgaaaatcagcttattatactgcatcttgtctcccagggagatacttgacattgcttggtctgttttcagaggggaaaatggagctcaaggagtgtggctatctcctaggtaaagaaaatttcttccagcagatttttttttttctactgggggatttttttggactcctaatatattgaaggaagtaaaagtagacaatgtggcttgatagaaattggacggacctctaacatggagcaagcagccatcgatttcatgttgatttctgatagcataggctgttttttttttagcctcaccctcaaattttggggttcaccctcactgaagtctgccatccctatatgctcataagatctatagttacttgtggttgggtcctagatatgggccttaggtaagaagggaagctgctcctttcctttcctagttgtcctcttgattctcagagccgtaggtacttgcccaacttctatggttgactaaaatcggagtcccggtaatgaatttagaacagattttcaaaataactaaaaacctaggcttttaaatcagactctattgaattgtatcttctgatcctggtaagtcacagaacttcctgacactacaggtgcttgaaaaagaggtgctgagctactgtgatcatgaatgtccatatttggtgccatctttagtggtggtaatatcttggcaaggtagtagagagttgataaaagctccagtaaataatcctgtgtgtccacagtgccttaaaactctaccaatcctctgcccaaggtttttgatcaaatactacttccctgagtgcaagattaagttaaaggtgtattcgttgtttgagttgttttggagtggctctgccacttactagctatatggccttgggtaagtaacttaacttctctgagctccacttgtaaaataggaatcataatatccactgcatagttttgtgaagctttcatgagttgctctacctattttccacactttgcacggtgatgcctccagaacagaagctaaagaaatgtttgtagaatgaatagatgaatttatgaatattaatcttgtgaaagtatatgcttacagaattgccctctgtttgggtcagtctaaaggtaccagagtttaatttggtagctaattgtcaaagcctaattagtttctctatcaaatacttagactcagcctatctccattcccctggcattttcataaaatagaggctagacattgatgggaagctgggaaaagcaccttctaccacagtacacattttgcagagatagagatattttaggggggtcagattgtccctaaatatgaaagataaatgagggtaagttctagtcaaatataaataaattttactaaataaggagtcattaaaatggacaagtacatattggatcagtatttaaatattattgagacatgtacatgtaagtgcttgaaaaaaaagtagaattctctgaactacttatataaacccctgcccaaaatagaacaataagtaactagggcctaacttttttagaacagctgtaaggggatagtactattaagtcatcaaagagacattacatggagccatggatttagattattttttgtgtcaggtaaagtttgaaaagataaaatcactgtttgttttttaggacagattttctgcaagtccattgtcatactacagtcataacctaaatcacatttgaatgaaactttgaaatgaatgaaactggaaacctcttgtacttaggtagttgtggctacagtgaataaaaatgacatgctttgcagttatgtaaagtgtagaaagactcaagatcgaatgccaattaataaagccaagtcacctgcacagcttcattttattattttttaatctcataaattattttctcttggcatctccatcctagaagctctatggaataggggaagggagcaggaacttgcaagtgtatcgggacggagtgagaaagagaaaagtagatgcaaccagagtaaggaggctggatgtacagccagtccagaaggtgctatggtgagctggttcacagagtcatttggggctttaccctagcccacatgcataggcaaacataaaaacatatgcattcacaatgtcattattttcaatttagttaacagcttttcaaatcaacatggtgtttcatagcaattaactgtaattacaaatccaagaaacattttttttttctgggtaattactttcctgattcttgttccatcattttcatttaattctgaaaaaaatttaactgccattttgacaagtgtttagtgtttttaaactgattgtgtataccctattacataagtactttatgcatacatttctacacacttttccccaatccaaaaatgtctataaatgtttgcagcgactccctatctggaggctggttgcacacttactctcatgcctatgattgcttggaagggactgtcaccactgccaaggaagaacgtttttgacaatagaactgccaattaatcagtggcagacgagagaagaattggctccatattttctgatggcgactggccacttggcagccagccaccaagtgagttattgatccattggaactcagcctacttggattgccatgatggggtttctgtcagcaggttattacaaccgtgcgccttgaggagatgaaaaaaatttaaaaagacaaacttaacaggtttaaactatctaaagtgaactatatgataggcattggcaagctgaatggcagaaatactgaccccttggatttagatgtattgaatgagtctctgaaattcaattaactggcccagatagcaactgaaatgctgtttgtggtgaggagggagaagattaaacagtactgatacttgcaatgagttcttaattagaagggcagaataaacggagggacaccaaagagataggatcaagctccagttcagatgcttatgagctgtgtgacttctgtttgtataattctttttgttttgttttttgagacagagtctccctctgtcacccaggctgtagtgcagaggcgcaatctcggctcactgcaacctccgcctcctgggttcaagcgattctcctgtctcagcctcccaagtagctgggattacagacaagcaccagcacgtccagctaatttttgtatttttagtagagacagggtttcaccatatgggccaggctagtctcgaactcctgacctcaagagatccacccatctcggcctcccaaagtgctgggattacaggcgtgagacaccacatccagcctctttgtacatgttttttagcgggataaattatatcatgtgtgtcaaagcatctaggactgtacttgacactgagttggttctctgaaatgtcatttctcttttttcctataaatcttagggttgtgttattttataaagaaccgagttttgaggatcatttcattctcagaaaatttatttttatgtattcatgatggcataggaatgactaattattaacctgtagacctatgtcttttttatgaacttttaaaacctttctaccattgtgctataatataagcattttaacctattatttatcttaccaggtgctaagataatgaccaggtgctgtaattattttattttaaaattatcaattattttattttcaatgatttaaaattgtgatgtgaaaggaatactagaattggaatacaattgcactggccaataaatgcagatttttctagaatatgttcagctattgtgtaaaaatgatgtatgaaagctacattttccttttttttttttttttttttgacagagttttgctcttgtctcccaggctagagtgcaatagtgtgatctcagctcactgcagcctccgcctcccaggttcaagtgattctcctgccccagcctcccgagtagcagggattacaggtgcccgtcaccatgcctggctaatttttgtttttatttttagtagagacagggtttcgccgtgttggccaggctggtctcgaactcctgacctcaggtgatccacccgccttggactcccaaagtgctgggattacaggcgtgagccaccgtccctggctgaaagttatattttccttataggtttttatccctttgttctattctcttggaagacgttgatatttgctctcctaatttctaccgtggcaaggcaaagaacaatgaattacctctaatggtgctactgacagtgacaactgatggctgcttgtctgtattggtgtgaatgataagcctggtaagctcacagccattctatcacacacaactcacctcagcctagatggctgatttctccatggctcagcttctttcatttattttattttatttttcttttcttttctttttttttttttttttgagatagagttttgctgttgttgcccaggctggagtgcaatggcatgatctcggctcactgcaacctccacctcccgggttcaagcgattctcctgcctcagcctcccgaatagctgggattacgggcatgtgccaccatgcccagttaattttgtattttttttttttttaagtagagatggggtttctccatgttggtcaggctggtctcgaactcccgacctcaggtgatctgcccacctcggcctcccagagtgctgggattacaggcatgagccatcaccccaggcctcttttctttctttctttccttccttccttccttccttccttccttccttccttccttccttccttccttcctttctttctttctttctttctttttaaaagagatggactctcactctgttgcccaggctggtgtgcagtggctcaatcatagctcactgcagctgccaactcctgggtgtaagtcattctcccgcctcagcctccagagaagctgggactacaggcacgcagcaccatgcctagctaattaaatttttttttttgtttacaggttgggtttcactatgttgcccaggctggtctcaaactcctggactcaagtgatcttcctgcctccctcccaagtcactgggattgcagttgcaagtcatcatgtttggctcgtgtattctttgggaacacctatgagcccagcattaaggggctacactcattgtgacaaataattcattcagaaagtatttattgagtctatttactggaccagagactctgctaggtgacaggaccatggagatacccctaagacatagctccaaccatagggtgctgatagtctaacaagggagctaagacctgtctgtagataactctaaaacaaaataacccaagtgtcacaaggaagaaaaaaattgctcttggagttgagagaaggaaggaagttggggaaattcaggaaaggcttgactctttttttcattcattcaacatacacaggaaaatgagactatactaggctggtaatacaaagacaaaacactatttgatctcaaggagtttatcctctagggaaggcagatactcagactagtaacagcatcctgggataaggttaagtgttatggacaactgaggtaagaacaaagtgatgtgggagcctggggattgctctctttaaggaaaacaaggaaggagtcatggtctaagcactcattgaactgggttttcttcagtgagcatatagtctagtgaatgtgactgccacgcccatgaataattccaataccaggtagaaaatgccgagtgccctacaagaaactcagacatagggctataaagtaggttcagaggtgagtgtgtttacttctagctggggtctcagataaggatttaccaaatagatcagattggaggtgagctttaaaagctaagcagaagttcaacagggaaaggagtgagggatgtggtaaaacagaagaaatagcttgaataggccgggcgcggtggctcacgcttgtaatcccagcactttgggaggccgaggcgggtggatcacctgaggacaggagttcaagactagccttaccaacatggagaaaccctgtctctactaaaaatacaacgattagctgggcatggtggcatgcgcctgtaatcccagctacttgggaagctgaggcaggagaatcacttgaacccgggaggcagaggttgcagtgagcaacctatatataatatatatatatctggtcctcaacagctaaaaatggcctagccagaatgttggcagccaaggcaagttgggcaaccaatacaatgtcatgtccgagctagagagtttcaaagagctcctccatgtatgatataaatcacatcaggagagcttgcaaacagtaaggttcacctgtggttaaacttaaggctgttcataaagtctagcaataaaactatttctttcccatgtaccaggtgtcttagttttcacactcccaccacaacttgaaatgtttaatatgaaagtgtgactatctgcaagtaacactaaaatattgtcccaggaggcttgttcacaagaaataggcacagcctgggaacaatgatctgcaaagctctggaacctgcttttgtttgcatttaccctccttgtagttttggacacactcaagtacagctgcatttagcagctggtccatgatttggtctattctcattgtgtcccaaactgcagactctgcagatgaatgtcagtgtaaacatgactctttctgatgggttgccctaacctttggttcatttaatctggtacttggtcatcactaagcacaaaggctgctgttacaagacagagacatcttagtgagtactggaaacacccacaaatcttccctctcaaatgagctttagcacgtgagctctgaggtccctttgcagattcacaagcagctggaagtttctgagacactgaacaattaaaatggacctcttcttgagaactctgtggcttacactgtcgaagctctaagcaaacgttgttttgtaggttcaaaagttggaactcatactgaattggaaaaattattgtatgtcttaatcagaaaaggatttagggtagctagtagcaggcattctgccaggagtctcacagccctccaaggtttaagccttaagtatcttcttcccaatttatgtgtcgtgcatcataaaatgggtctaagataacaacatgtttagataaacattaattaaacctttagctaaaaaaattgtttgcctccttagaatatttgttggagaggggatgttttggatgggtcctgtttgtttgaaaagactactcaagggagtttcccaaaataaatgtccttgtggcagagactcaaaatcattcatagaatagaactggaaatgtagaaatgagagagcccaaattcagaggtgttaggttcagcaaacagagcatgacgtttggttcgagcccacctgtaggaccttgagtaagccaatgtttacactcagtttctgcatctgaaaaaatatggcaaagaagatgtgcttacatcacagaattgtggtgagggaggattaactaaaatactatactttgggaaatagtttgtaaatttcaaagtgccattaaaatgtaatgaattactattataatcatcactgtctgaggtcctacagcttatagcgacctcgtcagtttttcgaaaagagagagagagagagagagagagagagagagagcactcttatctttccccactagatggcaggcgagccacttggtaaagtactgattggcttaggactctagaaaccacagcaggattttggtttgtgaagcagcgtagcaatggacaaagggtgaattagaagtcatgaaaagcagagacagcctgtatcccatcggtttgcagtttaccagcatttcgtgtgtatgaaaacatggtctttttcttttgactgtgagaaaaatgatagctaaacaaataatttatctaagaaggaaaatgttgagcccactcaattacagctaacagacttaacgattatttgtaacaccactttataggtaatgtcttcatctatatcagggattgacaaactgcttctgtaacagtaaatatttctggctgtgagggttaaatggtttatgttgaaactattcagctttgccactagcagaaaagcagcttgagacaatatgaaaataagtgggcatgaataggttactataaacgtttatttatggacaccgaattttgaaattcacataacttacacttgtcacaaaatattcttcttttgatattttttgagcactaaaaaatgtaaacattatttttaggtgaaagattgtacaaaaaatgaccataggcgtgatttgactggcaagcagtagtttgcagatccctgggctaatgttaaagacttcttagctatcagattagcagtctccttaatctatatatttataactctcataacacatatttcaatgtggttagtatattttttgcatgtataaattactaaaaatccatgtgatatttttgcctacatctgttattgtcttgtttgttaaagactatagacaaaaaaattcaagtagtaggccaggcgcggtggctcacgcctgtaatcccagcattttgggaggccaaggcgggcagatcacctgaggtcaggagttcaaaaccagcctggccaacatggtgaaaccccgtctctattaaaacaaaaaaatacaaatattagccaggcatagtggcgggtgcctgtaatctcagctacttaggaggctgaggcaggagaatcgcttgaacccaggaggcagaggttgcagtgagccgagattgtgccactgcactccagcctgggtgacagagggagactctgtctcaaaaaaaaaaaaaaaaaaaattctagtagttggtgcattgttcttgggtttgtcagaaagaaagcacacagttaaatgtgaatttcagttaaaaaactaaaaacaaaagggattcactgctttctctgagactcaattttaactgggtgaactaaattgctaagtctgatatttgttcttgtactgaccgatcctcatttattaaggccttaataaatgaagttgaatatctgaagacaagacttctccagtaaaatatgtctttggggaattgggagaaatatggatcttcactggcctggttgttttccgtgcactttaacgcattaaaacaactgtatggcattaacagctgtttttcacatccattttctagaagaacaaattctgagctgccagtctcagttgaacaagccatttaaaatgctttgtaagaatctcagagtaacctgtggacaagcacttgccattttatgttgcgaagggcttcagagaaatttgaggtcttataaaggaattgagtaggaacagcaaataaaatcctcccaggctggcgttctgtgaaactgagcttccttcaggccgtttcacaacagaaactcggtcctcctctgaaagcttttttataccccttgatggaggtgtcaagcgtgcacaggcagcaattcgtagggcctgctttagagaggtttctttttgtgtgtatctgttaggattcactactggtattaaatattaacccacatttaatttgcctcgtgacttttcacgacagatattgaatgttaaatactctccaaatcggatgttttttccagttttaagatttgacgcccttatgatcgaatccatccacgacttttacagttattgaataaccaacagacccttggagggtctcttaccgctctggacttgagttggttaattccgctgcagagacggagtggggcgggggcgggggtgggggtgggggtgggggtgagtggtgtaactgaggaagagtccctggcatactgcaactaggtcagaagtgacagcattcagccctcccctccttagggagtggggtaagggggcgaccccgcccagtgcagagggtggcgagtcaggagccgacgaatgctggagaggccatccgcaggggcgggtctctccagagagcagccgggtgacaacgtggcacagaacggcactgcatcggagtaggcacactgcaaagacgagacgagtcctccccagagaggggaggcggttaaggagaggagattgcgtggctcggagcagccagacccggtaagccgactccttcccgtattccgctttaaccaagcttgtttccctggcggccccacaaattccctgagcggagcgtcttcgctggctcgcagccagccagtcagagcccacctctgcgacctcctcctccttcccatcctgagggctcctgcctcggctcccggcttcctcctccgggctatcttttaccccttcggtagctggaaaatcgccctcactcaatcaccacggtggtaaatagggcaaaacgagcaaggcactcgcctcgggtgcaaaatttaaggcggcaccaagatactcagtaatcaagataaaactgttcatgcagtctctttaaaattcaaagttatagccaaaattccgcaagaagctagataagaaatattaaataagggcaagctcagaccttgcacttgaacgacttagcctcacttgcctcacccgaatccccgacgcagctaatcaactctgaagtgattccctcctctccgtggtgccacgtagtagacctccggttttcgttgtgtatacgccttcctggttgtgtgggaaggggcagggactgagcctcaagtagcgcagcccagtgctttgttcaccgaggccctggggtcaacgtggattttggagtagcccaaagctgagagcttatgcagccgccccaagttgcaaagctttgcattggaaccgcccgatccccacagaagcaaagttcgaggggaaactgcactcccttaattagtatttaggaaccccttcaataattgaattgagtataaaatctttaaagtaactacaaatagcagggaacggcttttggaattgtttttctagaagagggacgcctctatgcttagagattccttgttcctctctagcttcccatgtgtatttggtggtatggcagttcagtctgaagttgcaatgatacaagcacctttaatgaggatcacactcaataacttaggaagcaccatttacctctcctagtaagtgactagacactgttaggtgctggctaaaaggggttttcaattcttacccctagagccatttaatgctgatcttgaattgtttgctgctattaccgttaagggaggcgacaaggggggcaagtagctccggagtaggggatggactggttttatttataaatgcttctttttgtcttatgcgggccagtgaaaaatgaggtaagaggaagatctgtaaaagatctggagaagatcaggaaacgattgttcaaatccgtgtgccttttcttaaaatcttttgaggttttgggcttgaccagctcttcaaaaggaagaaaagggcacatgtgatccctggcctgctaaacagagtttgcttcccttgaggaggtatcaagccaaattctacttaacctggaatggggaaaaggtgggcagaacggtcattgtcggcatcgccaaacgggggtcacggcagatccccttagctgttggatttcttataggcctggtttagctgttccacgctgtagccagcagagggcactgttgctacatagaatcttttttgactgtttttggtggtgaattttcagagctatttaaaaaacttccatccagtaagaagtatgaacgattttccatgaaattttaatgtgaaaaatagattattattaaaaactgatggatgtctatttggttgttaacccattgaaccatagaaagagagtgaagatgttccataacaatcaaagattaaaatagcaagaacaaaaaataaatgtgataataaatatcagcatcatatccctcaattgtttcgaacataagtagttagggcttttgctcatagggatgatacttaaattttcaaatgaagaaagttgatttgtgaatttatattactcatttggaagaatgaaaactgggatatgcatggtcatgtgatcttataatgtacaattcagttttctacatagaagtctccagtaaaatatgcttctacgtgcagtgggaatttaaaaattaacaatgtaaaagatgtataattaattatcataaatgaaataacaaagaaagaatgtgtatgattctgagtaggattagaattgaaatctgttcgttatgtttaggtaatatttgtagaaatttaatggaagagttgtatcgatactaatttatttcttaccgttttgataggaatatgtggaacaaaaagaaaattcatattgtagaaacttagactcacattttgtgttagaacctatgagctactctgggtgttttattttaagatggtttttgctcattgttatgctacaggtattatcatacatcttttctaaaggtggaggccttcttttttatttaaccagaagtttcttgtgttaggatgattttgagcagttaagaattgcaagaaaaaatcttaacatcattagtttcaagtgcattgtaatggatgagtgtgtcatctagagcaagattgcatagctgtacattttgggctttcctgcttaataaatgtgtgacctcagacagattatgtaacttgtctgagcttcaatttcctcatctataaaataataataataatgcctaacacatagggttgtattaaatattaagtgagttaatatatgtaaagcagctagaacagtgcctggcccagaaaaattcactttattagtgttatttacctattatttttttccatttttgttaataatatttgaacatgatgcattaatttccccttagtttattgtttagctctagagctgcttagattcatttgcatataatattgcttatttaattttaaagaagtggttctatgcacatttagtaacttacgcctcttaaacattggctatgcaagagaattcttgaataatttcatgaagcactctttgtctcttactcagagtagaatattttgaagacatcttttctctgaagtttttagacaagctataaactagtttgtattagtcagagttctccagtgagacagaaccaatgggatagctagctagatagatagatagaggagaggggatttattagagaaatttgttcatgtggttatggaggatgagaaggccaagactgagggactgacaattggcaagggctttcttgctgtgtcatcccatggcaaaggagagagaggccaaacttgcccttttgtaaggaatccattcccatgaaatgccattcccatgaatggcattaatctattcatgacggtggagcctaaccacctcttaaagatctcacctcttaatactgttacagtggcaattacgtttcaacatgagttttggaggagacagacattcaaaccataacgcagctccatgacagaattttcacatgctccagaatgtgaatgacagctactcattttaagggaaaacagcttagtttagtgtaaaaaacatggatattggagtctggagcttggacgctagctgtgtgactttggacatgccacatgtcatctttgagcttctgctttttcaaatacaaggatgttgtaaggccaaaatatgatcaggttgtaaagggtttgccacatactgagtgctcacatcaaaacatattagttccatttccttgaccttactccctttctcctttgataatgcttcattcaagggtagatcgaagacctcaggaccaaggaggaaatgaaatgttaagaagatttgactgtaacaaaagggttagtgttaacacatccattctgtacctatacaatagaagtgcaatagtaatcttagaagctgtgaaagagcactgctgcttcctctctctgggcctctgaattaatcaatgatgtaatatatataacacatataatatatatactatattatatatttattatatatactatattatatatttattatatataaatatatatttatcacataataaatatatatactatataatatatttattatatataataaatctataataaatatacatactatataatatatttattatataataaatatatatttaattaaatatataattaaatatataacatatttatcatatataataaaatatattatatatatttgtatatgtatagattagtgtataagtatatatatttgtatatattatatatatatttgtactaatatacatacacaaatacatattagtataggacctagttactgcctctaaggcttcatgtctttctgatggtcatataatggaatgaatgggacttgagttggatgatgagattccatagatagaaaggaaagagggagcattccaactagaaggaatggtgtgaggagaggtacaaatgtgattttggtcaggagccaataagtaaactagtctttccagagaacctttcttggggaaggtgccttgtagtgcccacaaatgcaggaagcaagaattaggacaaggtcaccgatggtcagttcagaaggcttattgagtaagcacaacacagcagaggtactgtttggggaataaaaagctggtggctatgagggtggacttggttatggcaaagttagtcaggaaactattttaacagtctggggccagatcatggagggcctcataggccccaattgctccttcatctacatttgcttcagcttttacatctttctagaccagtcctgttgttttacagctgtcttccatttcagtcttagattctgtcttctatttgcaagtggcaattctaaaatcccatttgatttccatagcatctaataaaattcggttttttctccaccccaccccccccatgaaagcaaattttccatacattttgtatgccaaaacctagtaacaaggaagaataggtcagattaatcctaaatatctgctgttttattcactgcaaacataaaccctttcgttaatatcaagacagctaaacaactccacctcatctaagaaatctggcatctgaagccctttatgatttgcctcaacaaatcttttacagttttatttttactgcccacttcagccgtcctttgtttcagcttcatccctcatctaattccacgcgtacccagcaatttcgtgcctccgcctttgtcccttccacctgcttgccttctcctccacaccctaaaaattctacccattcttcaaggtcccattcaaatgctactccttttgagagcattgcatgctggtcttactttctgtactataaacatttatgctataaaatgaggacctattctattccagttaccgtcaaggcattcccaaatgattaaaacacagggaaacagatggcactatagtgaaatatcctaagtgctgtaatcagagtaggcattggaggaaggctctgagagtttccatcatcaattcaaagccagcaggagggatcagggaaagcttcctggaagaggtggcatcagaggcgtttgaaccagagtgactccatcttgagtaggggctgggtaaaataaggctgagacctactgggctgcattcccaggaggttaaggcattcttaatcacaggatgagataggaggtcagcacaagatacaggtcacaaagaccttgctgataaaacagcatgtggtaaagaagccggccagaactcaccaaaaccaatatggcgatgaaagtgacctctggtcgtcctcactgctcattgtatgctaattataatgcccaccaagcacctggatttaaaaattggtaactatttagccaggtgtggtggctcacgcctataatcacagctacttcggaggctgaggcagttgcagtgagccaagatcacgccactgcactccagcctgggcgacagagtgagactccatctcaaaacaacaacataaaaattgttaacatttttccataaaataaattactgataacattgtatatctatttgcttcagttcctccctcgacaaaacatatatttatttatgttaccacagttccattactgcacccaatagaatcaacagcagtggccgaatgtcatctaacagcctactcatgctccgattccctcagttcttccaaaactatgagtgactatttatttattaattattagtgaagcgttatcagaagatctgagatccgagaacttggtactgttgttcacttgatatgagtcgtagtatggattggtagacgaacaaaacttaagacaacaaaatagatagtaattatttatttgaaaacattttcctctcaaagctacactaacccaaagaaactgcgggatcaactaagatcagcttgaggactcaacctggttacccaggagttatggcactaccagaaactctcaggctctagagagaaaaaagactactgggagagaactccagacacttgtggatggatagtcagatgtttattccaacaccattttttgagtagtccatcctttccttaatgttcggaaatactaccagacaactgtaaaaatattaaaaatgaataagtgaacatatttgtattatcttattgggggaaagacttttcaaagcaaggcagaaacagttgactacataaatacttgaagcaactttatggcaaaagacaaaagcaataaaattcgaaagtaaatgacatgctcggaaaaaatatttgcaatatagagaggattaaaaataagttctctaaaatgttaacagtacctataaatcagtaagaaaaaaatataacgtggaaaaaggataagaacaagtatttaaagaggaaaggtgatgaaagaaatcaattaaaacaaaaattagataccttgtgatttaccttctaattgatacaagtcacaaatgttgattatgtgtcatgttggtaagtacatgagaggaaagaactgtcatttgcttttagcatacaaattggtacaacctttgcaagggcaatttggcatatatacacacacacacacacacacacacacacacacatacatatatgtgtgtgtgtgtatatatatatatatatatattttttttttttgagacggaatcttactctgtcacccaggctggagtgcagtggtgtgatctcggctcactgcaacctctgccccctgggttcaagtgattctcctgcctcagcctcccaagtagctgggattataggcatgtgccaccatgcccagctaatttttttgcatttttagtagagacggggtttcgccacattggccaggctggtctcaaactcctgacctcgtgatccccctgcctcagccacccaaagtgccgggattacaggcgtgagccaccatgcccggccctggcatatatttttattactccaaatttataagctactcatttagattgcctctgttcctgacctcatttcctatttttatgtttgctttttcctagatggtgtgcttctcacctcagcgtgatagcctgaccttgactcctgagttccacgatcgcttcacaactgcaagtcaccatcatacaaaatttgagtttccctaagtccgcgcctttgagagctttggaacgatatgcaagttcaagtcaccatcctgtttcttgctacctcctgtgagaagaccaacatttgggttacacttgtttctactcttgttcttctgcttgttattgttgcctctgcagccattgatcacacacgtgttgtcatacaaaaactggttagcctttttatttgtcttgtgaattttatcatttggttcttaagtattacaaattaatattgtgtactctcattgatatacaacttgcagtcattgtaaatatgcgtgagttaggggtgagaatggcatgcaagcaaaagaacaaggagagggatgatagagatgcaagaagagtaaagagggcaagaaagtttatgttaatagcgaacacaatgaaagttctttaaatgcttgataatggtgaaagcaacacttcctagggcatatttttggtgttaatgaacctacacatcatacaataaagaaaattgag

SEQ ID NO: 5910 - DNA, 2502 bp, human
gcggccgcggcagcatcacacacttacacactcacagggggcggagcctggacagctagaagccgcgacatggagcaggcacgttatcatccccggatctggcaggggctcgccgcgcccgcccctgcctttcgggaaccctctcccaccccccactgtcaaaatcagctagtgggagcggccacagagctgaggacccggacccggacccgggacgcaggggccgtggcagggatacaggaggtgggctggcgggaccaggacgcgggcttcgggaatgggacccctctctgaagcccagcccacccccaccactgggaattagttttgaactagaaaagacagcacaaacagccgtggggttgaaggtcgccccctgccacctcaagcacagctccttgagcccccgagtagtggagcaaactttgcgggcctgagcatccctcaggtctgtagtgcgtagcacgcgggtccaggaaggagaaggcggtcaccttcaccagccccgtggctccacgtgcccgcacccaggccctccaggcatgcctttaggcgcgcacctagtaggtcagcgagctataggccctggattcagtgggcagcaaggataggaacaaatgactgcccttgcgtggtccttgagttcggggttaggatactgttaaactgggttccactgtcactttcctcgcacggtcaccaggtgccttgagcaaaagacttctgctagctcctcctctgagaaatgggaaaaccactgggtgtgtgcccagtatcccacgcaccggctgcccgtctcccttctggcctgaaattctctttctgcacgtggagggtttaaccgagcctcctactcccttcaacctccacctctgatccaggaaggagtggatccctttagccaattccctggagggaaaggttccctggcctccgtgcagagaaaggtctgtgggaaggggcgggaccgctttctggcatttcaggacatgagcattctggagtcctaggcatgtaatttgccttcttcgtgtcgttatacagagggaatagtattggcacatttttcaaatcctaaggctagaactctcttgggaaggacagcagactgagccctgacagagcagggtgccggtagctctgtgtgtgactccaagcaagtcacttatctgggcctcagtttctccataaaacacccagcagccctctggctcatacttctctgacattctcccttctatttgaatatgcttctacagtattatctcatattaccaaaatcatccaaataccttttaacttcatttttttcctgaagaaacagagaccctaagacattaaaatgctcaagatctgatatttcccctagagggggatcccagattagaacctagaacctgggaagctcttccagggctggagccagtagaaggtgcctcagctccaagcatgaatgacttcagcatttgagctacaaggggcccagggtctggtctctttcacattgttttacggggggaaagaaagcacatcattaacatagagaaacaaggctctaagattctgcaactcaagcatccactgggactttgcttagatgtctatttactttgcatgggaccaagtcctcaacagatgctggttgactgatggaaaatcaaccagtgggcagccaaggggagacgacatctcaaagtggcttgtagatttggctacctgtaaactcctctggtcaaaaagactctatggagaaacagttattggcaaaaatggtgctggggattttcaaattatctctgtgacttatttattcatggaattctagtattcagccctggactgagagcccttaaagcaacaaggacggcctcgctcagatctgtggcccccgacctttatgccttcagtaaaaaatcctcaaattggatttgattgctgatgatggttgccagcattagtacttgatctgcttgaaaatccttagaggaaagccagaacacctacaattaacatttaaatggtgattatggtcactttatttctggtttacttttctcacaaaattgtatttaatggggaaagatagaaaaaaaaataacatgctaggcaaacaaattttcaacagaaataaagctgcccctttaagagttccagccccccatcacctcactggtgcactttcttcccaatcagcaggaggaccaagcagaagcagaaggagccagcaagaggcagcactatgaacagaagtgcctgcgggaaggagagaagagacaagtggtgccggctgctgcttcaaaagaggggcaggggctttcccttcctgagatcaaaaccaagcaggaaggttgggttgggtggaaggagcccccacttcctagccactctcctcaaacagagatgaggttaagacaggcaacactgaaggggccaggctgtccctgaggcctctttggccgggcctggcacctgctcactgagcatcagctactgagcaagata

SEQ ID NO: 5911 - DNA, 500054 bp, human; identical to SEQ ID NO: 5138

SEQ ID NO: 5912 - DNA, 500054 bp, human; identical to SEQ ID NO: 5138

SEQ ID NO: 5913 - DNA, 493726 bp, human; identical to SEQ ID NO: 5141

SEQ ID NO: 5914 - DNA, 403378 bp, human; identical to SEQ ID NO: 5140

SEQ ID NO: 5915 - DNA, 108678 bp, human; identical to SEQ ID NO: 3935

SEQ ID NO: 5916 - DNA, 150667 bp, human; identical to SEQ ID NO: 3937

SEQ ID NO: 5917 - DNA, 150897 bp, human; identical to SEQ ID NO: 3938

SEQ ID NO: 5918 - DNA, 149709 bp, human; identical to SEQ ID NO: 3936

SEQ ID NO: 5919 - DNA, 2644 bp, human; identical to SEQ ID NO: 3964

SEQ ID NO: 5920 - DNA, 3876 bp, human; identical to SEQ ID NO: 3965

SEQ ID NO: 5921 - DNA, 4812 bp, human; identical to SEQ ID NO: 3966

SEQ ID NO: 5922 - DNA, 5521 bp, human; identical to SEQ ID NO: 5291

SEQ ID NO: 5923 - DNA, 8793 bp, human; identical to SEQ ID NO: 5292

SEQ ID NO: 5924 - DNA, 7845 bp, human; identical to SEQ ID NO: 5293

SEQ ID NO: 5925 - DNA, 28324 bp, human; identical to SEQ ID NO: 4034

SEQ ID NO: 5926 - DNA, 27728 bp, human; identical to SEQ ID NO: 4037

SEQ ID NO: 5927 - DNA, 27071 bp, human; identical to SEQ ID NO: 4035

SEQ ID NO: 5928 - DNA, 24763 bp, human; identical to SEQ ID NO: 4038

SEQ ID NO: 5929 - DNA, 24598 bp, human; identical to SEQ ID NO: 4036

SEQ ID NO: 5930 - DNA, 24983 bp, human; identical to SEQ ID NO: 4032

SEQ ID NO: 5931 - DNA, 22343 bp, human; identical to SEQ ID NO: 4031

SEQ ID NO: 5932 - DNA, 22354 bp, human; identical to SEQ ID NO: 4033

SEQ ID NO: 5933 - DNA, 1137 bp, artificial
  synthetic oligonucleotide
tccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccg

SEQ ID NO: 5934 - DNA, 1510 bp, artificial
  synthetic oligonucleotide
gaggaaacgctattaaacttgcttcctctaaagagcgctacccaccgttttctctgaactgtacctaaaaagtcaggagagaactcgttaacttttgtttggtttaacattgccagcttcaagtcaaccgtaggccccccgaaggttttgtaaaatatttaatctagctcagacaatttcctgcagtccctaaccagaccaccccacttactgagccgctgccaaaaaggatgcttgactgcagactggcaaccagaggccttccagtcgcctggctggccttgacctccactcgaggcgccaggaaagacccttcccggaatcccgagagaccaagacctgggtaatcctggaggtctaaacccgtgaggaagcccaagaaatggagttaaagacccttttcgcacaaccgattgttgtctgtgtgaccttctgcggcccttgccctctctgaaccctctaaaatgggcatgaggatgtctcaccttcctctgggtgttatgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggctaccgagaaaacactccgcatcgctctgtgctcagagcgtgagtcagcttcccagccccgggggaacaatggggaccttgccaagggtccccttctgtcgacccctgacggcccccaggcccgtttgggtggcgggagtgccggcaccctgggaccttcgggcccgaggttcgggagggctaagggcgctccaggcgaccagggttggggtccagccccaggattagcgcggccaggaatccctctgcccgcagctgccgcggaggggttgagggttaaacagacaccgggcagaggagcgagcctgccggctgcggccggcgcggcgcggcgcggggagaggacgggagggaagagggcgcacgctacctagcctcccgacgagaagacgtctcctccccacgtcaggccgggctctcgcccactcggctggccgcctctgctccctggcctctcaagtctcagcggaaagaaacgtagcggctgccaaaagcaccccactccttttattgtccccataagcctatacacgtacactagccacccccccaacacacacacacaacacgcacacgtgtgcgggagactcgaggatgccctgcctccatcgctcacagagtgagtaccaaggccgagcgaaacggcacccctttggtggaagacacagtgttgggaccagtggtggcctccgcgctacgtcttctatcgcaacctctgggtttcctt

SEQ ID NO: 5935 - DNA, 2270 bp, artificial
  synthetic oligonucleotide
cccgcgctcccaccagcccggctgccggggcacagtcacagctccgcgcgctgggcagtcctatttttatcttgtctaatcctaaactgggcggggagcacaggcgtcgtgcttagagaacaagagataggcgcgggaggcggggaggagcagccaggcagcgacgcgagcgggagcgagttaaagacacagtggaggcgaccgcgggcaggaagaaagagcgggctgcgcgggcctcgaggcgccgcacgcaacgcgccgccccgcgaagttacactcgcttccccgccgtccctcgctaccggcccctccccacttcccagcggcgctccccgcagcctggacagcgaggccccggcctgtgtgggaggcggaggccaggacggccctgcaaagggctggagagaatcgctaatgagctgtgcagcccattgatccggagaacacttcctaattaactctcagtcacctactggtgacagcgcctcaaaggacagcgctggggccagccgagccccagccgcgacttgccggccgggcgcctgctgcccaaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgag

SEQ ID NO: 5936 - DNA, 1660 bp, artificial
  synthetic oligonucleotide
tctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacatagttataaaaacagcccttctcaaagcagaagtgaaacatctctaccgtttgaaacccgaaacttcggcagaattaaatcttcatgctccagagctgcttataacaactgatgcaaaagacaggcgagcaagtgcccccgcgagcagtgcccagccaggctgggccgcgaacgcttccaggaccagcgcctgcagaatggaatgcacg

SEQ ID NO: 5937 - DNA, 9393 bp, artificial
  synthetic oligonucleotide
gcaagatttatttataacgtatactaggatccacatcataaagcttataacgtatgtgtaggcttccgatggtcctcctcggaggctgttctcagggcgatgacacttggtactggaacaggtgggactcggatgagtacagataatgtatttttacataatgtgaggtagcctttctttaaaaacacacccacacttatagtcttctggtcactttgtacaagaactctgggcttatccaatggcactttaaaaaacatccgctgccccatcctccaagcacaaggcacagctggcttcccctctgaaactcaaacgaggtaacaaacaggaggcgcatcctcctcccaggatttcactcatctggaaacatctaaaggtagctgcctcccagggcagaagactgctggacttaagggtcgccaggctgaacatgactgttctttcttcttcctagcctttggagggttattgggtgtttggggaaggaaggccctaagggcagcctctccgtggttcctagcaaccatcttggaatttctggtctgggctcgatttgggtcaggccctgagctccccgaacacaggcacgtgtgggtgaactggcatctacactacgggggcccgcagggtggttgggtgtcgaccaaatgggcataatacaggaggcttctgggaggctggccgcctcttgcgctcggcaagggcttaagagccctcgacgccgccgcgctgggccgggtgctcctgcagataaacccggacgccacgtcccgcctcggctgcttatttagcaaggcgccttctgcgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgtacctctaagacaatcaaccattttcttttcttttcttttttttcttttttcctttttcttttttttttttttttttttttttttttttttttttttttttttttttttttttttttttgagacggagtctcactcttgtcgcccaggctggagtgcaatggcatgatcttggctcactgcaacctccgcctcccgggttcaagtgattctcctgcctcagcctcccaagtagctggaattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgca

SEQ ID NO: 5938 - DNA, 9815 bp, artificial
  synthetic oligonucleotide
atgacgagctgagctgccggcaggtagaggaggttgtccattctcagctaatgatcgccttaggcgccaagtgatggaaaatccagaaggactggcgagctgcagggggcagccagggacaattgtatggaccagtttaacatggcttccggagggatggcagcaggaatgctgtgtgtctgtgtgtgtgtgtgtgtgtctgtgtgtgtttcctggtctcctttctctcccctccctgccgcctttccctctctcttgctttcgattttctcttctgtttctagcccacacgagttgaaattagaaaggtctttgaattcatttatttgttttaataaaagcagcatttttaagcagcatatttgtagcaattgattgttaaactaaacaccaagccaactaaatgtgttagggggaaatgaaaagtcagtttacaagaaacataattaacacgtcctttgacttctcctaagcctttgtctggctagggacaagacagaggaaccataatcaactttaataaaacgaaagatggtatcaaggccaaaggggaacaaaaaactttggagtaggaaacaaaagccaaagaggggattcttaagttataacaaatatgttaaaaaacaaatcttttggccaggcgtggtggctcacgccggtaatcccagcactttgggaggccgaggcgggtggatcacgaggtcaggagtttgagaccagcctggccaatgtggtgaaaccccgtctctactaaaaatacaaaaaattagccgggcctggtggcgcgtgcctggtaatcccagctactcgggaggctgacacaggagaatcgcttgaacccaggaggcagaggttgcagtgagtcgagatcgggccattgcactccagcctgggcaaaagagcaagactccgtcctgagaaacaacaacaaatcttttgtttcctaatttttggtcatcagccattttctccttaccaataggaaggctccggtttgaactctacctgttcatggggacagatgctgagacctggaggggaagagggaaggtggtacaaggaacctgcaggagactgcagtatcaggtggcagtatcaggaggctgataaatccaggctaatggaaattactattgcacaacaccagagtcttcacgtggcctgactttcaataaactgttcccctcctcactccttggagaaagtgaaataagacattagactttcagtaatctcatatggtgatgatcaatcgaaacctggagaagaaggccaatttatagaaattgtatctgcttcactgggtggctggaaccagggagctgaaaagaaaacggtgctcgcctttgatgtgtgaagttgccccaaaatgacaaacgccaaaaaacactggctatacatgtggggtattcaaagggagagggtactcaggagaggcctttgttaggtggatcattgcggggacctgaccaaagacacatgcacatgttcaggccacataaaagcgatttatttttcttatcttttggctattttaagttggagtttccatctttcttatttgttttatcaccaatgaagtttatttactgaattaacttttaacggaccctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggcagcgatcagcagctctgcacgcgcttcagtgcatgaatggattgcggaagatgcctgcgtccgctccgctcaggaggctctaggagcgccccctccccgcccgccgcgcccgcccccgtggcctccctaggccctgcgggcgcctcggggttcgcaagctgggccctgcggcgcgatcactctcacccagaacccccgccgccgttcccagggccttggcacctcgccaccgagtgtcattgggggctgaaatttgacacaagccttcctggcctccccgacgcagacaccgctgtcagccccctcctttcttcgcgcccctagcccctggcggcaagtttactttcaaggagttggaccgtgtttccgccgcaaaggccggcggcgtgcgggcccgggaggagggggcgggctcggaacgtttccttcacctgctcggccgcctggggtgtttgtaggtccccgctggcccccagccctagcgtccatacgcggcgctccccagcttttggcggctaatccaccgagagtccctgcgatccgcacatgcacgtgcactctggataccctcgtcccagcccacatcagcggcaaaatcatgtacccaaattctctttcttggcggcttacagtcttgaaagttgggagagcgccacagacctcgaagtctgccgcagaaatgttccccgtcaactctgcaaagtaggtctcattaaaacaaaacaaaacaaaaaaaccctccagtttcggcctagggctgagagaagcgggaaacgcaagtgaaggataccccaatccctcgagtttgttttggtggagctaaaccagaaacccggggatatttctgtttgggggaccgccaagcccgggatgcgtctgcctaaggcgaggtggggagaaggagagcgcaagaagtggacactcgcagcgatccaaaggcaaagccaagtaccccgcgggaagaggccgagctgacccaggttgcaggaagaccgccacatgtgcgcaaagacgcactcggagaggcagagcgcgacccgccgacctaggagactggcgaggacaggcgagaagctgacagcaagacaaagcgggagtagagagccagggaggctcggtcgaagacccgaaaacgaaggcagcagcagccgcccgagtcccgaagcggaggcgtgcgcagccaggcccagcctggcatagccccattctcacgcctaaggacgcggacacagactcttggcatgacttcctgccagagctggtctctgtagggcttgggcctacagttggctgaggccttcccagcagacagtggggtccccaggggaggtcttcaagaatccgggcccctctggtttccgccccctccttgagcccaggacaaaggtagcgggtttgaggagctcggactgttctcagggcgtctacaaggccatcagagagctggtgcctccactctcagggcctcgggcaactttttatctgacttggcggcgctggagggctgccactttccaccgcatttccatttggccttcgcaattgcaataccctgaaggcactgcccacaccctagccttccagcaatcgggattcaagctggacttcccataaccagcaacagtgtaacgtgaagacactcctagactcaggtttccctcaacccttctcccgcttgtccgcacacggggcggatcaacgccccccacccacggccccacccccgcgggctccgcaacccagggccgcagctaccgagtgtgcttctcctccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaacatgtattactctcttctttatcaaaacatagaaatataccttaccctaaacagaaacaaggttctcacagactgatggggtaggagtgaaggagaataaacatctttgagaggattcagtttttttccactacggaaagggaagagaaactgacagtgggaaacacacttaggttatctgattggaaaggcctgggggattttagatgccaaaaactgtgtgaacttgacctagtgaaatgtcatcttagacaccaaattataataataattttatggattcatttttatcatagtttaaatcaataaggattgagttggaaatcttgctctagttataaatagatggagagaacacctcaggaaaactccaaagtagtaatttgggtaaaagttagaagcggaggaaagaggtggaaaatgacagttaatgagcctgtggcctccactctttgttacctaacagttgtcagagaaccatcaaagggagggaacaggcgcccttctcagaaccatcacaggaaaagcagacattctctggctgctgcagatccccccggtggtggttcctacacccagcctcctgggagtttgcctatgtgtatttatgtgtttccgggctggggagtgtagctactttcacaagattgggccctgagcctgtgaaacccactagcgaaagttctaccacgaggaaaagccattctaaggcaatgctggagaccaggaactgctctgccatcatcaacaatatcttcatgattcctgcactagcaaactgcttcacatcttcccacctcaaccatggggccgagctctgggcctcttacagatccatacaggcgggaccttttgcagctagcacagatgtgtggttaaggcatgagacagctggccaaggggaaaggaggctaaggctggggatggctgggaaggaccaaggcccaggagggcctcctggtacaagcatagaactgacccagcatgggggagttgtacctccagaacccactaagggtggcacttcccccctggacccaccaggtactccaaaccaagaggaaaagcatccttgtggcatgtgggtggattaggcccaaggcgcaggtgagctctgctgcagaaggaacctacacaccaagtcccaaatgcccaagtgctgacagggattggggcaagcaggagggaggggggatctttctgcctcccatcacctcacccttctgtaatgttttcctggaatgaacagaagtcgccagcagagttgttcctggagcccctccctccgggactgtcactacctcctggtgtaagacagggaggaccatggccttctgccgggaggatcctctggctagtacccgagccttggattctggcacgaagcctcacagttccgataaggctttacctcccttcccacgtctcgaagaaaaacaccccctggaactgctggggtgaactcggagcctgaggccagggtcagcggggggacgggtccccaccaccaccaagttgccggcagaggtaacagctgtggaagggggaggggagcgacaggcagccacgactgaacggttgcgatctagaaaattcaacaagaggccgcagcggtggcggcggcggcggctccaattagctgagccaactggggaggcagagagcgagacggcggccccgccgatcgtgtcccgggcgagcaggcaggcgggggcgcggggcctcgagctgccccggcggccctcgctcggcccctcccgtgggttctcggagcgcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgact

SEQ ID NO: 5939 - DNA, 1369 bp, artificial
  synthetic oligonucleotide
tgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccga

SEQ ID NO: 5940 - DNA, 1479 bp, artificial
  synthetic oligonucleotide
aaaacagaagaggcagtgaccttctccgggtggggtctatggccctttactgggtacattctgtacacacaggcccctcctttgcctgaagtcattgatgaagacttcattacggagggtttggggaaaggtgggggtctggctgggtaagccggcgtcccagccccgctacagccccgcccagatctggcagagccgtgggcgaacccaggcgggcagaaaggcggggcgggcggctgccaagccggccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatt

SEQ ID NO: 5941 - DNA, 3782 bp, artificial
  synthetic oligonucleotide
cctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcagaacaaatggccagagctgtgcacagaagaagctacttccacttggatctgaggagaaacatacagttcacctctgtcctgagctctttgatggtctggcctcaggcaccagcctcatcctagaagagttgtcatataggggccttgggttgggggtaaaaggcaaaagtttccaaatttacatttctgatatttccacggtcagtcatgtaatttaccttgatttgtggcctctaatgagacacacccacgggcacttttttttttccaagatggggctttcctcagtagcatttatttatttatttttgaaatggagtctcactctgtcacccagactggagtgcagtggcgcaatcttgactcatcgcaacctctgcctcccgggttcaagcaattctcctgcctcagcctcccaaatagctacaggcacccgccaccacgcccggctgattttttttttttttttttttttttggtatttttagtagagacggggtttcactatgttggctgggctggtctcgaactcctgacctagtgatccgcctgcctcagcctcccaaagtgctgggattacaggcatgagccaccacgcccagccagcagcatttatttattattactgttttttgagacagagtctcactctgtcgcccaggctggagtgcaatggcgtgatctaggctcactgcaacctctgcctcctgggttcaagcgattctcctacctcagcctcccaagtagctgggattacagacgtgcaccaccacgcctggctaatttttgtatttgtagtaatgatggggtttcgccatgttggtcaggctggtctcgaactcctaacctcaagtgttcccctgcctcagcctcccaaagtgctgggattacagacacgagccaccacacctgctcagcagcatttaaaaaattaagtttaaggctgggtgtggtggctcacagctgtaatcccagcactttgggaggttgaggcaggaggatcccttgggcccaggagttctagaccagcctgggcaatatagggagaccctgtctctacaaaaatatacaaaaattagccagttgtagtggtgcaggcctgtagtcccagctactagagaagctgaggtgggaggattgcttgagcctgggaggtggaggctgcagtgagtaaagcattccactgcactccagcctgggtgacagagtgggaccctatctcaataaatatatatatttcacttacgtaaaattctttttaaaaagttaagtttaatgcataaattgtagcttgcaaaattgctcccattcagaaatggcatgaat

SEQ ID NO: 5942 - DNA, 1834 bp, artificial
  synthetic oligonucleotide
ggccaaggtaagcagtgcattcccacctctctgtctctctctctctcgctctcgctgtcgctctctctcgctctcgcgctctctctctctccctctccctctgtatgtgtgtgcgcgtggtgtgtgtgttggagaaagagtgcgcgcgcgcgagctgggagtaagggggagtctggtactgctgggctcgggattcggaccaagtccttggcctcatttgtaccccgttgtaaataactacgcccttaaaaatgaaaaagcaaattcttatactgaatatgcaaaaccattgaggatacggatctttccaccatccaggagataacactttctggggcccctccggtgaacgagttttgttgacactgagtcttctgcgggcagtagggagattatatagggggttcgatcttctccctgccccctccactcgagatgttcccgcaaattcatcggagaagacctgagcagactgatggcaggaactgcgggacagagggattttgcagaatgtaaagtatgttggaaagagagaattcgatttgattgaagtgtatccgaggcgaattttaaaagattaggtgggatcatgattttacaatcccctcccgctctccagggctccaaattaatttctccgcccagtgaaatcacagggcttgggaaggtgcctaacagctgagggggactgggtttgtttttttttgtaactaccaaaaagcagcttcgaggggcagccaagttggtgcccgaaggtagctgtcccccagtttctataaggaaaggagtcgaagggtgcccctccccctccattccgccctgcgaggaaaagcgcgacttcagaagatgcgcgggctcgcgctggatgtttctttctcgcgctctcactcctgcccctgactcccttttcacactcatgcacattccgtgcatttggagcagagtaacaatcaaattcaaagaatgttgatcccgccgctgcagagggcagggctgggctgtcttgagtgattcctcaggaattcccctcccctcatccccccctttcttctcacccccgcccatcccccagagttgcgcaacccgccccccccccccaatcagcgaggtgcaagtcaggcccccacccaactgcatctctaaatttcagggcagcttcaagagagttgggagggggcgaggaccctgcttctaattgtcgttagtcgtgagctcttagaagtgaccaggactttgcaaagagggagtgtcgaatggaaagcgaaggcgcaggttgcagggaagtgttttgatcctcagattgctgggatttaccaccgactgcaagtctgtagacacacgcacacaaacaggcacacacccgcactccggggcagagatactccgacgcaagcttggcgctccgatctccgcacgtcgctcccgctgcagccaggccgctcccctgggactctggtccaccacccagacgctggggcgcgaagaccaccccatccatgccccgtttcccgctctccggcttttggggcagctggggcgttcacagtccagaggccagggcactcaacccctgctgccgccgcccgaaggaagggccgctagacttacccatggaatcgggcagggacatgtcgctggaccgctgctgagtcagggactgatgcatggtgaaaactgcccggttgccccagtccccgaagctgcttcaagcgcccccggctctgggcgccccgcagagcatcctactccgcggttgcctctctcggtccttccgagagctgagagacactgcctctggttgcgagctgcagcccaagtgccgcctccccctccc

SEQ ID NO: 5943 - DNA, 1154 bp, artificial
  synthetic oligonucleotide
gcgctctgtcaatctgctgcctggcgctggccggcgcgtggctgctactgcacggctcgcgccgggctccccgggaggcggggagagtgcgaatagggcggagggaaaggagcacgccggctgcagcccgggcgagcgggagggcgcgcactcacctccacacaccgcggtcaaggagagccagagcagcaggagcgcctgcacgcagagccgcagattcatgctgctccttgggccgccgcggccccggcgagccggcgcgggggaggagaggtcgggcgcccggaggccaagaaaggcgcgagccgcggctggcgcgtgcgggcgcagagctcgggaggctccccggccgctgagtgtgcgcgctgagccccgccgctcccgctggccgcctccgctcttctgcagcctcctctcccgccgcggggcagcgccgcgaagctggcctcggcggctccgggagcggcagcggcgagctctttcttagcggctggctgctcggccgcggctgcaactgcccgtgaccccggctgccagagagaatgctccccgctcactccaggggctgcattttgtagcttgtggcttggccgcgagcccacttggtcatgtggtcatcgggagggctagagggggggcaggaagagggagagggagcgagcctcccgcaccgcccccctccaggcacgcactctgcagccccagcccgagcgtgagcgcgagagggaaccccgaggtggccccacaacaaaggctgcgcggcctctctgacaacctacaaccgctccccggacaatgcccgcctggccgggggccagagggtttgcagagacctgaaggatttcaaacacaggaagcatttggggcggtggaggggcacacttaaccctttctcaccttgcttccttaacagctgtcaggaaacctgggcgcttagggaaggactcagtctgggttgccttcactcacgccctctacctctgaccctggtccttgcccttgccgctggccagcttcaagggtttggtcaagacaaccaaacactggccctcctctctcctctgcattttcaactggctttgaattgggggtgactgcctaggcttgtgcccaaggcttgattaattgcccaggcccctcatgttccctgcatc

SEQ ID NO: 5944 - DNA, 1840 bp, artificial
  synthetic oligonucleotide
ggaaggggaaacaaaaagcagaaagagtgaggcaaggaggggaaaggactattccttgtgcagtccttgtgtgcaaagggccaacaaagaatgtcccctgccctcaaatgccacaccagtcaaggcagaagggaagcaaagtgctgtggcaaattgtgtgctgagctgggatccaggagttctggaccttcatcttggctctgccactaattagctgtgtccttgggtaagtttcttaaccatctgaacctccatttctgctcttccttcacttgtactgtgagattgtgtggcatggccaggggaggggaggttcagagcattcagagggaagggacccttgggctgaatcttgaaggagagctctgctttgaataggggagagaagattgtggggtacagtgagaaccagtgggagtggcccagagaattcagcaaacaggtatacgtaaggcactgagctggctgctgggtagaaaattgctatgaatcagccccctcctcaccgcggcaagctttccagagagtaggggaatctgagaggcagagccaagcgctggcagtgcctgcagctcctctcagcactacccgctgccgcccgccggactgtcgagcaggtcacgcagcctttccctggccggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagt

SEQ ID NO: 5945 - DNA, 1371 bp, artificial
  synthetic oligonucleotide
agttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgaggg

SEQ ID NO: 5946 - DNA, 3192 bp, artificial
  synthetic oligonucleotide
aagctttttaaatattttttgtaaatcaggagaggctcctggtgactgaaccccacatggggtccagggcaccatcccagcccgcccttcggtccgcggggtgccccccgccactcccaaagagccacggatgcctctcatgcagccagtagtgataagcaagcctgggaaccatgagctctccttggatgtcggaaaatagcgacagagggacacccagtcgcccgggaagaccagagccagagcggggaaggagcgaggtgataaaagtccggcaagaagagaaaaacagaaagggtaagagagaaaaagaataaaagcgagagaggggaatggaaagaaggaaacagcgagcaaacaggagcagacaacatctaggacacaagagagaaagagggagaacaaggcaaatagacgaaataggggggaaagcggggggagggaagaatgcgggcgccgaaaggaggaagagagcgctgaaaggagacttcggaacccgggtgcagagtagaagaaagcagggatccagagacgctgcacggagagcgcggctctttagggctctccagtgcggagactgagtacgatgccccgtcccagcggccccgttccggccgctcggccgcctcccccgcacgctctgccaaccatcacgcaggccaccctgcggacagacagacggtcagtccggggccggagcggaaagcctttctgtggccgccacagcgcggcgaacgtgcgctactgggcgcccagcacctgcccagccggggtgcaaacgcccgggcgtcagggtgcgcgctaggtccccggcttgggccagccgcgcctcccagccctccgcccgcctaggcccgggtcccgctcgactaccggcgcgcactcacctggacggtctcagcctggcgtcgcgcttgccgtccaccacggagggcacacagctggtgagctcggtccagtcggcgtgcaacccgcagctccagcccgtggagaacctggagaagagccaggtttcccgcttacccggccggtggcaagtgcatttcttctgacccacgcggcactcgcacggctgctccagctggatgttacgcaccaagtggcggccgaaagtggtgcccccggtcttctggatgtgcaggaacacgatcaggtcatcgcccttgatgtcgaagtctaccttgcgcaggaggtcgccgcgggtgaaattgtagcggggcacgaacctggcggagctctcatcctccgagcggtacgggtccggcaccggggagctgaacgcctgcaggcggaggagctggcattctgtgccggggcacacgtattggaggacgatcacggcaaataggaagagcatcaccaaagctagcagcagcttgttggatttctcatccatgttcccgacgctgggggaaacccaagctcgttacgtcaatcccgcagctcagcccgcgctcgtcgtgcccccgcaccgcccccttcccctggagccgctgctgcgcccctctccccctcccctccgcaccgagtactccacggcggcggcggctgcggcggcggctcccttccccgcttccttccttcccggcaggctcagcgctgtggcttctgcggcacacacacacccccaccccgactccttcccgcgggccgttcgccccctccccccgccagagctctccggagctccccggagcccctccacggggtttagccccagtgggacccctccgggcccagtcgccccactcctcaactcacgcccccagtccgggcccccgcgtgtctcgctccactctcggtggctcccgctcccatccccatcccgcttcgtccgccggactctccgggctcttctgcccctatcctctttggagcgcacacctctgtccgggtttctccccgcatgccccgaagccctccttttgccggcgcccgcgcccgcttgcccacccggtaggcggcctcgagggagctcggagccgggggctcagagttaccctgggggaatgagccggccggcagcccgacttgctatcggagacgctgcgctgccggtgcccgcggaacagtagcgacggagccgcggcgtgggcaaatgcgcgccgcacccctccggagaccctagccgggccaccaatggccagctggaactttacgcccttctctaccccccgcggctgccttccctccccgtacagcaccttcgcgccctggcctgggagcgcgaaccccgctttcacctagaacgtacctggccatggggccgaaaatcttggagaagatcgcaccgagcacgtgcttcagcgagtggcccagggcggccaggccccgagtgagcagggcccggcagagggagcccaggtcccagcgtcgcctgaggacgtgcatccgcctgcggcggccccgggacagcagcgcgaaaagcggggcgcacgcggctcccgccagggaagaagacgcctttcggggcttgtccaggagcggccgggtgtggaatccgtgagacacacccctaggagggcccgcgcgaactgaggcggcgaccgacccgggccggctcgctgccaattcggcctctactctggaatgccggcggggacaggtggtgcggacgggcgctcctcgctccggttgccgcggcggctcgaactcccggactgcacacgcaggcagtgccattccccccttcaggcaactcagggtactaaggatcacgagcgagcttgaatttatataataatgcctcacgcctaagagctcgagccacttcacaagcagagaacctgggttttctcttttcttggagtacggaggtcactccgcttagcgcatcactccactttggctcgtaatttcaacctctcctaaaatagcaaaggcgcaaattggagcttttccgtctctctttgccaatttccattctccagcggaagcgggggcattttctgaaaaggtaagtcagcatgataaaaagacagcaggaccaaaaagcattacagaatgagaatctgaccttttttagagcacagactgtcttcttgctgaatcctgtgtaccaaaccctgtgcctgcaggagggcttgactcataaaaggtttgttgaatgaatggatacataactaaaaactccatcagagtgagaccgtctaatccaaggtaatgtgacacatgaggaaactgaggcccaga

SEQ ID NO: 5947 - DNA, 1868 bp, artificial
  synthetic oligonucleotide
gaaaggagcccttatcctggatgttagacgctattaaggaccatgctattttgtatttgtgagaatgatattgaaggtaaggaggtccttatccttgaagatgcatgctgaagtgtacagaagtgaaatgtcacgatgtctgcagttttcaaatgatgcagctaacatacgcacacattatgagagagagaacagaaaggaagcaagtattgcaatatgttaacagttgttgcatcctgttgggggtggggggtaaacagacgttcgttgtaccgttctttcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtgcggggtggggacttcctggcggctctcagcaacccctggtccgaccagactcggtgggctcggctgcaccacggatgagcaaagaaaccggcgggccgcgggaactgagccgcgcgcctgcagccgtcgccacggcggcccgcggccttcccccgcattccccgagggaggccgtagttgtcgcggcctgcagacagcgcgcagggtagcccagaaccgcgtgcgggcgctgggggaaaaaaaattaggtgccgaaagaaagcagcaacgcacgcgcgcgcacacacacacgaaatcagtttacaaaaataaaaccgcggaatctgccgtgctcggcgcccgagtttgagctacttaactctcgcatgcattttactgtcatatttctgtagagctgatggaaaatctgaaatgtttttgcaagggcgatctcgcagacccaaggcgttgcaagcgttgcgcagcctttcgctggcgtctgcggctcttttccggggcgcgaggagggaaaagagtagtgtctttcagggtctgcaaagctgttttgaaaagttaaccaaaaaggttttaaatagcaagattttcttttcaggaaaagtttttaaaacggctgatactcgtccagttttggtgggcgctaaaaagtcttattactaagctacaagtttccctgttaagattttcaaaacccctcgtggacagggctgaaagtttgccgggctgtgagacgtgactgaacacgcttctaaatcctcagatagatcatttataaagctctggtgcccttgggatgaaaggcttcgctgagtttttaagacttgccttcgtgggtaaatttgcttgggttgctacacgtaagcattcatttccccacctaaattagtaaaagggcagaagattccaacgacgtaagataaaagttgggtttatggcatgttctctaaagacaaattgcaacagctttctttattaaactccttttgctacctcagcaaattggagagccagttgaatattgatgaattctttgagggtgagtaatattgctacaggccggagaaagtaagggaggacaagcttaagcatttactcaagtgaacaaccttcaaatgtttttcaactatgatgtctcaaggattttcttaggacctttgaagcaaaccctgattctgcaaatggcttcttatttggtaggcccttcccaacctgacaaaactcacaggatataaattgccctaagaagtggtgagaaacttaccctagcattggaaacagg

SEQ ID NO: 5948 - DNA, 3732 bp, artificial
  synthetic oligonucleotide
tgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggc

SEQ ID NO: 5949 - DNA, 2070 bp, artificial
  synthetic oligonucleotide
ggcaccagggttgctcacctttgcacgcggcgtgtcgaagggtgcaaactcctgccttcccggagggttggggtggataaggagtttaggattaggaggtgtcgggtggcggggggggggaaggaggtggtgggaaaggaggggggaggggttctgcgtctcgaccaggctctttgtttgcattgggggcggggagagggggctgaaggtgggttcaagcttgggttctgacagcagggcagattcctgagtatgtcaccatgttgcacgcgcgcagcacacatatgcacactcgcgcacacgcacacacatgcactcatacagacaggcggccggctgtcagcagacagcgcggttcccggcgctccaggctgcagcagcttcgtctgcccgcagcgccaccaccgtgcgtccagaggggaagtggaggaggctggaggcactcgagggtcgacaattccgcgaggaaggagggaaagtggtgcaaacctagatccaccccctagcgacctctgcccccccttttctcccggggtcgcagaggtcatgggcagcttaggctccgggaaggaggcaaggagccgccggagggcggcgcgcacgcgagggggcgagggaaacgaaggaaaggaaagcaggcggactcggcgggcgggcttacccttagaagcatctttctcctctttgggcttggtcacctttccactcatagatcccagcttgcttgacaaggttcgctcagaagacggaagtcctcgccgagcgggtcggacttgggagagtgcttagggcggcaagtctcgaccacgagctcccctcggtgtggttcggggcggaatccgcttttccccaccgctgccgccgccgccgctgcctacgagagagtggggaggaaaggaaaggggtgaaggaggagccgccgtcgccgccgccgccgccgcgatcccgagcggccggccgcgggaggagccgctcgccgcgctcaagaagtgaagagacaaagcggcgcggcgcttcctccgcgccccgcgccctcagcttctgcccgcctgcggagagccacgctcgcaacccccggggcggccgagaggagcggccgggactccccggcttcactgccggcctccctgggctccgcgcgggccgctcgctgggagttgcctgggtgggctgcccgcgcactggcaggctgctttcccccgcctctcccaatccgctgcgggccgccaactcgatcaaaataaaaccccgaggaaggctttttaaaaaatcaaaacaaagataaaaatattcacttaaaaataacaagcctccctgaaagggaaatgtttgaacatgtgatgagcaacgtgtgagcctgttacaccgcagagtcgcgcagcttctcgcccgcggggaatggggaggagagggtcgcctcttttctttctttctatttaatccatttccaggttcctattattttgccaaaaagggggccggagttgctcgccggcggaggagtgggagacgatggcccttacctgctctctttctctctctccctacacccacaccccctcggagctcgcccgctccctcgctcgcgctctccttccaaagaactctccggtcctagagagccacgaatcaacaccgcggcgcattctatataaacggcaaggtgtgggcacgcggagggtgggggctggcgaaggcggggcctcacaaagccgcctgcccgctgtagtaaaaggagagctcggcaggggcgcgccgacgtcagccgccggttggcaaaaccccggcgagccccgcgtagtgcgggcgagcgtgtctgctgggcgtaccctggcccctccggggcagggagggcccgcgggtgccactgtagcgggctcccaccgttggccaaggagatggaaggccggcgctccccccaccccggcccctgtaactcctctactcctagcgcctgctttcccaggcccgtgctggtcgccacctacactttggggactcccctgttggcaactgctcgcaccgagcagtggaatctcagtccgggagtcgacgacttttcgcttctgg

SEQ ID NO: 5950 - DNA, 1993 bp, artificial
  synthetic oligonucleotide
ctggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcagacttcactaccgagcccatggggcccaggctcatggcggctgcggccgcagctgcggccgcggcggtggcgggctgctgcccgtaggcggcggccgcggctgctgtggctgagggcgccatgcccccgtagcccgaggcggcggcggccgcggcagcgacgttcatgtagctctgagcgccgggcggcatcattgggctgtactgcaggccggccatgtcgtagcggtgcatcggcggcagcgcgggcggcggcggcgggctgctcatgctcgggggctgcgc

SEQ ID NO: 5951 - DNA, 3328 bp, artificial
  synthetic oligonucleotide
ggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagc

SEQ ID NO: 5952 - DNA, 1770 bp, artificial
  synthetic oligonucleotide
tgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcc

SEQ ID NO: 5953 - DNA, 3505 bp, artificial
  synthetic oligonucleotide
ttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaa

SEQ ID NO: 5954 - DNA, 5879 bp, artificial
  synthetic oligonucleotide
agggaactgaagatgcaggcagtaccctcatgtgctcagaaggattacccattcctgagcagaaactgctcacttgccctctcattcctctgggaatattccaggtttcctctatttggattggatatcttaatagctttaaaatctcaaataaagggtttatgtccactccagttatttagggcttcctaacaagccttttagaaagagacttaattaaaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaa

SEQ ID NO: 5955 - DNA, 2089 bp, artificial
  synthetic oligonucleotide
aacgaggggaaggaccctgggtagcagacatccccagaacctgggccaccgcaggattgcacataggtgagtgagaggtgctcaaccagctccccatcggggtaaaaagaaatagcagtggcaaagggggcgggggagggtaccctgccgctttgggtgggaaatcctctttggaggcagatgtcaatctccaggtgtcacagcagccccgctatctccagcccatcctcccgccccttcatctctcctgtctgcctgtgtgatggctttctgttctgtggtcaccttgccccatccccctatgttctcacctcctgctcgttcatctctctgacttggcatgagggtgacactgcctggtgctctgtctttccaggtgacagaacacagagcaagacgtcgacttcaacgcagaagcattctggacgacaactccccggggccgatccacaaggtggcaaggaggggcaggcggcgaggtcgtctgtgctccagagaggtgcccagggcttggggcagagttcggctgcggggccgcagggccccaaaggcgcggagaagcggtacctgtgccagcagtgtgggaaggccttcagccgcagctccaacctcatcaagcaccgcatcatccacagtggcgagaagccttacgcgtgccccgagtgcggcaagctgtttcgccgcagcttcgcgctcctggagcaccagcgcatccacagcggcgagaagccctacgcctgccccgagtgcagcaagaccttcacgcgcagctccaacctcatcaagcaccaggtcatccacagcggcgagcggcccttcgcctgcggcgactgcggcaaactgttccgccgcagcttcgcgctcctggagcacgcgcgcgtgcacagcggcgagcggccctacgcgtgcccagagtgcggcaaggccttcagccgcagctccaacctcatcgagcaccagcgcacgcaccgcggcgagaagccctacgcctgcggccagtgcgccaaggccttcaagggcgtctcgcagctcatccaccaccagcgcagccacagcggcgagcggcccttcgcgtgccgcgagtgcggcaaggccttccgtggccgttcgggcctcagccagcaccggcgcgtgcacagcggtgagaagccctacgagtgcagcgactgcggcaaggccttcggccggcgcgccaacctattcaagcaccaggcagtgcacggcgccaggcgccctgcgaaggcggagacggcgcggaggctagcgggccctgggagcaccggccctgggagcgcggtggcggccaccagccccccgcggccgagcacagccgccaggccttccaggcccagccgccgctgactccccgccagcgcacccagggcgcggccggtctgcgtggggggccttcctggggacgtcgaggctcagcccccttcaggtgggaagaccgccctcccagggcctcgattgcggccacagccctgacctctttggccatcagaagaccccaggcagagcctcaccctgaggctgagaaacgcaggaaggactcagaaccgaggactgccgcctgccctggctcctccatcaacggcagtgcgggctgggaatggaggccctctactccctcctgagtcctgggccttgcaactgaggcacatagatggcacctgggccactcgtccctgagccacaggtactatcgagtgtgcacaggcgtgcgtggaggggatgcgtgaaccatccctcggatttgcatcagaatcgcctgctgcgggtagggaggaggccacgtgaggccagtgaggccagccagcgcggggcacgctggctttgagttacagaagagtggtgcatttcctccctgggggtcgttcccctcgccctaagagttgttagtgttcccaagtagaagatactgaaagcactttaatcctttaagcgcttatattgcaggtgggggaggcgctaaagttagcacagaggcaagaggctccctgaatgttggcataggatggggggctgtgccagaaaactcccgccttgtctgggtggccccagctgcttctgggaggaggagcagcgc

SEQ ID NO: 5956 - DNA, 18605 bp, artificial
  synthetic oligonucleotide
gagcccgggacgtgcgggctccagcgccgaagctgccgggcgggctgcccacacccaggtgggcacagcgcctggcaggccgctgacctctgcccaaccctgcaccctcccctcggccgcgcacacttgcgccctgggccgcgaggggacccggcccccctcctccagggcgcgcgcggagcccgacggccccagcccagagaggcacccgcgccccccgcggcgaccgactggccggcggcggcggcggcgtggcggggctgccggccccagctccgcaatcgcggtagtcacgccgcggcacccccgcacccctcccgcctgcccctctccccaaaggtccggcgcgctaattacagcaaattgaaactaattaagcttctcttccctttcccatcaccctgggagcgtcggcgagacccagcccccgcgggcgggcttccaccaagcggtcacccggaggggcgcgggcagggcccgggggagggagaagctgcggtccccgccgcgaggagggaggcgtgcgccgaggtggttaaggattgcaaatctgtttgggtctcctcacgaaatctgagttgtttagatttttttaaatgtatacatttaccaatgcctggataagtgatgtaatgacatttgtcgagttaagatctgccatttggatacccctcgctgcctttccatcactactgctcccgcatgtttctctctctctccctccctctctctctctctcacacacacacgcacacacaacacaatacacacacacactccctcctccctgcgaacatgccgtggagcccgccccctcggaagggagcgcctgggcttctcgctctcgccattacctgtcatctcggactgcgcacttcacttcctggctacgtggcactttccaacagctcccttcgccttccgagccaagactcccgcttgcttcaaatttctgactccaccgtcaacaacgcccaccatccacccacccatcctggaacccaccccacctccgtggcccgggacccccagctcccgctgtgacacgacccgggagagcccaggtgcgcgtggaaagtaccgcggcggcgtccttaaccttcgtaggaaatccggttccctttgaggatcggattcaaaccaggggcctctgccaggaaaacgcgtgtgcagataatcccaggagatgcctggacgctggagcccacccttgactcccggggggtgggggtgggggcttctactgtcccctcagcgcctgtatggagcattcacacttcgttttgttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttttttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaaaaaaaaagaaagaaagaaagaaagaaaagaaaggctaagtggggtgtcaggaggaagaggttgggctttttaaattttttacttcaatatcaggcgtctgggggagaaaacctccccgatattttcaggaaagtaagaacaagagagagtggatgttggagttggagcgaggttggcagtagcaggggcaggggcaggggcgggtggacagccagccgaggaggtgccacgtcccggagcgccgagggctgccatgcccgcatccagactgctgtgaaggcggctgcgctctctcagtgccgtctcgggagtgtgctggtcctctgtttccatttggtcttgagtggtgctgagtgaggtgacctttcggggcgcgcgcggggcgcgggtgtggagggcagcctttagcacacctccttgcccgtgctggtgcccggcaggatgttgagctgcgtgagctgcgccgcgtgctccttggccttgagcctcagcgcggctatgctagaggcgcgtctgtctgcggccgccgtggccgggtcggccagggcgcccgatgccactgcgccctccacggcgggtgtgggctgtctcaggagcgcggccgcggtcgacgcgctggtcaggggggccattgtggaaaagagcctgcagggagagcaaacagcgcggtcatggcctcgggagctgtgcgcggcgcctcgggcagcgtctcccgccgcttgtcgccggggcagctgaggggcgcggtacccacgggacccggatgggccgcggcggggaagtgggcagagggcgcgggcggaagctggaccccgcagagagggctttcctggggcagggaaccgactggggggaaaagaccgagtccagatattccccgaggggccgggccgggccggggtccacaggccggcgtggagacctcaagccccacggcccagtggcgtggattcggtggtttcgcttaaacggacggtttattccaaggccaggggctgcaatgacactatctcccaggagagaatgcggaaggagaaaaggagaggagagcaaaagaagggaaggtggagggtgggaggggggaggaaaaaaaagacggagaaggtgggattccagctgcccggacgcacgccgcaggctctgagatctccctccggctccttggcccgggactttctgcgccctgaagaaacaggcctagctcgccggcctcccgggccacccgcgccgccgcggccgcccttccgcgcgggactcagctacccgcgtctggccagcgcctgcgggtgagagtgaagggcgaccgcctgttgatttcggctccacgggcgggtgtcacctgccagcagccccacatcctggcgcggcgaccccagctgtcttccccgcgcccctgtagcctctggcctcagggagcccccgacccacgaccctggcgcgcggcgcaaggcgatgcccaagcctgggacccacgccagcgccaccgcctccaagcggcgaccgaattactccacgtgacgcttccaccccatgcacacagcaccgggacattagctgtggccggagccgcccggggccaccggacaccacccccacgcccaccgccttggagcgcccgcgagctttcccgaccgcctccctgaggggtctggctccaggcccgcggggccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgg

SEQ ID NO: 5957 - DNA, 2074 bp, artificial
  synthetic oligonucleotide
tttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacg

SEQ ID NO: 5958 - DNA, 4967 bp, artificial
  synthetic oligonucleotide
atcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgac

SEQ ID NO: 5959 - DNA, 1898 bp, artificial
  synthetic oligonucleotide
aatggaaatactttcctggggtacttgggacagggtcagtgggctggggtgttgaccagacgcgtggagaggagagcaggccggcagctcttgagagtgccaacttcccacgggttgagctctctgggaacaggactgagagggacccaaccctaaccgcacgagccgcacactcagattggtgccatcgggcgcgcggcgtccttaagagctccctgaaaccccgcccccttcctgctctgggggcgtggtatggggcaaggaccccgccactgagcttgctattggctaagagagcagggttggccttgcgttcgcctgagcaagggagtagacagcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggt

SEQ ID NO: 5960 - DNA, 1198 bp, artificial
  synthetic oligonucleotide
gtaggcctgaggtgggagtagaggaagtggcagcgaggggagaagtggaggcgccagtggtagcattgggggaggtgggggcgcccatggtggtgtaggaaacatatggtggcgccagtggcggcattgggaggggtgggggcgccggtggcggcgtaggagcagctggtagtgccagtggcggcgtggggagaaggggcgctggtggcgtcattgcagatagtggggggcctggtggtggcgtagaaggaggtgttggtgccagtggcgggtggagagaagtaggggcaccagtggcggcgttgggggaagtgggggtgcctgtggcagtgtcggggaagtgggggtgctggtggtggtgtaggagcatgtggtagcaccagtgacggtgtggggagaagtaggggcaccattggcggccttgggggaagtgggagcgctggtggtggcgtaggagcgtgtggtggcgccagtggctatgtaggaatacgtggcgccggtggcggcgcggggagaagtgagggcgctggttgcggcactggggggaggtgggggccccagtggtggtgtaggaacaggtggtgtccctagtggcgggtggggagaagtagggatgccagtggcagcgtggggggaggtgggggtgccagttgcggcctaggagtacttggtggcgttggtggcataggagcacatagtagcgctggcggtgtggggagaagtggaggcgccggtggccgcattgaaggtgggggtgccaatgggggcgttgagggaagtggggggttctggtggcggcgtaggaacacttggtggtggtggaagtggcctaggagcacgtggtggtgctggtgggcgtggggagaagtgaggatgctggtggtggcattggaggtgggggtgccagtggctgtggggagaagtgggggtgcccgttgcagcattggggggaggtgggagctagtggttgtgggtaggggtgtgtgtgtgggggttgaggtctctttggctgaggactgagtggtggtgggagacaggagtggggtagggcagaagttggatagaagtgtgggggagtggaagcctgcttggaaaaccggttgggagcagttgaaggtggctggaggtggttggaggtgcgagtgtgggggaagggtggtggggttgaggcctgattggtggaagactgaggtgagaa

SEQ ID NO: 5961 - DNA, 3665 bp, artificial
  synthetic oligonucleotide
tatactagttgtagaaccttcttgaactgcttcagggacaattaattatctgaaggaatgcatgaaaacaggccacgcttagaatcattaatgtagatgcaggtattctgttcaaagtattttactggccagtgtggtggctcatgcctgtaatcccagtgctttgggaggctgaggcaggaggattgcttggggccaaggagtttaaggccagcctgggcaacatagggagattccgtctcttcaaaaaataaaaactaaattagcaggagtggtggcacgtgcctatagccctagctactcaggaggctgagaccggaggatcccctgagcccagagtgaattcaaggctgcagtgagctgtgaccacaccactgcactccagccagggtgacagtggtagatcttgtctcttaaaaaaaaaagtgttttgctaatggattataaaggattataaggatgtgaacatttgtaagaggaaaaatgagaagagaatgaagagaaggaagaaaccgaagtacaccaaagtcaaagaagtgggttagaggagagtcagatgggagctcagtgtgttgaaaataagcgttctgagtggaaaggtcctaagtgcatgaggacatatgctcacgtactctggttttctgaggacaataatgtgccccctcttttctgccttctggaatggagagaaatcaggccgtgaccacagggttgcccgcactgaaagcacatctcggctcctgtaaccctcttcggagagcatcccagcagcccagcctggccagggatagagcctatcccagctggcggaccctaccagaaggaggcgtccctgggctctctttttgcataaactatggagtggcgtccctctatctgaattaagtctattgttccagaaaatgggtttgtttctattcatccactccaatggctttacaatgtccagccactgtgggactccctagagacattgtcttcttgaacagtcgaataagatatttggttttttggtccttatttccaagctcctgggtgctagaaggttgtattcacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccct

SEQ ID NO: 5962 - DNA, 3681 bp, artificial
  synthetic oligonucleotide
caagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcggga

SEQ ID NO: 5963 - DNA, 2037 bp, artificial
  synthetic oligonucleotide
gttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtg

SEQ ID NO: 5964 - DNA, 1592 bp, artificial
  synthetic oligonucleotide
gagcaagggggtagttctgggagctggactctaagccttgaatgaaagcaggtggagctgagacaggggtgggagctctcgcctaggaggccgggaccgtggctgcagcgcgggccgagcctcgaaggcagcagggctgtggcagctgatttcctggaacaggatcctgcatgggccgtgggcatgtgaggcggtcggccggcacacaaatcgcttttggcccgtgggtaccaggcagctgtggcctccgcctgccttggggtcgctctgtccagggtaggagacaatccaggcagcctggcacgaattgggaatctaggaaaacctcgcggtgtccaccgtgtaagggcacaagtcctggggcagcttttgccggaaactacctctggactccttgcctcagtgaggaaaccgtcctgggcccactcccagtcccagaaacagttgtctcttgggcccaaagcaggaaacgttcaacctccatccaggattgtctgtttgcctgccactatacaaactgttcaacacagctgcctgtctcacatatagaactaattacacaattaatataagccttgatctgagacaaagatcattaggtttctaagcaaatgtgttcgctcctcggtaatttgccatttttattttcaatttccaattctatactaagacatcatggggggttctgtgacagctacctttgcccctccgcatcctccaatgtcctctgcttcctcccaaggaccctataatccaagaaagacaccttttccccaagccagtaagatgttctgcctacactcagacatgacacccttcccttctttttcccaccctccttcttgccaacatctgccccaaaccccccaaacctctccatcctcctattctccatgccttgctagagctgcatctggagtgcacagcaaaaaggggaacataggggccagtgcggggtaaggccaagcctagcaaacaacttaggggcagggttggtcttccttgctgggaacaggcagaaaccctaatgaggtctatggtatcttggaaaaatgcactcaaacatagctagagtacagtaggttgggaggggtaatggaggggtgcaggtgtctgtataaacttgcagcaggtcctcaaaagggtgataaggtggagtgggaggagagggagtgttaacttggctcctttccctttcattgcttgtgattttgcagtccccttttgttcctcttcttaaggaataggactcccacactggcctcagaggcttcctgaaatggcataaagataccagagtaactcattgccgatatgtaaccaaaaaaaaagatcatgaaatgatggagagatgtggggtgggggtagcgaaagtggaaaaattatgagcacacctcccagcagctccaaatatttttctgattttgtgcctaagctgagcccagtaacctacaaggtcaacataaatcagtaataggctcttgggataagtggtctttaattacctccctaaagacacatcttgatttcttttcatttcccaggtctgctaagggtgttaagtttaaggagaaaccaaaggaaataagatt

SEQ ID NO: 5965 - DNA, 3339 bp, artificial
  synthetic oligonucleotide
tgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaaggcttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactctctcattcaggcttctcaatgctgatacacagttacattaagcagtccaagctgggatctcatattcctggctccccgggcaacagttccctttagccttttctgctgatcaatacatattgtttactcagagtaaggtttgtttggtcgctcctctctaggaagaacaaggagtgggataacgtgggggcggggtggggcgggggagggattgggaagacagatgtgtgcctctgaataacctttcagcgccttggttatagcagctgtatttcaggtgaaatttgttttacaatagactagttttgcatttttaaaaacttctatagcgtttctaaatgtctgcggtgttttactacaatctgtacacaatatttgtgagataatttgtatctaatcgaccactccatgttattattgctattattattactacttcgttgagctgatggctttttaattgcttagaaaagggaggagatgaatgggaataggcggggagagagatgcctatctactcaccgcccccccccttcccaaatctctatgaggaggagaggatacaacgaagagagttattgatgatgatattggttatattttttttccggggtggagtgcctaggaagggcagaatagggaagcctattaggtttgcaaactagtgcgaagtagcagcggcgatttcgcagctttctgccctccctcctggaagtgtggagcccgcgcaggctaccgcagcatagatcgaggtatctgagaaggattcggcggcaactctgggccaaagaggtggcctgacagtctgggagggctccgcactcaccggactccaggattcctgcgcgcagaaatccaggcccccagcctcgctagggcgaccttccgcgcgacctcacttcggccctcctagaggaaagactttgccttcacacgcgattactttcactggagatcacgacccggagacgctggcgactgggccagcgcctcccatttcggttcacctccagttcaccgccccctctgagtaagaaacccttggggaggggtggcgagggagtgggggataggcattctctgctcagtgcagaacggcaatgaaatgattggcaaaggtcacagggattctggtccatccgcgtaccacctctccccccatgtatataccgctgtctgtgtgtgggctcgtggggagctgtctcggcgtttctgataagcacagctggtggaagcccacagcgacgatccagcgagctagcgagcgcccgggaggctgggttcctgctttttaaaatataaatatatatatatttttaaatctctgtgtgtatgtgtctctgtgcgtgtgtgtgtgtgcgtgcgcgtgcaaacgtgtgtgtgtagatagctgtgtgtatcgcgttactatgtacaaaaacaaaaagtacaaaaaaaaaaaaaaacctggctaggctgtgtagagatcccaaaaatatgcagttgctgtggctttattgctagctagtatccacacaccaggtccacaggcgaacctcattcccaaggagcacacacgtgtgaggccggccaagcacccaacacccagccgccgccggccagacctggctgggggcgctgcacgccactgctggccgcctagtccggcctttaggcgcagctgctgtagacaaagcttcaaactacctaaggaccagaaagcccggcccggttgtcgaggatgcgttagtatgagttgccaggcctctggtccaccacactgtgtctccctcagctgcaggtcgaagagcatgtgttaattcaaatcccggacccttctacttttttgtcaagtctctgcattctgttggtagttaggttttagttctgggattttatttttttttcccccacactgagttcatgttttacaactgttgggagttttttgtttgtttcgattttttttctttgcagttaattgctatggttcgaacctgagttaacccaaatatttctgccgactttataactgtacagttttgtatattaaacgtttttgaagttattaatttaaagaaagatcatttagtttattcatttagtaactgatgtataataaacgctattttcattaagagttgctttttcaactattttattcaaattgcctattgcagttgccaacaattatttattttcaataaattctgcattgtgtttaaaaggaaattctttcacagataagttggatgtcaaaaagaaaacaattcgctgtaatgtttgatgtgaagttttagtcaaggggtttata

SEQ ID NO: 5966 - DNA, 1087 bp, artificial
  synthetic oligonucleotide
ctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaac

SEQ ID NO: 5967 - DNA, 2945 bp, artificial
  synthetic oligonucleotide
tgctcaggaaagctagcagcccgaaagcggcgcgttttcttcagcagcgggtcccgcacgcgagagtgctgccagcacgctttctgcctccttctccaggaggcgagcagtaacttcctaagcttacctccatctctcccccgcccttcttgctggttctccgtcagcggggaggggccgcccccggatcgatgggggatgtgaggtgcagggagtggggaccagaggggggtactcagcagttggtgctgcgccatcccttcccagcaggcggcccggacactggttcacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgc

SEQ ID NO: 5968 - DNA, 2910 bp, artificial
  synthetic oligonucleotide
cagagttcatcactgcaacaagacagggtagctgccaacactccctctcctttcattcagtacctgtcccaaaaacactgtgccccagacaccaagttgtggtagttggtggttttcctaaaaatatgatctctctctctctccccctccctctctctctctctgtttttcctaccataacttcatggagacagctatgcaaattttaaaatgataattgcgtttctgctcaccatcattatgtgacagaatccattcaaacactaaatgattgtcttccagcaaattgtcagatcaaaagaattgatcaacttggactgtcacaaacttttcaccctacaaaaagaagcactgcaagtatgctgcatgcatttaagtaggaaacaaaagcaccaggattttcacacagagacacagataaacacaccttattcatccaagacaaagaaagaaaacttggctttacctgcagttgtaggtccggatctctttgttgtctcgcttgcacttgattgccacgaagatcatagttacaaagaggatgcccgcaatggagcccagggcaataatgaaaatcaaggacaagttcacagagcccattgactcttgggcatcgagagcaggggacaagtagattaggacgagagcagaggcagagagagatgtcttgccgtggtcgtgagccaccacgataagctcataggaggacttggagctctccccgaaggtgcgggtggttctgacttcgccattgacctggtctatttcaaagaagccgcggtcgccctcggtcatgtcgtaggtgactcggccattttcgccctcatcgtagtcttctgccttgacaacagtcaccaggtagcctatgccagagttgcggggtatgtagacctcggcagtgccgttaatcagaggtggggctgtgatgaccggggtgttgtcgttgacgtcgaggatgatgacccgcaccgtagcgttgctttgcagtgagggaaggccgccgtccttggccagcaccttgaattcgaacgccttggtctgctcgtggttaaaggatcgcagcgcgtagatgtcgcctgagttgggattgatggagacataggtgaagacaggcatgtcccgcacctgcgacggcacgatctggtaggagacactgccgttgagacccaggtcggggtcgcgagcagacacagagagcagataggcgccaggcgtgttgttctcctgcacaatgacctggtagtagggcttggaaaagtgcgggtggttgtcattttcgtcagtgatgagcacggtaaaggacttggcactctgcagcatgggcacgccgccgtcgcgtgcctgaattgtgaggttgtattggtcgtgctgctcgcggtccagccgtccgtccaccagaatagtggagaagctctcatattcctgcagtcgaaagggcacattgcccagcaaacggcactgcacacgtccattgaggcctgagtcgcgatcagacacccgcaccaaggcgatcacgtagcccgggggggcgctctcgctgacctccacaagctcactgttgactgacagcaggttgatgaccggcggattgtcattggtgtccagcacgctgacggtgaccttgcagtgtgccgggatggaattgggccccaagtccttagcctgcacgtccagttcgtacacgtgcccctcttcgtagtctaaagcgccagtgacagtgaccaggccactgtgcgggtcgatctgaaagagctcgcgcgtgcggtcgttgacgtagccatagaaggagtagaccacctggccgttggtgccctcgtctggatcgctggcgttgaggcggatgacgggtgtgttgggaggcgagttttctggcacgctcaccgcgtaggtggactcgctaaacaccgggttgttgtcattggagtcggtcaccttgatactaaggccaacggtgcccaggcgcggcgggtcgccaccgtctagcgcagtgattcggaagctgtagtgcgactgcgtctcgcggtccaggctcttttccaccacgagttcggcaaagcgggagccgtcgccgcgcgtcttgatctccaggccgaacagctcgttgggcgtgagctcgtaagtctgcacgccaaagcttcctgagtctggatcgtaagcgctgtccagcgggatgcgcgtgccagggctggctgcctccgagatctccagctcgatctgtgctgccgggaaactgggcgcattgtcgttcaggtccttgatctccacctttatcacgcagatttccattgagctggacatgacctcgagcgagatgatgcacttggggctctggcggcacagcagatcacggtcaatcttctgcttggtgaccagcaggccagagctgggattgatgtccactaggtgtggagccgagttggacaccacgcgaaaggctgaagcctgccgggggtccagcgcgaagcccgcctctcgcgcgtctttggccacgttggcaatcaccgtcccggcgcgctgctcctcttctaccgagtacttgagattaatgagggcggcagcctgcgtccacagtatggccagcagcagcagcaccggcagcaggagcgactccatggctgcacggggctctgcctggcctcgcctctccacacccctccgagaccgacgccgtcggcgctccagcttcccgccggctcgggccgcctgttgcgcgcgccccgtggccccggaggccgcgggagaagtcccgcccagggcggcccggcggcgcgcgggggacacccgcggcggctccaatgctgaggttgcggcggacgcggcgggggctcgcgggggccccgggggctccgaggggccaagggagcgccgcgcggccccgagccccctccctccagcccggctactcagttt

SEQ ID NO: 5969 - DNA, 2453 bp, artificial
  synthetic oligonucleotide
ctcctccggatgccgcaaactactggccgcggagtctggagaaagccggagaaagctcaagctgccgagcccggctacgccaggccctggccaatcagcgcgccgccagcgggctccagtcttggggcggggccaagcggaggcggggggtagcgggggggcggggccaagcggaaacttcacaccggcgggaccaagtggtaccccggcccatggagccctggcgggattcatgggaggacggacagacaggccaggcaggccaggcaggagcaatagggcaggaatgagcagggaggcggtgtgctggcgctgcggctgagcctcgccgggaactgtgcgcttctcatgtttgcagagatttcaggaaagatgaggatgatatgattgtcttatcgtgtttacctcccttacatatcttcatatcttgaatataatatatacatatatatacacatatatatatatatacacacatatatatatccctctatttctccttgtctcttcaccctaaaaaatcgtctgtttttgttttcctctcttctcattctctggtagtggaaggaagaaagggaaggagaaagcgcccctgaggtggtcattcatccagctcttagccggtgtgtcttcacatcaggccagagccacggccgccacccccccggaccgtcacccccatccttccaccccgggcagacgccgcactactctctgcgtgccgcactcccagcagggcccctggatcggttcgctcttgtctgttgcttgttaatcaaatgggatatgtggcacagagaatgagctacggagggggccggacacatttcattgcccctcaccccaccctgttggagaatttagctccctataaataaactgtacgtttgagaagagccggtggagcggacgccgccgcgccgcgccaagccagcagagctcaaagccgggcaggagctctggggcgggcacgccatacatgtccgcttaggtcgccgacagctgggagccggcgccgatgtgcagggcgccccagccttcccgcggggtctcggtcccagggggctgccagctccacttgggcggcggtggtggctgcggcatgtgccagtactgggaagcgggaggccggcgtggccagggctgacatcaagctcatcctgccttctgcactgaaggctccctgggggcagcggggcattcctccccacccgggctctgaggcttttaattaaggtcgccagcggcaaaaaaatcaaaaacgtgcccgttaaacaagtttttttttctcttagaatgtggggaagctgcttctgaattcacaattcttggaagagtaaaaatgtcttctgagtgagtcgtctcggatatttgggagtgggataagcagactcataattagcccagcgacattggctcgagcctgtgggcttcacatgagcgtcatttttgccctctaaaaagcgttaaacaagaaaaggaaaccggcatttggacacataatgggttttctcaaaactgccatcttcttgtggagagcaacccagctgctttttaaaatatttttccttccaagaagagctactttagcagcctttaccttggcggtgggagaggggaaaggcggcttcctcttacagaaagaaattatttcgcgagtgagattgcgatcccctgaatatgtagccgaggccaaagggagagcgtagggagcctgatccgctttccgcgtgggggtcgtttcactgtttcacgttaggatgtgattcggcccagaacaacagggagaaaaccgatgcttctgcaatgagtatcatttaattttggtcatttagagctgcgggtggacaccagagtggtggctcaagggagcccggtggcccgaccggttttctccagacaccgttggagaaatgggcaagtagtagagaatgacaacatggcaggcagcggtgggcgcacctcgcgggctccgcgaaaggaagggttccatttgatttatcacagttatttacctttgatgtcagagcatgggaatgaagtgcatcttggtctaattaaaaaggcctaaaaaggcatttgaaatgggtttgctatctgatcacgggatgtgaattcggcgtttggcagctttctaaaatattgcttggactatttaaacagaacaattagcagcatgctaaaatgtttgcatgctatgcttagaagcttttagctgtaaactttaaggcgatctgttccccctttaagttaaaaaaggatgatgctgcttccttgtggcgaaggctgtcaggaacccactgatcaataaaagtaaactggcgcctccacggcttgattgagcgggagcaaagagtctgagaagtagtctcggccattaacaatcccccaggtaacgagaaatggaagaattactcaggtaaaatgattaacattgtcgtagcatctgaaaa

SEQ ID NO: 5970 - DNA, 2867 bp, artificial
  synthetic oligonucleotide
tcctccgcgccccgcccaccacgtcccccaaaaaccaagggcggaggcagcgcccgtgagccccctacgtggcttttagctccggtgaaagggtcccgggatgaactgggcgcctccggggcaagccacttaccgcgccacaacgtcgggatattgagattcatcgaaaaagttctctagctcctgcagctgaaactgcgtgaacgcggtgcggcggcggcgtttcctctctgggggctgtggtccctcagcggtttgtggcccctccgccggctgtggcccctccacggtcgtctggggcggctcctcctgctcttgcttcagctcgagcaggggcggctcctcctgctgttgctccggcttggtcaggggcggctcctcctgctgttgctccggctcgtggccgccgccaccctcacggtcttggtcgtccgaggggacggacccttccgtgccaacgttgttttccgcttctgttccgtactcaggtttggaccgtgtattctcctcgtcctctcctccccttgccatcagcgaggtcacggtaagtttctcatctgggaagggaggaaagcaaaagagacaccagggcgttggagcccacggcgcgtgggctggaggaggcaggggacccgctatggaagagcaactgcgacagccgcgcagcgtctcctccgcttgcctctcccagggaaaaattcctcttttggagttcgcgaaagctcccgtccctgtccaagcactaaccattcacttcctcgatgtcctcgccgactgccaggctgcggtagccaatatcactgtgggtgtacccgcgaagagactccatgcttcaagcgctgtcgataaagctgtgcacttctgcagactctgtgcgtggttccgcggcgatcccggggttggaactggctctgggaccaatggctcgggcgagcgcttttctggcgccgggacctctttctggcgccgtctggcacttgcgcgccctatatagcggtacggtgccttccgcaggttcaaagcgtatgcacacgcgtcggttaaacgccccctattagcattcacagtacatctagttgtgagtgcgacccccgggggacgcattcgtgtccagggcgtacgaaaaatagggcgagcgtgcgcaagcatggtgcaggtagtgaacatgctttgcggggaacagtggccccaaattgctgcttaactaactactcccaacttgagcagagacccagattggaaaaagcggctgggttgtgaaagccgatttgggggcgaggagacgagggggcgagggggcgagggggcgagggggcggggtgagacctcgcaccagcccgtggagaggtattttggcagtgttcctccgcccaaccgtctttaccccgcagcacttgggtggagcgatgccctttgcttcccccacggaaaagaccgagagatggcgttgaggaaagcgcggaaagttcagcagcccaaacatgcgaaagtgaacttgttagtctaccatgcaattgggttctgagcacgactctcccctgctagaaattagtgacaaatggataggactatctagttctgtacagttcgcgccaaagtcaggatagtgataaggtgcaatgattggctagaaggctgcttgctctggatttttgaattcagaacccaccgtgcattccgggagcgggaatttggggctgaatttgaagagcagtccgctgctcaggtgcacgctgcaagaaacccaacgtgctttttgagaaagctccaaggacttaagctttttagtaatgaacttatgtcagagtgcaagtatagaaatctgctaagtgcatagtgcatccaagaatgcttacactacgggggccccgtcttttgatgcgcggcacttgaaacgtctgctgtactaggttcctgcgcttcttattgcagcgcgctttgcagaagcccgttctgcaggctcctaaagcgcgcgtattccccgggtttgtgctgtggacctgggagagttcccgccttccccactaccccttcttcctcctccccctccctttttctagaactatcttcctgaattcttgctccatagtgatgtatcacattaaaagtcctgggctatgattgaaggctgtatggttctccctccaataagtgtttgcaggttctccaggacgtgttaatatccgtaatattataaaaataactctgtagacttagttactagggaggctgaggtgggaggatcgcttgagtccgggaggtcaaggctgcagtgagccatgatcaggatactgcactccagcctggacgacagtagaccctgtctcaaaaaataaaaaaattaaaaaaatttttaaaagcctgctaataattggccctatgcttgccactgtacacgatttatcttactttcgccttgataaccaccattatcatccccccccctttttttttttttgagacggagtctcgctctgtcgcccaggctggagtgcagtggcgcgatctcggctcactgcaagctctgcctcccgggttcacgccattctcctgcctcagcctcccgagtagctgggacgacaggcgtccgccaccgcgcccggctaattttttgtatttttagtagagacggggtttcaccgtggtctcgatctcctgacctcgtgatctgcccgccttggcctcccaaagtgctgggattacaggcgtgagccaccgcgcccggcctatcatcccccattttttaaaaaaaatacagaagactggggcccaaagagccaggcaacttgccaatggcaatacaagccagttttaactacaaaatgtgtgcatttttcactatattacggctgtcttaattcaaagga

SEQ ID NO: 5971 - DNA, 4005 bp, artificial
  synthetic oligonucleotide
ttaagatcacttttaaaaccataaaacagactggtatgattggccaaacaagcagctctctttgatgaataccaagagcccatcccccatccagaaaaaaaaatccattgatctaccatggtgcgttaagtttccaattctcgggagtcttcttaaagtttctggtgaagggtgatgtaacccaggaaagtttagtcatactagtcaggcattaatcagactggagcaccaaccatcctcagcagacagagtactgaaaaaatggtaggtacacaaaggagtaagttttgatagggtaggaggtacagaacttgatacataaaagcactgggtattagagtgaaattgggtcaaattggttgtatgtgccactgcattccagtctaggtgacagagcgagaccctagatatagaaagatgatgaaacgagaaaccaacaggacaggaagaggtttgtttttattttaaatgtattgtctacttgatgatttgcctagggatcttattggctaggatcctgaatgagctcccctcactctgactgctggctccttaacaccccaatgtaagtgaagggtcccgtggcttgatcaaatggtctcatccatggacagccctgctggtcagctaaggcccagggtccgggggctagtgccatgctaaaggccagactggaggtgccagggatccaaccagaaaggaaagacttgaccaggtggtgtccttccaccaaggggccaccccgtgttgctgcctgccgtacccagctggttggaagcacctggcagttggcattgaggaccactaacagtaaagtaggtgcggagggggttggcgggaggtggtagtgaaggttgcacagggccagccggctagcgtagggaagtttgcatgagctccgtaggcaaggagaaatggaaaattggctggctatctcccttcaaaagaattggctgttaaaaaaaaaaaaaaagaaaaaaggaaaaacagaagcagaaacggcaggacatcttctgttttaaaaatacagaccattttccccctcccatgtatataaacaacgaaaaccaggagggtagcttggtattggttcccgcccgaaggtcctttcctttcacacccgacctctctagatccccgacttaaccccgattgaagaagaaattttccaggatgggggtggggttttgctggatttgtcgaaagagatggtccacaggggaagagtgcataaacttggcgagaggcgagagagggagaataaccttaatcatgcacaggctccggccttaacagttgagtgggtggtggaccgaggccaagcggccaaataagtggagtagaaaggcgcgagtctgcgctgcgtgccacgtaccaaacgctcaattctccctcctgggccctgtatccatctctcgttcgctctctgtggctaatgcagagcgatggaacagcctcgggagaatagctggagaaagctcagagaaagacaaattaaaaggagctcagcgcagcagcaaatgctggagaacagcgctcagctgacccgttaaatgagtaattcggtaaaggtgtgttaatcagtgcggcgccccgagagcccagcgaaacactctgggaagatacctggcgtggcaacgggactcttcaacgctgcgatctagaaacgctgctagtcctgggtcgtagtccctctcccctgtctcgcttaaagagaggggttcctgggttgcaatacgttggagagcaggtgatcagatgcatggttggcgagcccctggcgcatggcagaatgattgaggccagggtcctagctgcaagcccatccctgcgtcccagtacattacctgcctgccccatgactggcggggctggagaaccctgagacttaaggatcttataggtggcaggggtggaaaagaagagttctctccggtcctggaaagctctaattgtcagaaaaactaggtggtttgcgtctttaaaagcaagttccagtctgcggggaaccaagcaggtgaactcctgactgaactagatacctgttcagcggctagaactggagactgggagagctggaaaacttttagtggctttccatacctgcactcagttgagcgctcgccccaatcctgtacgccggcctactctggtaaggacgctagacggcgctgccgggacacgctttccttctccggagaaaggtaagagagcgctttttttttttttttaaaccaggggatgggggacttggggttggcagcctttctcaatctgcctcccctccccgcgctcccaaatctaaaggggtgtggaagaggaggaggagcagaagcagctcttttcgtgacgcgccagagcgcttctctctaattcccacctcctccccggtgcaatcagtcagccaggaggctccaaactgttagcgacaaaaacgcagctctcggtcactcccactaccctcccacccgcactccaggcatattttggaggcggcagcagcggtggcaggatgtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcct

SEQ ID NO: 5972 - DNA, 1942 bp, artificial
  synthetic oligonucleotide
gggtcacagccccatgcctggaggccatctatttgccttctcttctgctagaggagctgaccttccccaagctggccacaaaaatccccataatgccagcttacaaggtaaagtttccatgctcttccatgccttctttctcccttgaaaataacaataaatttaaaaatctgtaagttccctgtcaagttctggtcaaacacgtagtttcccctccccgcacctggggaggggggcggtcccaagagccatgtggctaatccctatggagtctccaagtggctagcctcccacagagccttgcaactagtgagcccaatgatctagcctggattgttttcctggcctggacttgccctttagacaggctaaaacggtctttgccattaggggccacggggcattttcccccacaccccacgttcagcaaatcgtattgttaaaaaaaaaaaaaaagttttgacttatgaacagctcttccctttagcaaagattctcttcagagttcctttaaatgttgtattttttgactccgtgtcttatttctaaaaactaaatgtgtatgtaaaagtgtaattttctgttaactagttcacctgcccttctctagttaagaaatgttaatttcagactcacatttaggaagattcagtagagttttactgatcatccaggaattcttaaagtgtgttttaaaacggtttattttgtgtggtaaaattgtcaagatttgaattattggaaagtgtaatagctgaaagtgtaatttcaaatatgtatcatatttgaattatcgagaaaattcgatccagcacacccgggtttgtttttgggggaaggtagtggttggttttctctgcaaccgttaacagagaattttctttatttagcgagacccggttcctcacacaggctgtggccattacacagctcactgagacttgaaagttaaggaatgtaaagaggtcaaactctggcattgaaacagacaggaaataaacaaaatctaccaatatgtaaagatattacagaaattagaagaatgagtcagaaatggagagctctaggtcagtgggaagaattattcgtataaatcttcttagaagaggtaggtaattattaatcaaaaaataaagaaagaaacaggaaacaagtccccccacatcgctttccgaccccggagttagggtgcgcagaatgccgtctgggagctccagagaaagtaagcagtgtcgggacatttactaaagtgctctctgcagagcatgagtttagaatgcggttagtttatgcaccgactccccttcccaggaatgtttcaaggggctctttctcaaagctgaatcacgtttgtgagattcttttaagccatatgtcagtcccccagcgctttaaaggaaaacggaagcaaacaacttgggcacttggaaaagttttgcaatgaatgagcgaatgaatgaaacccggccggaacgctggaggctggaagggatgcaggaattttctccgcgcgctgcgaatacggcatatgcaaaacttaggacccagggcaggccgggctttggagacgagtcagtcttactcaaccctgcgcacctgagaacaggtgctgttctgagtgaacgactgggacctggcacgaactagcctggggccagaggagataaggcctgccgggagaagagttcccagcggctctgtccattctgctcttgccctcggctaatggctttgaaggccaagctgtgacagccccggggcgtactcggtgccttcctctgttcaaataggtgctcgcctaggactgattcccaacccatggcaagtcatttccttctgtaactcggtaggtctttgcaagaaatggagcgataaaatcagagggacagaaagagaaaacagccaactagaaaagtcagaagtgtttcttgggaagtctagg

SEQ ID NO: 5973 - DNA, 3229 bp, artificial
  synthetic oligonucleotide
cgaggagggctgacttttcaccttagaactcacaaggcccaaatgtgccaatgtttaactgtctctccgaggtgcttctgacacccggaaattcaccatgtatttggcatcaccaggagctcctcaactccactgcttcctcctgcttctctcttccctggccttaacttcaccacccagacccactgtccagcttcccagtctctctgggtccccactgaggctgccctttttggggaaggaagagtggccttttttcttggccctcaaaactcctctgaaggggtctggagcccgctgggagaccaagagcttctcttgaatctcggctgctgcatgtttagtattcacagcatgtctctaaaaaacgtcctgagatcattcatcaggcactgtgctgtgtgcctagctgctctccttccgggtgtgtgtgtgtggccaggaccctccctccatctgctggtgaacacacatgcacacacaccttaacctttttcccttttcaccaaaccaatcgcattttctaagcagacctttgccagctggcagatcgctcccttactgaggtgggctcctggcgttgggcctgggctcgaagccgctcacactccagtgctggggagaggcgctgagagcaggagcccgagccgaaactcaaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagcgtgcccaactctggtagtcataccctccacgctcgagctgttgggtttcctgcacacacacaccacagccccatacacacacactgaaaccactgcaggggcaaatgtttgacaccttcccccagaagcaggtggcacctccacccttgcagctgcaactaaagagccccagatgacagcaaacgccgaattctgctagacctgcccctccccttggcatcttggtccaggtgcaaaaccctggagtccaccgggtggtcttagcatcctgcagctcttacggagggcggggcagtctctggactcctgccttcggaggaactgctataagcgcaaggctcccttgggggcgcccttctcgaagtggagggtgggggattctatgctgactcagagcgaagcaccaagtgagttttcccagctggagaccggggtaaatggcgaactccacctgggcctagaggacccgggatagtgtgccagttcagccacagaggccctcagcttggaggccctgcccctccctcgccttccttgcccatgaagctcactgcaggagaagcagggggaacccagctgccagcttcttgggagctaagagaggcttttcgggaagcctttgctgtttccgctgagcaaagagatcttgctctacccggggagacctcaacaagacttggccgtgcccaagcaaacatgccagcgtctaccca

SEQ ID NO: 5974 - DNA, 1711 bp, artificial
  synthetic oligonucleotide
cacacacatgttggtgccctatcctgatggcgctaaggacactaaatccatggctgggtttcctgatgttgtctgccctgcctctaaattgcctcagttgttcccagagactggttcttgccagagtgtctcaaactgaaggacagcagctgccttgggtcttcccattgtgttttttccctcccttgtcctctccttgcctccccagcaggatttctagaaagcttgaccggtacaccaatacacgcctgcaacgacatggattcatccgccctcctgccacacatagttcttgaggcactcaagatgtcctagggtgctctctggggttgcgcttagcttacatttgaaatttaacgctgtgatccatggaggaggcgaatccctcccatccagaggctcaagaaattctcacaagtctctgatttttaaaaattttcccctccccatctccctctcctaccaccagcagtttaatttgtcttgacattttgcttgccctcactgtcagtcaggggcactcagtaattttaaagcccttgtagtttcaatctgattttgcacatttgagatgggcttttgagaagggtagaacttggaactcaagaagaccccatggcagaatctccaaaggggctatggaaatgtatgcatttgaggagcgggtactttcagctacctccaaaccatctggggtctgcccaccttctaggccccagcgtccccatcagaaagcctttgcaggcagctttcagaatagggcttgcacctgccagtcctcccctcagctccgcggtactccaggcaacctcaaggtccagtcactgtagcctgagtcagacctccccagtacccctcctgaacttcctagttgccccttttgccagagatgagggtgcagcagaggctggtgggagcaaggaccgagttgccgccgtgtgccgagccacccacctgtggaagaagagcaggatggagagcatggtctggtcgatgttgcggttgcagatgccctcgttgatcaggtagcaggggtcccgcagcaccggctctagcgaatcctgccgcattatgctgttgagcttgtcggtattgaggttctcaaagaccagcttttcctgcagctgccgaaagttgctcactgtagggctgcccgggttgttgttctccccgctgctgcctcgctggagcccactccgatgggccaggtccaggcagcagttgcagcagtcgaggccgacaggtgagcggcaatcgagcttggactgggccatcttctcaggctcggaggtcgcctggcctgcgaggtcaggggcggctggcaggtgcgcgcccaccgagctggcctgaggggactccagggtgcctggaaaagacaagctgtgaggaaaagagttggaaattagcgcctaaagccagccaccttcggctcggcccccttctggctgtactgctccgggtgcgaatagaaacagctggacaaacagctccgagcggatccttcgggctcacttcctcctcttcctccttctcctccccctcctcttgaggccgggggccgcccccctgaggtgccacacgcggccccagcgcagtcccaagtttcccaagtgtgagcggggattggggcggacctgtggaggcaggaagggcgggcagcagggcagagggagagccagggcgcgcccttgctccctccctcctttgctcc

SEQ ID NO: 5975 - DNA, 4875 bp, artificial
  synthetic oligonucleotide
acaaacacattccagagccaaatactgtcttcttttaatcacctcctgttttggattatttatgttttgttccccccagacattcacgttaacaattgagatttaactttcttggtaaatcacagcaaactagcacaacaacgactgctctttaaaaagtaactttcagaggagaaaattatcctccctaaacataaatagttgattattactgcttaatagtctgtgctcttattaaattcctacacttaaatatgggcatttgcagaaaagcagcttttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacataattagaaaaggctgactgtctgggttcagcaattatgccccacgaatctggtagtccttgagtagagggagctggtgtattgctctctcttttagtgaagtccatgttgacgtagtcactagagctgtcagcttctctctgctcatgtgtgggcttttgtggttttggcttgattttatatccttttgtaataaaagaaagtcggttaggtctcttagctttattctttgggggctcatgatctgaaggctttgaaggtgatcccccatctccaggctttgagaatgatccctcacctgaaggctttgaagctgcatctttggggtcccagttataggagacttctttgtctaggcccctccccaggaactttccaggtaacattggcacatactcactgttgtcattctgtcccaaaggtgagctccgaaaagggtttggtagagagaagtaggagctccaacttttggaggaagagccaccctgaggatttctggggttttttggaattgcaccggctccaggagccataaacatgtagtcactctcactgtcattgtcctttgagtcatcctctttattagtatcaggtgcttttggaggactcggagcaggtggtgggctcactctgggaaacatcatcatgtaccctcttgaatcttcaaaaggggatcgagagtggcgcttttttgaagcagagacattttgaggagccattggcatataatcactggagcttacaagaggggtggccacccctggcctcattggcacgtatgggtcatcctcatcttcatcaaaagctctggctctgtggggacctcgagctgcaccttctgggatctctgcatctttcacttctttggcttctttgcattctttcgtggctcctctgtcaacacaaaaataaagtctgaatcttcccccagacttcccttttccaccagttcctccagctggtgggggtggaggaggaggtggtggaggtggtggcatttgctgttgcttgctttgagttaatttgccaaaataggatcttttcttcagagattttccacgttcaccatcaccatcggatcctttcccacttcctgagcctttgccccccccagagttcttgccaccacctgagccatggccatctccaggtccctggccaccacctgagccatgcccacctccaggtctctggccaccacctgaaccgtgcccacctgcggtgccctggccatctctagagcactggtttcctcctgagccctggccatttgagccctgaccacctcgggatccctgtccctcgcctgaacactggtttcctcccgagctatggctactggagccttggccatttgagccctggccacctcctgagccccggccatttcctgagccccaattgttcataggcatgtagtcacctccgcttccttcctgatcttctttgccctggggattgccttcctccccaaagttgccagagccagaaccagacacttcagaagacaggcgagctccattgttcggggcttctgcagggtgccggggacgtgctgggctgggtgctaagcggcgaaaaaagctggccggcactgaaaccgctctccttgacctgcgccctctgggcaggtgcagtcttcctcgcctggagtgggccacaggctcgctgggtgttacgaagcgcctggtgaaaagcatctcgtcttccccgtcgccgatggccctgaggtggcaaaactgctcaaagcgggaccttctgagccagcctcccggctcgagcggcaccaagcccaggtgcctcctagcggacagcagggttaacaggtgggcgccgatgctgatgctgtagctgcggcagcgggctctgtattcgtctgcacacaaggctctcatcttctccaaaaacagctcatgcatgttttgggcaaccacacagtcatcgacctgcatccagagctctcccggaccgatgacagtggacctgcctacttccaagaagaaatactgctccgagtgtccacagcgacggatgctcaggagctggacgaccacgctggccacttcggtgttcagcctcacaaacacgacctcctcgtcggttagacacagccggaacacgccgctcagctcttttctgtgccccagccccctgggtttgactattacctgccacacatctttatagaagggtggctccgccgccgctgccgccgccagcgcggccggctctccgtccggctgcgcgccgagcgtgccgcagcggcggcgcttgctctcgaggatgaggcggctgagcagcaagtaccagctttcctgctccgactcgttctcggccaccatcgcgaagtattcgtcttgggtgaaaagagcaatgaggtgtcggtaccttgcatctgctcgctggctcacggaaaagcactggtatagggtgatcacgcgccgcggtggaatgagcggggggatcgcggcgccagaggcggccgccgctgctgcagccgccgcggcgcggacactgtgccggaacttcctggcattttcgtagtattccagccgagctggggcgtcagcagtctcgagtttgagcacgaagtagcgcctgtgcccatgcttctgtttccgcaggtagccgcgtttgcagacttcctccccgacgggcaggtcctcctcttcggactcggagtctgaccgggagccagtggccgtggagagccacatggctcccggacaagacgacccggtcccaatgagtgcggtcggggttcccgaggaaagaagcggggtggtcaccactgctgctagagctgccgctgccgccgctgctgcacctcttagtcttcttgtcgcttggtcgcgagtgaaggagcaactcgccatggtgatgcacgatggttttaaggtgagcgaggaggagggggaattcaggaaagggagggttgggggaagaggctgtctaccctcgtctgcccgccccagccccctcctgccttggcccgcgcccccgcccactccactctgagcgcacgacagcgggcaaaacaacacgtgaccacagcctcacgcggcggccgctgcggatcctgctaccggcgcaatggaggggcgcgagcggccaccagtagaggtgagcaagggaggagacggcgggctcgggaggcggagccacctccggctgtgccaaatcctcccggtcaatctccaggcctgtgggccaagggaggaccgagaggaggaggcgggctctctggccaagctgattctaacagggagtccaggaaggcatgagggggcgggagaaggcctggaggggcggaggagaaagcggccggctatc

SEQ ID NO: 5976 - DNA, 1772 bp, artificial
  synthetic oligonucleotide
gcgtcgcggggagcctctggaaacagagcagtgtagggaataacgaagatgagcacagaaagtggacgagaaatgggtggaaggatctagggagcacaagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtccctattcgtcttccttcagctttgattaatatgcatgtctatgctccgtagtgcgggccaccgcctcccgttcgacccctggcactgggagactgagctgtagcgaccaaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactggg

SEQ ID NO: 5977 - DNA, 2433 bp, artificial
  synthetic oligonucleotide
gacggcccccagagcgggaacgccaggctgcgagctgctggcacctgtctgcctgccagacagaccctgggctccggcctcgtgccggcacgcgcacgcgcacgcgcctcgcgcgcctgccgtcggccctgggggcgggaccgcgcggcagcgagcgggcggggggctcgtggcgcgcgcgccccgcacccgagggctgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccg

SEQ ID NO: 5978 - DNA, 1304 bp, artificial
  synthetic oligonucleotide
tcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacct

SEQ ID NO: 5979 - DNA, 1416 bp, artificial
  synthetic oligonucleotide
tctggggggaaattttaaaggattgtggagaagaggccttgagacttcaagaggaagaagaaaaaggggcccaatgaagcctgagcctcccaggaggtagaactgagttaatgaacagggctgattatccaaggtaattatgtaaaagagaaggctaggaggagttctagatggctgcaacttggagtttactctgcctaaggtgagtgtttatgtttctgtgtttttgcttctccggcaaggttttgttttgttttgtttttttcttccctgttcccttcacccaaggctcagtgtgcaaaagcagctcgctctgcgtggcagaccccattctaatccttctctttccttagattctgagcccggttagaattagcctccgcatcacgggctcctgggaccctccgctctatgctcctcgaggagggagcagctgtgttcatccccctacccgcaaatgcctccggttcttatttggcagacactcccgcggtgctgctgtccaaagacacaccttcccagccagcccagtggtcacgtctcgccccagcgattcgggagaagcagtgggaactctgagctccccgaatcgagcccgctgcgcctggcatctcccttcccttccccttgacaaacgacccaacctcaatcatccctgctccttccgaacgctagttttgtttacggagcaaaccgaggctttgagcaacctgcggttgcacggctctccttcggcttggggagggaggggtagcgttcacagttctccagtgtgccatagactgttagaccagatccttcagatctagaggcacacgcagtgggtgacaggagagtgccccctccccccgggcgggtgggggtggggagaggagcagggactcggcttggagaaggaggcagggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgt

SEQ ID NO: 5980 - DNA, 2288 bp, artificial
  synthetic oligonucleotide
gccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaagggtcgcgccagctccactcacgtttctggaaaggaagggaagtgtcagattgcaccccacccactggtgtcagatgggcagccggggacgattgctctgaagttggagttaaatctcctgccttttctccccgcgcccccccaccccgccctgtcccggctgtttttgtttttaaaaaggaaggatagataggaaactgtctaaaagcagtggctgccgatgaatgagctggagatggagacctactaagaaagtggagggggaggagcctttgccgtggaaggggtcctgagcacgtgcggaaacgtgctctaggaggaggggtgagtgaggccgggtagggggcaggcgccgggcgcagcttcagcccagaggctgcagagattggcgctcacaaagcgatctgtctccgcgtcccgctctgggacgcctcgggtctcagcgcggtggccacagtcctgggaagctggagaacgctggggaaatcaatcttcccggcaaggagatgagtctgaaagcagcttctcccgctgtcggacccctggaatctataaagcgcaaagcctcgccctcttggagggctttttgatgtaacagttaagctttgcaatgcaacttacaaccatctcagcagggagcagac

SEQ ID NO: 5981 - DNA, 985 bp, artificial
  synthetic oligonucleotide
gaaaaagtgaagagcttttccggttgcgatacagatgctaactttcccatccagatttattcagagctggtaaaagcaatagcattcctcttgaaatccctgcccttccaagcctattggcatgtttttccagccttgttttctccttatatgagtattgttcttgatatttaaatattgacataaaattcttccataactttgattgagttgtaaatcacaccctctccttggcttcctacatccactttttctttccttttcttgcttaacagcaaagctataaacctcttcctggactgataaggaattttatcatcatgccccagagccacagaagaagctgttggtttagaattcttttcaaagactcatttaagtaatcccccagccctttctccgctcactactttcagggctgccttctcacgtccagaagcaatacagtttccaaactgctagaacagaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcc

SEQ ID NO: 5982 - DNA, 1746 bp, artificial
  synthetic oligonucleotide
accggtattgttcgtgtgttgtgttattcgtttgtgtgtgtgtgtgtgtgtgtgtgaatgcgcgcgcgtgtgtatgtcttcctgcaggggaagctaaattgaggtgtgtgtgtgcattatcctggttttcagttttgtggaacgaagtttagggtaaaggaagagtagggagagtgcagagaaagcaggaaagacaggcatactcccgcttaagagcagacggggtttcagggtccaaggtaaacacgaaaacctttttcctccctactccccttgggcgagtgccagaagattctccactcatcttttcccggctaagtgtaacgatttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggt

SEQ ID NO: 5983 - DNA, 4603 bp, artificial
  synthetic oligonucleotide
tgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattctttcattcaagaaattcagggggagcccactgtgtgctaggctccgctttatatataagggaggtagaggcaaacaagacacttaaaaatccttgcccttatagatatggcatcaggctagatagtgataaaggctacgtgttaaaggcaggtgaaggaatagggtgacaggtccaggaaagccttcttgagagtaggtgacatctggacaaaaacctgaagatatccagaggcagagggactagccagtgcaaagaccatggccacaaatcagctgccaccacagcaaccctcagtatatccagggcctggagcaagagtacaggtaggcctctacactacataactaaatatgtaaacgttcagacattacgaatcaagctttacaaagtaaatgaaatacaccctatcctactttggcaaatacactttattagtgacctggatacccaggctccaatttctcagccttctcagagttccctgccagaatgtgcctgtctgccaaagagtgtgcctgtactggggcctcccgaccctcagtgccctctccctttctctccgctctctccttttctcttccccacatcaggaggtgttcatgtgtgcctgcgacatcccagccagcacctcaagctctactcacgtgccccacaaagccaccccttggccctcaggaggatggtcccttggaagatgatggtgcaggccctgaaagtggcctcaaagcctgggatccccatacccaagtgaggcctaaaagggggacacaagatccgcgattgtccatgtggatgtcttcccctccacccctaggagagacatagactgagcaggtgattgctctaaagtgcaggacccagggtagagtctcctctctcctggtctaagggcaaccaccaccgcggggaaccaccagcccctagaaactgccactcacacagacaagcacagagctgcttcagatcatgtttattgtggggccagggggtagggatcctcgggtgagagggctggctggccggggtaagttgctctggacgtgctggcggggagcagtcctggtggcgggatggcgggggcacttctgggtcccagggtgcacgggatccgggcagtgctcagggtggcaagaggcggcgtgcaggcacctggggcgccggggtctctaggcgtttcacacgcagcagcgcccccagcacgccctcagggggcagctcagagcccacatcgtggtcggcggcacggcggaggcggcgcggggctgccaccccctcggagtccgcgcttcccgcaagaatccgtcccagcaagtacctgcagggccgagcgcaaagcagtgaggcggtgtccgcggtggggcgttcccccgccccacgctcggggcccagaacgcaggatccacaaccacatactgcctggggacacggttccctccccaagaaggcgtcctcagcccactgctttcagtagacagccgtcatcgcctttcatcccagaaaactgtggcttccccgcctccctctccccttcccaggacctggggtccacttcccccactgagtcagccaggcatccttgcctggactccctggatccaggacctcactccctcttaggccccaggacttaggggttcgcactccacggggtaagcaggcttcccagttcctcgccctcgtcctctccggacgcaggcgcccgacccctccccaccccctgccgggcacctcaacagctcggggtccacgtcgggtgtctcgtcgcctgcctcctcagcatccgggcccgcggggccgtcgtcgtagaccgggggccggggtcggagcgccgcggcggggacgggcgcggggacaagctgggctgcgagggcggcagggtcaaggcgggcgcggagcagagcgcgagcgagctgcgctgcaggcgcgtcggggtcgtcgtccaggcccagagccggatcagagttgcggggggcgccccagacgcgcagcagctgcgccaggacgcgcgcctgctgatcctcagcctcctgcgcctcggcccgcgcccgctcctgacgttcggcctccagcagatgcgccagcgcccgcgccagctcctgcaccgcccccgccgcctcacctcggggcactgaccgccggaagcggcgaggagcgccagtctcagccaagggcggagacgctgcgcttaggccgcggggctcctgcgggaaaatgaggtgggggaaaagagtttgtcagcgtccgtcgagacagggacccccagcccgggaagcttcgtaggcctcaaacatcccagatgccaccaaaagcaccgtgaccatccaaatatacccggacacccctaaggccactggaaaccaccaaatatctccagacgcacttaagaccaccaaagatccccagacaccccccacccccaccccacagcgcgccagtgatcccttggtgactctcataattcctccctccccacccccactcctggagaccgagtttcttcataagagtagtgatggtagatatgacagttatagatttttccatatttaatattgtggacaataggaactatatgaataaacttgttcatatatcatttggcatgtgtacaagttcatctgtagaataaattacccaatgacaaattttcagttcaagcagttttcaaacaatttccacaagtttaaagaaataaaagagggtaccaataatctgagcaaggaataaaagatcataaaaatgactgtgaaggtttggaaaagaaacatacaggccacatataaatatgtttaaaaggagtgatgcctgcaacacaaatagtcaatgaaagagtagtacacagaagatacagagaattcctaaaaagtagtaagagaaaaacaaactcatacagaaatagaaaaaatacatgatcgcctatttcacaaaaatgattactaaacatatgaaaaattgggccaggtgtagtggttcatgcctgtaatcccagcactttgggaggccaaggcaggaagatcgcttgaggccaggagtttgagaccagcctggtcaaaatggcgagaccctgtctctacaaaaaataaaaccaaaaaaaatgagcggggcacaagcccatagtcccagctacttgggaagatgaggtgggaggatcacctgagtccagaagctcaaggttgcagtgagcccagatcgcaccactgcactccagcgtgcatgacagaggaagaccctgtctctaacaaacataaaataaaattaaaaacctcattagtaatcaggggaaagcaaattaaaatgccagggagatactatgcataatataaccaaaagattgacccaaatcaaaaagtctgataatatgaagtgttgatatgaatgcagaaaaatgggaactctcatactatgctggtgagaattaaactggcaaagtaattttgcagagcggtttgacaatatctaaaaagatgcacatatcctatgacccactcctgggatgtcactccccagagcagctttggcacatacgctactggtcacaagttcgtgaaagatgacagcagcactgttcgtaatagcataaaagggcgggggagaaagaaaagcctggaaacagtccaatgtccactgacaaattgagaatacatatataaatcatgatgtcctcataggatgtaatattatgcagca

SEQ ID NO: 5984 - DNA, 1421 bp, artificial
  synthetic oligonucleotide
ttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctgggg

SEQ ID NO: 5985 - DNA, 1458 bp, artificial
  synthetic oligonucleotide
ggctccctcccttcctctcccctcccccgcccgcgcctttgtctggcccggcggcgcgctcggagccagcagggcgggtaattggcggccggaggaggcgaacggcccggcccggcctccgctaatgagcgggcggagccgcggggagggcgcggcagggctccggcgcggagccggggagggagcttccgtggccgcgcggaccccgggatggctctccgagtcccggccgccccctcccgggctgtggcggggaccggcgccctgaggggcatcccttcctcctcccctctccctcccctatcccgtccccggcgcgctccaattaccctgcggccgtgccaaggcctgcggctgcccccgggccgcccccgcgtccccggagaaatgccagggacagaacgcgcgggcaggagggcagaaggaggcggctccctgggggcttcgctgcgctgcaggggacccaggcgaccctggggcacggccaccgttgttgtggtgggggggcacccccggggtccgatgccagagagctctcttagggaagccctcaggcagctgcgaaacctgctccagcatagatggtgataaaacccaccctggtttctaaattaattatactcaatccgcctcgctctgccggccccgagctacacttgtgtatcgaagggcgcggtagcccctcggtgggggtggaggggatgctctgttgttggctccgagaaaccccctttccaggactgtgtgcgggaagtgacagaggccagcggagctttaaggaaaataggggcaggaataggggacagagggaagcctttctccagccagtacccccgtcgactccccctcctggaagcccgccctgctgccatcactggcccgaggaccccggctccaggagcgggtcccgcttcctgcggtgcagtactcaattgtcaggatttctacaacaaactggcccttgtgcctccatgctcaactttcgcttatctccattgagcccggctccgtctccattcccgccggtgctttgttccctagctgcgttctgggttcttgaagtcactaatgcttagcattaacaggatccttcgtggccgccctttcaatcgtggcttctcagacttgggagctgaggttctgcctgtggaaggaagggcccacacctcagggacttgggggtccatgggggagccccacactggccccagcacagccttagggtatcacaagcagcctaggacagccccagagagggagtgtcccagtggcttccagggtcacttgacttaatagggactaccacatcttaagggaaaaaaggtcatttttctttcaaagagtccccagctagaacctttccctttcctgcccagctcccaccacagtggccacctgggagcagcccacccacagagagcttttccccctttttatttacttttttattgaggtata

SEQ ID NO: 5986 - DNA, 1751 bp, artificial
  synthetic oligonucleotide
gtctcctgaggaccagacgggcttcagcaggaagaccttgctgcccatctctcccacccagccttggtgattctcaaaaccgaggggcaatattccagatcaaccccacttggtcctgaggaagagagaaatggtcaggggcggagggtgggggaggtctcaggacaaataatataatcccagtgactcccccgacacttcccctgcactatcacctcacaaatacgtgcattcacacgtgcacacacgcacaaccacacagccatctttggcatcattaataatttatctttgaagaagcctgtacagtttacaaatattaaagcattatctcactattttaatcacaacgactgctttggggtattctcgttctttctgataatgaagctaggctccgagatcaaacttcaacaaggtcaaagggatggcaggtggttcttaacctttgggactgtctcagatccctttaagaactctcccctcggaaaaatgcatctacccagaattttgcccactctttcaggggtttgcagtccctacttcaagcccttgcagggctccgcctccccaccccagtcccggtgcggctgagttggacccggcggccgcaggataaaatccagagaggagtccgtgtgacggcgcagcaggattaagaaatctcccagaccaggatgggcacagaaatggttaagggggtggagggttttgtttttcacctctgaggactctgttatgggtcattaagaacacaagaccgaacgagcattccatttgctgggcctgcctctagcgcacagctctgcttcccgacaagataagttctgtgcaggaaggaaatcctgggcccagggaggcagatgggaaatcaccccagataaggcggctgctccgagtgctggagtcacacagggcctttctgctgcaagaatggcactgccgagagtctgcgtttcttgccagctgaggaggaggaggctcttcggaggcgtctcctaacacattgctgttctaggcagctctgcaaggggaaccccccaacgggggtgcagcaccgtgcctccaagtgaaggagaggccctcgggttcccggagtctggagaggtggcctccagcggtgccccggccgcctccggctaggcccgcacacagtttacccccacccaggcctcctggcacccccgccccgcatccaccacccaggtggtacctgtgcccgcgcaggtgaggaaaaaggcctgtggaaaacatcattactgataaataacagttcctttcaggtttaatgacacgttgcatccatcctaaatctctcaaaaaaaaaaaaaaagaagaagaaaagaaaaaaaagaaagaaaaagaaaaaagccctctcgagggactgcgcctcgcgcctgtaaataggaacgacaggccggggcgcgcgccgaggcgggcgcacggcttggagcgggcgtataaattaaccgggggccgcagagtgaatacattgcacgcggtatttattatgcggccggacctccgaggggttctccggctcccggacgtggcaaatcttgtccggagcgccgctggccgcgctgccaagggctaggacgagaggacccgtggcggggggcggggggcttctcctccagtcctcgggagccccggggcagcccgcttacagcggcggcagcggggagggtttaggcgaggagagacgcggccccgggcgccgctcgggctaggggccgggcggggagggc

SEQ ID NO: 5987 - DNA, 8159 bp, artificial
  synthetic oligonucleotide
ttgtactcttctggaaggtgtctttggcgctgtgaatgcaaactcaggctttggattaagggcttcattttcaactaactgtgtgatttgaggccagtttcttaacctcagtttctttatctacaaaatgggagggatattcgtataagtgtggctacgaggtttaaagaagatatagttatatgtcaaatgcttagcacaaagtcctggtggttagcattattattaccatatggccagaactgtgaggacattaaaagtgaagtaggctttttcccaccaggggtaagcctcgcggagtcctaggacacatcccacaaaccgaggtgaacctaagccaccggctacgtctgaagggaggacagacgagacgaggggcagccaactgagcgaatcactctgccttccgcctttgcaaatgaatagggctctgtctacagcttccgccattcctacgccagatctgcaacgcctaaggcttaaacttggcgcggcggtaaatttagcccgaaggcagcggctcctaaggggcggggatgtctccttggaagaaggaaagggaacagggtaagaaaatggagttgcctctaggaagaagaatcaggcagaggaaacattcagggccgctggcggaccactgacaaaaagaaatcggacgcaaaagaaacctccccagaagaaactgggccaccgtgggagccgtgcgagacagacttcccatctgggaagggctgcctacgggtaattgggtttgctcgagttgcctctataattaataagtgatttgacttggagattggaaatagtcatgaaaggaagccgcgggcgtaggggtgtgaggcccaggagcctccatccgaaatccaaagaccgcggaggaggacggtttaaggaacaggacgaatgtgataatattggcatctaaccttctagtgtttgagtaattcgttgcttagctactttggataggccattattttgcaaactggaaacatttgcaagtggtgatattttgctcttgcctgacgcaggggctgcaaacctacgccggctctgctgaactcttcgaaatatatatgcataaattgttcctaatgagaccatctgttttttatggcccctctggaagcaggaggaacccgaagcctgctccgtcttgcagaaatctgtggccaggcaggcctgggaaataaataggggagattagaacggtgtgcgtgatttaacaatacgcagaacggcaagttcggtggtcgagatgtgtgcctcgattcccaggggtgcgggtcatttagggtgactccagacatgggggttcctcctaggaggcccagggactttgcggagttccacggcacacacgaacctcgtttttccatatctggaacatcgccagagccacaacgcgaaaccacgagcctgtagctgctctggggacccaaaacaagcacccaggttgtaggtggtccccgacgtcgcccactatctagggcctccttctacggtggtgaagggagctgaacctgggccacagaggcagagaacgagcatcactccaccccatacccgggtcagagcacagagctcattccgggcctatcccaaagactgagctgctccgcgagcgtctggcaggcccagcgccccggcctgagaccgcactgagggtggcagggcaaacacttttcacattaccgcgtggctgttaattggggcagtgcaaaagacgccgcgactacccctttgcggcggcgggggaggggggagcgggtcaggagtgggcagtgggggctgcttataatagaaggactgccctggggagcctcagatatcggtaacccccatgattaattcataactctccactgcgcctggcaccgtctcgggtctttaatcggttctgaatgtcagcgaggcttccccgacagcctgagcactgctttttcaatgtgttgaaagtcgctgcgcgcacaccaggagacaaagttgccatctgctccggggaccaaggcaactgggcgctgggaggggccttcctcccgcggctcccgctgccccgggcggcctcctcttcccggcctgccccaaagccaacactgtcacccggaacgtccccgccccccgccccgggtgcatgcatggtggaaactccggcttgcagcgaaacagagcgctgcgcgcgggcgcgcagggagcctcgcggtcacccagaccgagacctatgctaatgagattataggcccgggttgtttgtgtgcgcggacgtcaaagggggggcgcagataaagtgtggaaaccgggatgacttggaggggggaggggcaggaagccccaggagaacaaagctcctggccgtcggcctccaaagagtcgcagaagtgaccgccactggctcgtgcacaggcggaagcgggggagggcgggggacgccaggcctaaagcgcctcgtgggtttagagaactcagagagggcaccgggtgggggtgggaagaagactcaacccgtagctaaatgtttggcctttggctattttttaaggaaacgaatctcagggaggtcggggcgcgggggatgggggcatcatcgcgcctcggagatgggaagcgagttcccctccgctttctgggaaaagccttgtctcccttctttcccctccccccatcctgctgagggtttgcgttgacccatctctccgctcgggaccggcaggaggacggagccgcaggggctgaccgcggcccagaggctgcccaggggtcgcgctgctgccggcctgcgcttccgcactcccgggttcggtgcgtcgcctctcgcggcagcgcctcgcttcttccagactgtaattccacactcccgcaagcgctggggctgcggaatcgtttgagggagttggaactgcatcagatgagcacgccgggaggtgagatcgggtaggaaatagccgaaactttgagttgtgcgccaccccaccgcccccaacacacacacacaggcacacacacacacacacacacacacacacacacatttaccctcccccttcccagccgcaacctccgccaccctctcgattcttcaaggtttgcagcccagtcctgtcatatggttttgtttctgtgctgctgttttttttcagacacgaaaattggacacgtggagaattagccctgctggagaagcgctgggtgcagactcaaacaatggtttccagcgccgaagctgaggcatcaccttccccacctccaccctcaaatggcagctgcctctatatacagcgggcacaccccttcactacccaccccctcccccaaagcctggttagggacctatgtgggctgcacgctctggagccccttgcccggacacaaaccctaggtgggcctgggctgcccgctgagtagctcattgcgcctgggatcccctgggatttagaagtatagggctctctatttttccctaggaaggtcctgtctcaaagatgccacccccaaaaattaatgtgtaaaaacccaaccaagctccagtctctgtgtcctttggcaaatctatctttcctagggcatactttcctaagctgctgggaccttgccccccatctgatgagccatacgcaggtggtctggcctcttcagagcagcttcctttagttattgtcttctccagaggccccatcctccacggcagccctaatcttagccccccagcctctctgagcccccatcccacccccacactgcgctgagctggcagcagccacagctcccccaggcagttcctctctcactgcgcggcctgtgcatctcgctggggcacacactccgcacagaagctccctcgcctcctggagctggtttcctcttacaggctccccttagagctgctggtgctgtgacaacgcctgcatctctgtgtctccctgcagcgctgcgagctgtgaatctgccttctcttcccttcctgcaaaggtcaagctgcctccttctctcgcagggccgcagttcagttctggcctgcagagcttctacactgcaacttgaatatgggaatggggtgggcatcgtgcaagggagcagtcacactcaagccaggaggcagggacaaaagggtgtgcgattcagggagggaaacactgaggacaaccctcagaaagcagtgcaggatttgcagctaaagactcaaaagagggagagaaaacgaggaaaaggctgttactaggtcgtgagtcctgaagtgtaggcctttctcctcccaccccgtgggttgccctaggggaaggccagaagaggcctcaggtgtctgcactgtgtcctgtgcagttcctagggccatgcacttccggtgaggctgcactttactccaagcaggagtcagaagcatggaattcagtggccgcaggagctcaagtcggctgcagccctttcaaagagggaccccgaagaggcctttctgccaccccagccccagagaggctatgaggctctacaagcagcagagagaatgatacggagaaaaatgagaggaaacgctattaaacttgcttcctctaaagagcgctacccaccgttttctctgaactgtacctaaaaagtcaggagagaactcgttaacttttgtttggtttaacattgccagcttcaagtcaaccgtaggccccccgaaggttttgtaaaatatttaatctagctcagacaatttcctgcagtccctaaccagaccaccccacttactgagccgctgccaaaaaggatgcttgactgcagactggcaaccagaggccttccagtcgcctggctggccttgacctccactcgaggcgccaggaaagacccttcccggaatcccgagagaccaagacctgggtaatcctggaggtctaaacccgtgaggaagcccaagaaatggagttaaagacccttttcgcacaaccgattgttgtctgtgtgaccttctgcggcccttgccctctctgaaccctctaaaatgggcatgaggatgtctcaccttcctctgggtgttatgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggctaccgagaaaacactccgcatcgctctgtgctcagagcgtgagtcagcttcccagccccgggggaacaatggggaccttgccaagggtccccttctgtcgacccctgacggcccccaggcccgtttgggtggcgggagtgccggcaccctgggaccttcgggcccgaggttcgggagggctaagggcgctccaggcgaccagggttggggtccagccccaggattagcgcggccaggaatccctctgcccgcagctgccgcggaggggttgagggttaaacagacaccgggcagaggagcgagcctgccggctgcggccggcgcggcgcggcgcggggagaggacgggagggaagagggcgcacgctacctagcctcccgacgagaagacgtctcctccccacgtcaggccgggctctcgcccactcggctggccgcctctgctccctggcctctcaagtctcagcggaaagaaacgtagcggctgccaaaagcaccccactccttttattgtccccataagcctatacacgtacactagccacccccccaacacacacacacaacacgcacacgtgtgcgggagactcgaggatgccctgcctccatcgctcacagagtgagtaccaaggccgagcgaaacggcacccctttggtggaagacacagtgttgggaccagtggtggcctccgcgctacgtcttctatcgcaacctctgggtttcctttgcagaactgcataccccagagcagaggccatgtggagacctgcggcttggtcccgactggtgcagtggcctctgctctggtgtgggctggcggtttccccgcgcccggtgaccttaagggggtttccggagtcgcgcagccagcccttcctcccagcttctccggccaaggccgctctcggccgcccagcctggtcgggctcggctagtcggctcctcgccccgggcaggagtgcggttggtgaaagcactcggggcctcacccacgctctgtgcacacgcgccccgccggggcgggagccggagccgcgctccaacagcccgaaattgccaaatggtcgctgggcagggttggggatagactttgggaaccgggtttgagctggagaagacgaggaaaacgagtgaaacgggagaggcggggtggggtgacggctcataaatcatccagccccaccctcgggcctcagtgcagaggcgccctagccccacgaggaagaggaggttcacccagccactcctggccgacctctgagctctccgggagccagcgccccaccctaggctcaggccgcgctaggaccagctcccggcccagatcgtaaaccacccgccggaatcggcggaaagccgcccttggacacagcgcgcatccgcccaaggggaagtttatttatagcttgtaaacgtaaaggaaaccagaccgcgctacctcgccgcgctccggctgcttcgctccccacctgcccaccaggagggcgcgacgggtggagggaggtggggtttggttctgtgccccccctcccccgctcccgctccgctgccaggggagaacagggtcctaagaggctggcaagccttacattcctctcgggacgcctatccagtgccatgaaagccggagggggcggaggacagggcccgggcaccggagtggttagggtgggggtggccgagctggcccacttggcacggaagggcaggcaggccaggcgacgcggcgcgagattccacagctcccgctccggaccgggggaaatcctggagtgccagagagcccggggagggggcgctccgggagcctctccttgaaaggcgggatgctttccccgttcctcccgcgcacgtgtcctcagcagagcaggcaagcgctgcgcgcctggggctgcgatcctcgggtgacagcgactgagagcgcgccctctccacccccacccccgccgtcgccgcctctcctggggagctccagtctccagggtgcgctcggggcaggccccaagagccagagaaacggaaaagtgccggggaggcgattaggaagagaagacattaaaaagcccagccctgaaagacaggcagccgagctgaaaaagacgcctgcgaacccccaccccgccgcccctcgcctactgcgcccagacggcccctccttgtcccggctgagcgcacccacccccggcctcggccggggcgaattcgtgtgtgtgtgtgtgtgtgtgtgtgtgtgtgtgtgtgtgtgcgcgcgcgcgcgcgcgctcgagtgccgggagggcagttgcgaaacgggctcttggctgcagcgcggcataatggaggtggctggaacaatgcgcgctttgtgcgcgcggggagttgttttccacccgcctcgccccccttgctcgggccgtatggcactttaatctccgccacgactcggcacaaatgcacttgtgtcctgcgggtcactgggggccgtgcggctggagccgcccccaccccgacccccgcggaacccaccgccggctgccccatcttccttcctgagcaccccccaccaccacctcaattcccggcgtgggccggtgagctggcgtggaagcttccgggcccgccggccacttttattttccgtgaagacggcccctcccccgctccacgagcgcgcgcgcgcacacacacacacacacacacacacacgccgcccgcaggccccacactcaccgccctctctcgcctagcctctcctcggcccgcctccgcccccgcccccgcccccgccccgcgctccggactcctgcgaacaatagtaaatgtcaacagattccgcgcggcgagtgtctgactcggccgagataagggtgcgcggttgg

SEQ ID NO: 5988 - DNA, 806 bp, artificial
  synthetic oligonucleotide
tgcaggcctcaacattttcagaagctttggttcacaggaacattataggactgatcaaaattgggagctttacatctacatttgccagaaaggtctgctggattcaattccagagaacccagtggtcagtgtgcttacagtcaccctctgtctttcctcctggaatttcccgtatacactgagaaccaccaccgcacagatagggaagcttggtctcagcagagccaggctgagaacaagacacatcactgacctggttccatcctgggcactacagttgacatcagcgccatattcaaggaggtgtcgcacaatgttgagccagcccctagcacaagcttcatgcagggcgcagtaacctgcgttgtcccgatgatttacatcacaaatcttgttctctaagcagtacaggaccacttcctgtggggaggggagggaagaatgccatcagatcactgcacaatgaccttgtaaggtggacctctctgtagctttcaaagacatacaccctcaggcctgagaacctgagaacctctcgggcgggctgtggatgtcttggtgagggggaaacacatgtgcgaagcgcctgatgacagggacagcatcatttaggggtctgctgcccagctgcctggccctgggcgagttatgctcctaattctccaaagcttcctttcctacctctggaggagagtaacagcgcctaccagaggctgctaagaaactgtaattagagacccacacaagcccttagctcagtgcctggcacagtgagtacagagggatttggttgctaatgtttcaaa

SEQ ID NO: 5989 - DNA, 6747 bp, artificial
  synthetic oligonucleotide
acaatttggaaagcatggccaccaaactaactctgctcacgcctccctgctgtccacacaggcattgagggtggcccatctcggggtcttttcttgggatctctctcactaggttccccttgcccccaccggcagctatccagcagttaacagccagaagaactggagaggttcgcaagggcttccagctcaggtggccaggcaggcattcccagccagtgtgctggggtcctctggcagaggactcttcaggggaggggtctcgctactgcatggctggttctctgtggagaacatggtcaccacagcctcccggctcccaccctcactcaccgcgtgtctctgggcaggtggctgaacctctccaaccttggtcccctctgtaaatatttggcactgtgttttccaaaggattaagctgcactatggacttgagttttgcctggcaatagctggcgctggccacgtttaaccccgctaaatagtacccgactccaataaacacactgtgtaataagccccagaatcacaacacagtttctttggggcactaccacctcatcctgcgggggaggctgaggcagcaacagagaggggatcagagcagggagggaacttcagcagaactgtgtagattttacagaagcccaaagctcaccacccgccagcccttcctggggttgctccaaacagagactgcgtcacagcagcagcgctgtgctccgggtgtcaaggaagggaggggtgaagaagttcctattttaggatgtgaggggtgggggtggggtgtgtgggagtgggagatgagaagaaaaagctcttccggatgtgcagtgtgggatgggtcctccgggtctgctggagagtaagataccccaaggctgccccccaggtccctgggaggcaaaaccgcaggcttccaggggtgtggtcgagggaggtggctggcccggtcccacccctcccgaccccctcccccgagagagttgggggtgagggaagtgatccagccggcccaggtgctgcctcttggcacactccaagccacagccttagccgtagccagcacgggcgtccccgcccacacctccaagttttgcattagtaagggggagggggaaggggaaactcgccggcccagaccattccagcacccagaaccttcccggcctcctcccggggcgtcggggtctgagcggagagccacctgggctgggagtgaacttggccccggcgaagaagaaagggggaggggcgccccctccccgggctgaggcgcttcagcccggagcgcgatcggtcggcaacaaagggattttctctcccaccacacacacccgtgctgctcggggctcgcccgctcctcctccccgctcctcggcggaggtcccagcgcgcggggccgcaccacggcacacactcacgccctcgcggcgcgcccccgccaggccttccaggaactccagcagcctccccggaggcggcccgaccttcccagttcccgaccctaggtaacccctcggaccctgcggcctggcacgctctccatggtgccccttcccgaggccccgccgcaccttctctccccatcaacgaatctgacgaaaagaaactttgggtgggcgcagggagaatccgagacctcccgggaaacgccgccgagcccacccggggaatgggcacggcagacccctcctcgccatcgttctgggttcccttccgatcatactagagcgctgctcctctggacgcttccccttacaaagatgtgagccaagcgtcgcctactgtaacgtgggaggggtgcgaatctcgggcgttggggtccggggtggaatctgcaggggttgaccctgagggtcgctgccgaacctggattgtccgctacactcccctcctccaggcagagcccatggcccggggtcaggtgcccccaacctctctctcacaggccaacgggggacacttgcccgtctccccggataatctgtccaggccaccccaccggctttttgttcttttcactttccttcatggttttgccacacggggagtcaggaaaccacgtgtgtattcaagagagggcaaatttagaaacaggtgtcccttcacaggaggccacccggcaacagaaacccaagtcaaaagccaggaatccctccttactatcttccctccacgcaaaaagaaaccacttgccccctttgatctagtccctgcagaactgggtccccacttgggaatctacacaacctgggggcaaatccagaataaatgttccacaccatgcctccaaaggctgtgtcaatgcacttttgtttccaccagggctttgtaggagtaaaacacaaacgccgtcgccgccacccccccccaccaccaccaccaccgaagggaacaagctataccgtaaggctaataacaacagctatcattagtatacacaggaagcacaaaggaacttttaatgcataaaagatgtgtaaaatgcaggggtcctgcaatctgcaagcgagtctctcactgattgtgcagagcctgggagtcccagaaaggctgggatgagggtcagagaaggagaggggcacccaccttctttacaaggaacaataggaatcccatgtctgctactcagtcatggaactcagagcacccaaaacaaagccatggaacaactatggtatagatgggggcccacgaatttttgtagctgttcagggcttaattactcctccttgatccatgggactagacacgacaccgccaaggttaaaatgccccgaacagcgctgagcagatgtgagcgagctggcagacgcgcaaatgaggcctgcctcggagcacgataacaagtgactaatacattgcatatcgttgaaagaaaattatttttctctaatttgcatttgcttgggggaaaaaaagccaacgcgagtccctcctcacatgcacaagtctaatcctggaaatacagcccggctgctttaagagagctggaaggagggaaagactgccagtgttttggcgttgcaggcttgtttatctttccgcctttcctccaaggcgaaactcgttttgcaagcaacattcctacagaaaatggcacacgtcataaaaagagaccaatttatagaactggcaccgaagttcatgtctcactccagaagcatctcccagctccccatcggaaacccaactagatgtagaagtccatgttaaaacttagagagtagacttagggaggggaggtgctgagggtgggggggacaggagagaatgaagtagatttgcagatatcctgtaggctgtacacccagagaccaaagtcagccctaaatgatcttccaaaacccaaggaggaccaggcaggtgccagggcttggaaggcttcaaccttgggactcatgggggagaggagtgaatttttacacccagcttgccccaggacggtccagaggcaggtccacattcttggccatcctaagtccacctgcttgggccagccatgaacctccaggactggcctagtgggtaactgccaccaccaactgctctccctcccaccctggcgcctctctgcagggcctggcggggtaccaggaactcaaagaaagcctgttgctgtgggcatctagttgatgaagtcagagtaggtggtgctgtgggcaggcttcaggacggcacctttgcgtgctgcagttgaaggcaaatgtgctcttgaaaacgggaaggcttggaagaaaaggttaagggatgtgggtaatcaaaagccaatctgtcctcccttccccccaaaatacaccccccttagggtactgaacctgcacacttgcatttccaagctggaaacagtgtcgagtgcacagaacacagcacccgcctgtctctaacttgtctgaataacagggccatttcagaggggaacaacggccttcagagcctctgcaatttccagaaagctttcagttaataacacattctttccaacaagcttacttagggctgaaagttattttcacaaatcttaaaaactcagccataaacagctgaggacccagttcaacggatcctggccaaaccccaccaacacggtgacactcacggccccgtgggccttctcccgccacctctgcctcaccacaagttccctaaaccacaacatacaaaccatcctgcaccccaccccaatcctgggaagtcataaagatgtgtgttggggatggagggcgggtgtgccgtggagctttctctcatctggggatgcgctggccagaaactggccgccacctctgcagctcgtccatgggcctgcatagtgcgcgctttgtgtaagtgctgaggaggcgcagcgctgctcgcgcgccaacagctgtcacattatttgcactcgctgtaaacagccttcacattccccccttaccacatagttaaagccagactaacaatccacagttagagatcaaaccaacaacagcagcattgtgtctgcctttgctgccttcacaccaagcccagcagctggcaggtttctccggaacaagggaccccttctccccctacccctccgggatccagccaaggctagccaaggaagcatgcgtttgtcagcgctgtttgttaaagcaaaagagcaccgccatttcgcagagatttccgtgtggctcatcagccctctccgagagtttactccttctggaagctcgaggaagcatcacgagaataaaggttgtggagactcgcagggttggtttccatgctcagcaaagtggggtctggccgggctggggccggggccgggacagggaggtctgcccctctccatgccatgtcacagaggccagacaggtctgtgctttctgcagccctcagcggaatgcctcctgtctttcggaaattgcccaactcactaaatacttactggccgccccactgatcaaaatgtctcctttatgatttttggttaagttgaacatttccataatcgtcattattagtgcaaattacacgcctaatcggtccttaaatagattttaattaaataagcatacaaggctcattttatgacttaagaaaggcattacttttcgttataaactttccaccaggatatagaataacgatagcagacaaatacttattctttgaaaatcaccaataaccgatgggcagagtatcatgaaacataccctgttttaccctctggaatcaaagctgagaccagacatatcacagctgtacaactttcctcctgggatgggagagaggatttcttcctccaaagcactatgtctgtcttccttgtggccagtagaaataaacccccggtgctgctttccctacccatctgatgagatttctctagttgatgtcctctagcaaccactcctcccccacctccatccattttccaccctttcgcctgcttagagtcctggtgcaaagcaggcacgctgtgcttgttaaatgctgtgtaaaatgctgttaataaaataataaatacaaaggatggaggctgctgcttccatgggtgttttgactggaaatgccttggcacttgtcatgtgtttatgggagggcagacaacgctaggatttacatagtttggacatttctgtacttcatttattctttcctaaatgacgtaggcctcgagctatttcaagtttgcatttgtacagaactgttaaatgcctaggagtttctccaattaaaccaagtttaaaatcagacccaaagctggaacatacactcagacttgcccaactccaccttcagcctcggtggctggacaaaacaaacagatcctcgaaaacaatcagtcctcgagctccccaccttcaccccccactccaggagggcccctagggcaaaggttaaggcgtctctagattccaagccccagcccaggctacacactgaggcaatcactgcagtaaggcgcatcttgtccatacactacctttaaaatcgtgcgctaaaatcggggggaaactgctggcctggtaaaacccactgttcacaaaacaatgtcagcaaaggctgtaaggcattctttagagagggaccagggattcgtgcctactgaagctctttcagcacaaaggcttttaggggaagaagggaaaaagagggaggaggagggggagaggaggagagaaagggagggagggctcctgtttcagagcaggcatcccctgagagtcaagaaccaagtgtagcttcaatcaaacactgacttcccctctgggagtcgagtaggaaacctgatcacagtagcttactaccagcctggatccatacaggtctggttttcttctcatgctagtaatttttttaaatacatattgatataaaagaagcaatccctggcagactttattgaaaaccacattgagccctcataacatccggacttaatccctatcaaacaaaccacagcacctctggcctctgcaccaggccaccccctctcacctcttccaaccaggtcttgcccctctaggcaccgtggttcccccctgaaataatgccaggaagccttgccgaagggtacctagatgacggttctgaaatgagttcctaaccatataatgatcccacttgggggtggaggggagaagcaagtcttttcatatggaatcctttaaaaggcagaatgcaaactacggtaacaaagggaaaggggaacccaggaaggtggacctagaataccctcgtaggggagatttaatctgcatccttgggtcc

SEQ ID NO: 5990 - DNA, 22904 bp, artificial
  synthetic oligonucleotide
cgctcaccccgctagccagccgagcacgcccccgcaggccggccacccctggctgcaggccagccctctgcaagtggcgttctttctcttttttaaactttccggccttggcgaacgggcagggtttccagtcctccccggcccccacccagttcggggaggggcggggcggggcggggctggccctcctaacccctccggggaggcgattccccccaagtcccgggcaccgctagacggcggccagggcagacgccttgctccaccccaccccacccccgcctactgtggccacctggagagggcggcttcccgaagcgatcgccgtccagccaagcctgggaccgcagcgtccggggaggaactccctacagcgccaacggtcctggcctgcccgcggtgcgctctctccgaaaagtctaatgctccgggaagggggaggggagagagagcaaggcgggaagggggggacgggctgcttttatttattttttaactcttcaaatgcaagaggtttttggtgtccctagcacgactgcgagcgtctggccaggcagaacaatagaaatggaggggggacgccggaaatggtgctggaagacccctataaccctataaacctctcctctccctctaagttcctattagcattgaaagatcctagtgacttcaatgcaaaattgtctttttataacttttttccttaaacacattccccctccccacatgaaatcacaagggcaaagatcgcttcccaagttgtgaccttccgaagctccagggcttctcacctgctctgcccctggcaccctgacctgagtcaatcccatcccccaacagttcccctggtttgcacctagacaataaatttagtttaatttagcttccggtctttaattttagcaggtctcctttttgcatgcaaatcaatatggcaattaccatctaaaagctcgcccagccccgggtcaatgtaaattgatcattgtccgccttccacaaaataacatcgggagtctgtggtgcataatgagattatactggaaactgtcttttagatcacaaattattttttatgctgtcaggatcttctccgagtggacttccccgcttctctaatcatggagagccgagcccgtgggtgccggctgtgggagacacagctctaaaacaatgacggagtgaggacccccgtttctgagaccctcgattgtaaacacatggaggtgagcttgcgccccaaaagggagccttctacagaaatatcgcagaaaggcatcgttaatgaactccacccaacaaaaagtaagatatcccttcctgatgaacacgttgagggcaaccagagaaagccgtcgggcagggctggagaccagtggacgcccccggccaagtgcgcgcgacgaacgcggctcggctaccaccagggcggctggggggagaccatttactcccgccccggcggcttctcctggctctaccacctaggcctcagcagcgcgtccggttttgcaaacagacggaatcccgtcggccataaacactggcaaagaagccggggcgggtcagggccggcccaggcctccccacccagctttgggcgaggcccccaccgggcccgatccagaagatgggctggggcaccgaggcaataaggaggctcctcttgacccgcagcactgctttctcccacccatcggcggcccccggggcacgagtgtgacctcggggcctaacaaagggccttgtgagctcctttcggcctcgggccggagggagaagggtggggcggggcggccgagatggacccaggaagttccccgccccgccgcgcctctccgggtccgccgggcccggtgtcctcgaggaaaccaccggggtggcattgccagggctgcccgcagctccggggaacgtcctgcgggctccaagcctcccgcccagcgcgaccggaccctgccccactccgcccggcgcgggccccacccaagtgcggtcttcccaataaaagctggaattcccggctgggcttagacaaagagggaccgcagcaaatcgacgccgcgggcaagccataccctagccggagtttacgtgcgcgtctggggtcaccgaggcgcctgctaatccacccaacacaggctgtccccgccacggtctcctccagaggaaaaaaaaaaaagaaaagaaagaaagcatacctcccttttattcctcccagaggccgcacttcttcctgttctccttcccagcccactgaggccctgctccaccttagcaaattggaccccagcagtgcaacagccattcctactgaccacaaagtggaaagctacccctcttgtggctacacgatccagccactcaaggtcaggaactcaaaatctcttcagaaaggctcctacctgctcgtcaccaacccgctgcccactccacctcacccctagaagggaaagaaactataaccagagataatcctagttcactgcacaccatccatcctttaggctgctagcgtggccctcagtttccttcaagccaaagacacattatttccctgtgaataagtgtgtgaatgtggttgtgtggcccactcttctgtacccaagtcggtctcactcactcggcaggaaagtcttcgtcaggcattgaggagtgtttgtcattcagcctgtgtatctaagcatggatgtatgcatatgaatgctttttgtgtttccaagtgaccctcttcacacctttaaatgggctattgtctctggaacgcacttacagaaattctgccccagtttccagctcaacaaagtctgggatttttctctcagaatatcgctatacatctctgtatttgcatacccatgtttacattccccttggccagttctttatctcttatgtatctcttgttccatttgggcaacggagcccaagtgtcttgatttgtctcagcacatgtcattcaagcgcacatcttaatctgagcattcgtactacttccattctttttgctttgcctataatgtggctctttcccaggccagaccaatatgggtttgcagtttaaatgtaaacagaggatcccttaagatcacaaactcttaaagaaaggaagaggagggaggaggagactggaatgttagtaatgagttatttatgtatagggtaacccatccgcccatttcaagctgaagaaagaactagataaatgtctgcagaggtgtattaaaattttagaccaatttaatattagccatatatatacacacacaaacgatggatctcacaacacatcagtgtccagctcctctttggaggctgtctccttgcacatatctaactcctcacaagttcctggttaaaagtatgtctatttatatagagacaactcaaagaccgctttgctctcttcagtgcatacctgtacatgctggcggggcatttcaggctcaggtccttggtctgcagcagtcatagtcagaggccccacccgactacagctatgtgcagaccttcccgtccttgaacacccgcatgaattctctttgggaacattgagtctacgtctgtcttccaaactcagtttttaaagtgagggtgttcattgtgtgtgttcacagctccccgactgagaaatacctggtcaaactagatcatctagcagctgcgtttggtttgtggaagaatcgagcccgatgcaccaagatgtgaccgtgcacacataagagaaaggaaaaccctaggcccagactcacagctcctccccactgcgagctactctgcctccaggaatttccactaggctctttgcccccctttccctattacactaccccaccacggcctttaaagggttaagagaaacccccacggccttccctccacccagctcgctgggcccggaggctagctcgctcactcgcagctcacagagtctgctgccatctccgcgcctcccccccctccagtccttcagccgggagggagcctgcatgcctgtctagaccgatctatcaccggcacaccaacaacacccgcgagagcgcggagaccctgcccaggtcccccggcccgcacggttcacggcggacagaacccggggagcgtgacggtgcctgcggggtgggggtagggggcccacaggcactggccgctccgagcgcaccacgggtcctctccagctccggccccccgcgctcccaccagcccggctgccggggcacagtcacagctccgcgcgctgggcagtcctatttttatcttgtctaatcctaaactgggcggggagcacaggcgtcgtgcttagagaacaagagataggcgcgggaggcggggaggagcagccaggcagcgacgcgagcgggagcgagttaaagacacagtggaggcgaccgcgggcaggaagaaagagcgggctgcgcgggcctcgaggcgccgcacgcaacgcgccgccccgcgaagttacactcgcttccccgccgtccctcgctaccggcccctccccacttcccagcggcgctccccgcagcctggacagcgaggccccggcctgtgtgggaggcggaggccaggacggccctgcaaagggctggagagaatcgctaatgagctgtgcagcccattgatccggagaacacttcctaattaactctcagtcacctactggtgacagcgcctcaaaggacagcgctggggccagccgagccccagccgcgacttgccggccgggcgcctgctgcccaaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgagtcgaaaaagaaagcagacggcaacccgctgccctccccttcctgctcgcgagctaacgccgaacccagcttcccagcttccagcccacctcccccccctccgcccgactcgcggcgctcagcggcgaccgcgctcccgcgcacagacacacacaggctgcaaacttccactctgcgaactccctgctctcctcctggcccaccgggaggcgccaggcccccagccgcgccccctccctccctggtgcccacgcggggccgcttaggttggctgcattttaaataacatagctatgaaataaaaacgaaagcgagccaagcagccaaagggaagcgcgaggcaaaagcttcgcggggtacgctgcgggagggggccccgggagagggggccgactgcagccctcagcgcgcccgcccgcccacccgtccgcggtctcccgggggaaaggtgttccgggcactgacctgaaatccccggtgggggagtaggcagggagcctgcgatccggctctttgaagttttcccccaagcggactcgaggcggcgagaaggagcggggggcggttgggtgggtggagagagatatgaggggtggggggggttggcgacgttaacgagcggagaaggagccgggccggagaagcgcggcgagcagcaaagtttgcggtccccggctgcccgcagcccgctcgcggcgccgcgctcactcgactccctcgccgtctgctggcagccggctgccctcggggtcggccccgccgaggggtgggctctgggccgggtgggggcggggcggggcgggctcggggcctccgggcaggtggcgacagccccgtgcgatcctccgggctcccgcagctggactgggcttggccgagctcagcagctcccgcgctgccgccgccgcccgcgctcgggcaggagccccagcgccatgttgacggttcgccgcgagcgcccgctcgggctgggtgtgtgtgagtgtgtgtgagtgttggccaagtcgtccctgcgcggcgacagcgcggcttgggctctccgcccggcggctcgcgggctccccctccgccgccgccgcccgcctagctcccgctctcggtcgcggtctgggctcctgcgcgtctcccccgcagccgccgagctcggcccgcgttcagcgaggagcgcagctctgcctcaccttgccgctgggagcccaggctccgtctgccgccgcacgccgcgatcccaacgcgtcccccctccctggttccctcctcttcctcctccccctccctccgcccgtcctccctcccgcccgccctacctccctccctcccaacagccgcctcccctccccccgcaggcgcagcgctcgggcgacagccgcccgcccgccgccgcctccagctctcgcaagtttgagctccgccagtctccgctcaccctccgctgcggcgcctccgcggcggggtttcgggaggggtgattccccaggaaaggtttgcccgagtttccccggccgtcatcgatgcacggcccggcacgttttggcctctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacatagttataaaaacagcccttctcaaagcagaagtgaaacatctctaccgtttgaaacccgaaacttcggcagaattaaatcttcatgctccagagctgcttataacaactgatgcaaaagacaggcgagcaagtgcccccgcgagcagtgcccagccaggctgggccgcgaacgcttccaggaccagcgcctgcagaatggaatgcacgcttttttcttcctggtctttctgggggtggatatctctgcaagccaacccacacatttttttaatctccggtaacaagcagaaagacacctggactattatgctgtaaaactattttttataaagacattttaggaccagacattaaaagttattagattgaacgcatgcgagttacagacacagctggagaaaaggcctctggttgtgtgttgtggcaacatttctttttgaagcgactccttttattcaaaacaagtcaaaaataaccgggaaggctgaagctgggtatttgtggggaaactctgaacgtggttccaggcgaggaggccgctctgctgctgcaggctggacgggagaactggcctgggccagtgtggagccgtgccaggctcttccggctcggttaggccgaaccgcagaggccctggcccggcgcccagccaccttctatcccctcccctcgtctccccaactctgcccccaggcacaggcttttctcggagttcgaagtcgcatgtaaacgtccagaacttttagaaaatccaggaaccgagctcggggcctgcagcctctcagagtcttacggcctcccggggctgctgacaaagaggcctgtttgtctaactttaaaagtcctagaattcgggaggctgagccaggagaatcgcttgaacccgggaggcggaggttgcggtgagccgagatcgcgccgttgcactccagcctgggcaacaagagcgaaactccgtctcaaaaaaaaaaaaagaaaagaaaaagaaaaaaaaaagtcctagagttaaaatgaacaggggtggtgggggtgctgtaaatgcgaaggggccgaggggagggctgactgggggagaaatttgatgctggagacaaacaggccagtaaattcgcctttgacgtaatttgcaacatcctcccccaccttttctagggatcttgcctccacggtaggctggtaggattaaagggtttctcctccatctcctagggatacatttttcaactccgtgggatttcaaaaatatcttattaagggagtcctaagaggcatgagtggtgggggggattcgtgactcactgggaattaaaatgtgggattttcccgaggcgctataaggcagagggggggaggggagattacacctattggcccggttagttccaattgttctggggaaaacaagcagaaagctgtcgaagggcaatcccatcttgtgtcctcacttaagaaggggctcagggagctggggatgccgcggggcctgcaatgggtgccggcggtttggcccttctcctgccccctcctctcctgccctcccacaagcccttcgggagctgacccgggggtcaggctgctatacccagcactcagcaaggggaggatttcaatgaaaacagaggaggaggagagagtgagcaaaggagtgcatgggaggggaggccgtgcagcccacggagaaataaagaaataggtgccgaaatgagaggtgctgcggatggagcagcgggggctgcccctccgccaccaatctcccttcccatggaagtgtctcctgattataacaaaccactcgacctcaggctaaccaggccctgcaactgggcaatcgagctggcccttctaggagcaggccttgagcctggctgcccttctcaaggcaggttgactctgcaagacccgctagggcctctcccacacacctccagctccaccctggcctaggggaaaggccaggcatcctgtgtttggggggaccctggccttctaaccttgtgtgcaagatttatttataacgtatactaggatccacatcataaagcttataacgtatgtgtaggcttccgatggtcctcctcggaggctgttctcagggcgatgacacttggtactggaacaggtgggactcggatgagtacagataatgtatttttacataatgtgaggtagcctttctttaaaaacacacccacacttatagtcttctggtcactttgtacaagaactctgggcttatccaatggcactttaaaaaacatccgctgccccatcctccaagcacaaggcacagctggcttcccctctgaaactcaaacgaggtaacaaacaggaggcgcatcctcctcccaggatttcactcatctggaaacatctaaaggtagctgcctcccagggcagaagactgctggacttaagggtcgccaggctgaacatgactgttctttcttcttcctagcctttggagggttattgggtgtttggggaaggaaggccctaagggcagcctctccgtggttcctagcaaccatcttggaatttctggtctgggctcgatttgggtcaggccctgagctccccgaacacaggcacgtgtgggtgaactggcatctacactacgggggcccgcagggtggttgggtgtcgaccaaatgggcataatacaggaggcttctgggaggctggccgcctcttgcgctcggcaagggcttaagagccctcgacgccgccgcgctgggccgggtgctcctgcagataaacccggacgccacgtcccgcctcggctgcttatttagcaaggcgccttctgcgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgtacctctaagacaatcaaccattttcttttcttttcttttttttcttttttcctttttcttttttttttttttttttttttttttttttttttttttttttttttttttttttttttttgagacggagtctcactcttgtcgcccaggctggagtgcaatggcatgatcttggctcactgcaacctccgcctcccgggttcaagtgattctcctgcctcagcctcccaagtagctggaattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgcagcacccaacataggatctcacactgttttaagtcatcgtttcatacctgctaaaatatcaccttcttagaggcttttccttgctgcctccaccctcaccccccataccctttcttgaaaggccccttgttatacttctttgcttgaagcatcacccatctttataatgccccttcttaacctcgcatctcctttgctggttccctatttatctgtttccctgtacacctggacttcttgaaagaggtgtctccatccatgtggaatttctgcaggcttacctcatgttcactctaaaaatcagctagtcatgaagttattttaagacactggaataagtgcagctttgtttataacagcataggattataaacaacctaaagagtcagcagtgacattgatggcacatgcatacaatggaatattctgtagctgttaaaataataaagaagatctgctctgtgtattgatatggaaagacccccaaggtctacagttaaggaaaaaaaaataaggtacagagcagtgtgtaccatctgctacagtttgtgtaaaaacaaaataggggggaatatagacacatatttgtgtgtgcattaaagatttccaacactgcaggggagtgcccccttcccccccagtttctctgtagatatgcatgtcctctggtctactttcagaaatgggaacacactgcacaatctgttctgtacctcacctatgaaacttatcaatatatcttacttttctagcaacacatggagacaggccttgtcaatttccaggctggtggaatttcactgtatagacacatggtcatttatctcactcctcaacccctccatcctccctggccattctgcagaaagtgctcaagatcactggttacttccttgttgccaggagtgggggccggggtgggggggcggcgttgtttttcagtccttgccttccttggcctcccagaagcatttaccacaccatgaccactgctcccttgagctgcttgctcacagggttttcatcctagctgagaaccgctttcaatttctttgtgggcttttctatgctctaccagttgccttgggcctggatcctccccttcctccccaccagtctcatccaggtttatggctttaaataccacctacttattgatgacttacattttttttttctagttccaaatccccatatcaaacttcaaacttggtatctcaactttgcatctacgctcagcttaataacaatagcaagcatttacatcacgcctgttaggttgaagctctcttcaaagtgctttctataaattaactattaatccttacaactgccctataaggtaggcagagttattatgtacattttttccagatgaggaaactatcagagaagttactgaacattcctagaaaatggtggtgctaggattcaaatccaggcagtcctatcttcagagtccatggtcctaatcactttgccacactgcctcgttggcatgtgtctcgaactcctgacctcaagtaatccacccgcctctgcctcctaaagtgctgggattacaagtgtagcaccgcgcccagccacaactgaattctaaaaagaggaattaatttacaaatatttgggggcatttaataaatgccaggccttgtagcgggtgctagggaaacagtggtgagcaggacaaatgtctcttagatagagaagagcttttcctttagaacctgctctttgctttaactcccttccccatcacagaaaatggctcacccactcaggtgcttaaagcagaatcctagggggccatttttgacccattttcattcatctccccctcaccttcctccagtccactggcaaagctaacccattctacttccaaatagtctatctagtaagcctacttcttcccattttcctacatccacctgaggccaggccaccatcttgggcctggattattatacaggatgattattctagcaatctctgtgctgccacttttgctatcctccagtccacccgcaacgtggcagctagaaagatcttatttatttatttattta

SEQ ID NO: 5991 - DNA, 18721 bp, artificial
  synthetic oligonucleotide
aaggaggggcctgggtcttgttaaccgggggtttccccgagccaccccaacagccacaagcacagtgcaggacagacaagagaggcttgaacgaatgctagttgaatcactgactatgctgtgttcaccatccacgaaggaccatgtggtccaatatccttcctattcgtatgtgtgggtaactcttggagcatggatgccacacttatgacaagtgagcagtgattctcagcacagaatgtgatatttttctgttgcacaaagttaaacagtgaccgagtgtccacaattgcccaacatggcctgaagctgccagccaaggaattgggtcacccctggttcactctgaggggctgggggatccccgtcttgacccattggcaacccactcactcttgggaagctctgggtgaagggattttggaagccattccctggctctggaactagcaacccacaactagaagggggagggggtggtctgagagggctgccaaggggcagcagggcttcctggggcttgggcttgctctggggtgtgcccaggtttttggggggcgacggggcctgagcagtgggctgaagagggcacgctgccagctctggttggcccagggccagtaagtctgactgaacttgagccagccctgttggcccacagactctggaagctgaactgctccagcgctccttggcctctttgttttcacttccccacagctctctcttagtgtttaggaatgtgctttgaaggttccagcgtgtttcgcctctgcttagggaaaccaagagcagaggctgggcccaggccagatggcttgaggaagggcacctgtgatcacactgagagcgccccaaggggcaggtggaatgcatggggcacttaagctagcccccttctctgctgggagactccgtgtgcagtgctaaaccttggagattctcaggtttgttttgttaagggaggcagtattcccttaccagctcccccagagagcctacatttgtccaggagcttttggggataagctgtgctcttctgcttgttcagggcaagagagagagctgtagcgtgtgcttttctagctagaaaagttgcctccttcgttggcattagaataagtttcctggcctgcctagggcaacaaagtcaggccctccaaggaaggggaagtgaagatggcctctctcgcactcccaccactgggaggacaatcttacaggcgcaggtgcttagccaggtagggtttggctcagggaggccatagaggggtccattgctacaggttgccctctggcctcgatgcccacctgtaaactgctatcttcaagagtggaacccagagtggttggcttcctcctcccattccccagccccttcacccactgtctttcatggcctttgtcaccaggcacatataaaggggagagtcttccctgctcagtcctttgagggctcatagtgctggtagccccctttgatgccagcatagtgctttgcacacagcaagtgcttaataaatgccaaatgactaaaataccaggcctcttcagtgaccaagagcactctggatctttctctaaccagcagtcactttcctcctctggctgttttctgaagctgggagctctgggttctggtctcttttgccacaaacatgtcaccctgagctagtgttttcaccctctcaactgatttcctccactgggttaaacagagctcaattaaagccctggtggctcttgtatgacatctgcatacattcttgtttgccggctgtcattttagcttcaggttgggtcacttcgatcctgcctgggcccaggtgctagtagggtctttagccttcagctgaaggttctcccctgctcctccaccatctgtttggctttacaacacacacctagtccttggactcttgacacatctgttcctttctgtccccacggccatttatacagctccagctcctgtgcgtgagggggccgtggcacatgagcaataactccgatgccacaagggcacctgagtcatttttctgcagccaacactgtctggagctacagcagacctccctcctgctctgtggtgacataggccctgttcaggtatgtgtgggctatggatttttttcccgatttccatttctccttgatttcagcacccaagtgaacatgcactccaaggctctgctgagggtaaacagaaagcaccatcgcaggggtccttcctcctctctctcggaagattcactttctcttcctaggtaatgactgctttttcctcccagcttcctctcagcctacgtatatttagtgcacgttgccctggatagagtttaattaggcaccaatgcacccaggggcaaaaaccaaggacccctctcgggttgagcaaatggggccagcctcccctggctggtaaatgacgagctgagctgccggcaggtagaggaggttgtccattctcagctaatgatcgccttaggcgccaagtgatggaaaatccagaaggactggcgagctgcagggggcagccagggacaattgtatggaccagtttaacatggcttccggagggatggcagcaggaatgctgtgtgtctgtgtgtgtgtgtgtgtgtctgtgtgtgtttcctggtctcctttctctcccctccctgccgcctttccctctctcttgctttcgattttctcttctgtttctagcccacacgagttgaaattagaaaggtctttgaattcatttatttgttttaataaaagcagcatttttaagcagcatatttgtagcaattgattgttaaactaaacaccaagccaactaaatgtgttagggggaaatgaaaagtcagtttacaagaaacataattaacacgtcctttgacttctcctaagcctttgtctggctagggacaagacagaggaaccataatcaactttaataaaacgaaagatggtatcaaggccaaaggggaacaaaaaactttggagtaggaaacaaaagccaaagaggggattcttaagttataacaaatatgttaaaaaacaaatcttttggccaggcgtggtggctcacgccggtaatcccagcactttgggaggccgaggcgggtggatcacgaggtcaggagtttgagaccagcctggccaatgtggtgaaaccccgtctctactaaaaatacaaaaaattagccgggcctggtggcgcgtgcctggtaatcccagctactcgggaggctgacacaggagaatcgcttgaacccaggaggcagaggttgcagtgagtcgagatcgggccattgcactccagcctgggcaaaagagcaagactccgtcctgagaaacaacaacaaatcttttgtttcctaatttttggtcatcagccattttctccttaccaataggaaggctccggtttgaactctacctgttcatggggacagatgctgagacctggaggggaagagggaaggtggtacaaggaacctgcaggagactgcagtatcaggtggcagtatcaggaggctgataaatccaggctaatggaaattactattgcacaacaccagagtcttcacgtggcctgactttcaataaactgttcccctcctcactccttggagaaagtgaaataagacattagactttcagtaatctcatatggtgatgatcaatcgaaacctggagaagaaggccaatttatagaaattgtatctgcttcactgggtggctggaaccagggagctgaaaagaaaacggtgctcgcctttgatgtgtgaagttgccccaaaatgacaaacgccaaaaaacactggctatacatgtggggtattcaaagggagagggtactcaggagaggcctttgttaggtggatcattgcggggacctgaccaaagacacatgcacatgttcaggccacataaaagcgatttatttttcttatcttttggctattttaagttggagtttccatctttcttatttgttttatcaccaatgaagtttatttactgaattaacttttaacggaccctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggcagcgatcagcagctctgcacgcgcttcagtgcatgaatggattgcggaagatgcctgcgtccgctccgctcaggaggctctaggagcgccccctccccgcccgccgcgcccgcccccgtggcctccctaggccctgcgggcgcctcggggttcgcaagctgggccctgcggcgcgatcactctcacccagaacccccgccgccgttcccagggccttggcacctcgccaccgagtgtcattgggggctgaaatttgacacaagccttcctggcctccccgacgcagacaccgctgtcagccccctcctttcttcgcgcccctagcccctggcggcaagtttactttcaaggagttggaccgtgtttccgccgcaaaggccggcggcgtgcgggcccgggaggagggggcgggctcggaacgtttccttcacctgctcggccgcctggggtgtttgtaggtccccgctggcccccagccctagcgtccatacgcggcgctccccagcttttggcggctaatccaccgagagtccctgcgatccgcacatgcacgtgcactctggataccctcgtcccagcccacatcagcggcaaaatcatgtacccaaattctctttcttggcggcttacagtcttgaaagttgggagagcgccacagacctcgaagtctgccgcagaaatgttccccgtcaactctgcaaagtaggtctcattaaaacaaaacaaaacaaaaaaaccctccagtttcggcctagggctgagagaagcgggaaacgcaagtgaaggataccccaatccctcgagtttgttttggtggagctaaaccagaaacccggggatatttctgtttgggggaccgccaagcccgggatgcgtctgcctaaggcgaggtggggagaaggagagcgcaagaagtggacactcgcagcgatccaaaggcaaagccaagtaccccgcgggaagaggccgagctgacccaggttgcaggaagaccgccacatgtgcgcaaagacgcactcggagaggcagagcgcgacccgccgacctaggagactggcgaggacaggcgagaagctgacagcaagacaaagcgggagtagagagccagggaggctcggtcgaagacccgaaaacgaaggcagcagcagccgcccgagtcccgaagcggaggcgtgcgcagccaggcccagcctggcatagccccattctcacgcctaaggacgcggacacagactcttggcatgacttcctgccagagctggtctctgtagggcttgggcctacagttggctgaggccttcccagcagacagtggggtccccaggggaggtcttcaagaatccgggcccctctggtttccgccccctccttgagcccaggacaaaggtagcgggtttgaggagctcggactgttctcagggcgtctacaaggccatcagagagctggtgcctccactctcagggcctcgggcaactttttatctgacttggcggcgctggagggctgccactttccaccgcatttccatttggccttcgcaattgcaataccctgaaggcactgcccacaccctagccttccagcaatcgggattcaagctggacttcccataaccagcaacagtgtaacgtgaagacactcctagactcaggtttccctcaacccttctcccgcttgtccgcacacggggcggatcaacgccccccacccacggccccacccccgcgggctccgcaacccagggccgcagctaccgagtgtgcttctcctccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaacatgtattactctcttctttatcaaaacatagaaatataccttaccctaaacagaaacaaggttctcacagactgatggggtaggagtgaaggagaataaacatctttgagaggattcagtttttttccactacggaaagggaagagaaactgacagtgggaaacacacttaggttatctgattggaaaggcctgggggattttagatgccaaaaactgtgtgaacttgacctagtgaaatgtcatcttagacaccaaattataataataattttatggattcatttttatcatagtttaaatcaataaggattgagttggaaatcttgctctagttataaatagatggagagaacacctcaggaaaactccaaagtagtaatttgggtaaaagttagaagcggaggaaagaggtggaaaatgacagttaatgagcctgtggcctccactctttgttacctaacagttgtcagagaaccatcaaagggagggaacaggcgcccttctcagaaccatcacaggaaaagcagacattctctggctgctgcagatccccccggtggtggttcctacacccagcctcctgggagtttgcctatgtgtatttatgtgtttccgggctggggagtgtagctactttcacaagattgggccctgagcctgtgaaacccactagcgaaagttctaccacgaggaaaagccattctaaggcaatgctggagaccaggaactgctctgccatcatcaacaatatcttcatgattcctgcactagcaaactgcttcacatcttcccacctcaaccatggggccgagctctgggcctcttacagatccatacaggcgggaccttttgcagctagcacagatgtgtggttaaggcatgagacagctggccaaggggaaaggaggctaaggctggggatggctgggaaggaccaaggcccaggagggcctcctggtacaagcatagaactgacccagcatgggggagttgtacctccagaacccactaagggtggcacttcccccctggacccaccaggtactccaaaccaagaggaaaagcatccttgtggcatgtgggtggattaggcccaaggcgcaggtgagctctgctgcagaaggaacctacacaccaagtcccaaatgcccaagtgctgacagggattggggcaagcaggagggaggggggatctttctgcctcccatcacctcacccttctgtaatgttttcctggaatgaacagaagtcgccagcagagttgttcctggagcccctccctccgggactgtcactacctcctggtgtaagacagggaggaccatggccttctgccgggaggatcctctggctagtacccgagccttggattctggcacgaagcctcacagttccgataaggctttacctcccttcccacgtctcgaagaaaaacaccccctggaactgctggggtgaactcggagcctgaggccagggtcagcggggggacgggtccccaccaccaccaagttgccggcagaggtaacagctgtggaagggggaggggagcgacaggcagccacgactgaacggttgcgatctagaaaattcaacaagaggccgcagcggtggcggcggcggcggctccaattagctgagccaactggggaggcagagagcgagacggcggccccgccgatcgtgtcccgggcgagcaggcaggcgggggcgcggggcctcgagctgccccggcggccctcgctcggcccctcccgtgggttctcggagcgcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgactgcattaaggagctcccgagacagaatgaggaagggaaaagccgagagggcgggaggagacagggagacttccgcgggaggccgatggtcaaagtggggggtgaaaccgctcagggtgaccgggctggagacccaggaacccgattcggcgcgaaggtgccgcgcgagttccagcgagcagcctgcccggccaagtggcgcctgcccagccgtcggccgtgccagcttcctgccctgcccaggaccgcggagcagtcggggacgccgccgcaggctggcccggaatcgcaggacagcggcggggggagggggtagccaggccgcaagtaaactcgcactagagctttctgcacacctccgccctagagagggggcccggacccccggtctgtgaggcgtcggctttggccttccaaccttggggtgcgcgaggaagcaaagacccagggggcacccccaccctcgcccaaggcccgagggtgggggacagctgaaatgtctttggtcttgtttgatgaccgcttggcggatctgctcccatccgggttctgccgttccgagagtgccgggtcagtgatacccaggccggtctgagcaggcatgtggatgagcaaaagcaaatctgtcgctcctccgaccgccacccctcacttaacctttcctgcatccaaggaaggggagggcacccagactctgccccaccccccgcggggcgctccctctgcctcggaagctgagactaagagcgagggttttccccctttcccctgggctcgctgggtttctaacttcctctaaacctccctcctcgctccgaaaagccccgaggagaggagctgagaggaagcacgccgctagtgtgcaaaatgaagaccatgtgtgaggacggcggcatcagagtgcagccgcgggggttagggggtggcaaaggcccccgcgcggccggaggctcggggccgcagcagccagtgcctctgctctgcgttggggactcggagccgcagcgagaggcagtggagaggcagggctggcctcgtggcgggaggcgaggagggggtgcgagggctgccgcgccgtggggggcagggggcggggacgcagccccggcttcctgggccgcagctgcgaccgagggcgcaagagcagatcgtgctctgcggcggtggcggctcgggcccgccgctctagcagctgagaatcaacaaagggaggcggcgggggaggggcgccaccgagcgttcgctggctgctctggaataataaaaaataattaataatgataataagagaaaaatcccccggctttcatggctctgggtttccgtgtggctgcagcgggaagcgcgctgtccttgaggcggcctctctcgcctggcctgcccgcccctccccctcctcgccccctcccctccccaggaaccgggaagagaaaggtctgcagctgacaaatattatccattctccccatcgatcgcggagtgtacagatgtgagcgcttgatgtgcccgcggagcggcggatcctccctgctcgctcgctctcgcccaggctccgctcgccgtccccctcctccccctttgttctcctcccctttccctctctttaaatagatttcagggcgctgcctgttggagagcagctggcgatctctcccgagagagggagcgagcgaagcccgaggtgccctgtcaccagcctcccctcccccacctcggcttttctctacgtcccccccaccccacctttctccagtttccaaaatagaaaacaccgggaacacccacgtccactgcaccgcgagcccctgggagcctttggacccctcgtgctgttccttgtgtctgtgtctgtgcagaggaagggcagtgcagggaggggacccagggccgcggcagaagagccaagggtccggatctttccctggcagcagcagggacgcagcgtgggtcacgctaacagggtacagtttacccattagggaaagtcggcggagacggccctgttattcctcttttgcagatggcagattaatccggcagcacccggcctcaaagggaccggctgctcggcaaagggttaacccgtcggccggtaatcgtggacacgcgcgcacacacacacacgcacgcgcgcgcgcgtcctctccgcctgcccgagcgcccgccgcggcccgcagtgcgcccggggctgggggagtagctgcgggaggggagggggtcgggggaggggcggggcgggcttaaccaggccgctcgactgagccggggccacctcgccgtctgtcacttaaatgattgtcctccgctccgctcagtgcggtcagtacgggctgttaacaggcagttgcaatcagtttccgaaaggtcagccaaggtcctccggctctcgcagacggaaggcattacgaaaccgcttttgtatctgcaggcactttagaaaaagaggcgagaaggggcgcaccgcagtgccgcggctgctgcgaccgggggagagggtcgggggctgcggagcagaggagtccgcacccccgcggccagggtcaggcggcgtggatatcacccgcggagtgacccagggcctccgggtttcggtggggaagcaggaagggggtggggagcaggcggcaagggaaggaggagtgggaggaagtgggagaggcgtcctggctcctctcctcacccagccaacagcccacacccggacccagacgggagcgggcggccttggacgcgaggagaccccactcggactctcaggccctcctggcgcctggaagtagggagggggtgtgggggggggaaagaccctcgccgagcgagcgagtcccagcgcggtgtctgaagacgctgctgccgccgccgctagaagtcgtccatcagcaaccagtccaacctgccagtgataatgtgcgatcaacaccaaatcacccccgccaggcgcgatccatcatcgcagcgcgccgcgggcccgcgtgaggctgactcgcggctggggtggggagggggggcgcgcggagcaggaggcggtcgcccagcacacccggactctccgcgcacctcgctgcccctcctggaggcctgcacccaggcgctcataactctccaagttccccagctacagagcgaaaacccagtggctccgagttctgggcacagctcacttaggaatccgcgcgtcctccgcgccctgctgtcgtggtcacaccctgcaaagccattccagcctcggagctgccctgcccatcccctccccctcctccgagaaaccgtggctggcaggaaattaatatttaatatcgtgaaattgattaaagggctggaagccggcgatgggttggggggaagggtagggactcctagcgtaattaaagatctgagagtcgtggtcgttccttgtcggccctggccgcacgtggcctttgtgaagccgaggcggggtcggactgggctgagcctggcgagccggggtcaggagcccgtgcagcttaggctctggcccgcgcggccgggttttttcggggcgggggtagggctggggcggcacagcagcggcaggggatgaggaggtgaccttagggcacccggggctgcgcgcagagccactcttcccctgcccgcctgcaccgtgggccactggagcccgagggtcgggtgctacaactgctgtcttgcttgtacagcacagaagcgcctttactgaccaggtggcctcgagggcgcaccgcctaccccccaggccccctttcagcagcctcactctgggccccgcttcgaggcgcctccccaacccctgacaggagtcttctgagccccccacgcagcccttcgggaggggagtcaggttcacctttccccctgcaacttggaaatcctagggcttaggcgccccggggccccccgccggttctctcctgtccaggccccagcctggtacgctcacgcctggggcagcttaactcgttcagctgcgctgcagatggggcctgctgctcgaagccgctgtctccagggagtcgtcaccgaaccagctcggccagccgcctgtcgtgccgtttaaggttaccgcgcttcccgcgaggggcatcgggactggaccgggcaggaggtgggtgcagctgaggctccctggccacccgagctaacgctaggagaggaattcggtgtgcaaaaggtcagcggtaacccattggccctggctacagtttagaagtcgaatggttggcttggtggtggggtgaccccagctcacggaggcctggctccaaagggctgatgtgaactttttcttgtatctgattttttagtgaagcactctgaaaagtaccaagtgtgcagaggggagaaaacacaaaacacatcaagctgcgtccttggccctaatcaggggagcaggaaggccctccagactccaggccctccagactccaggcccgctgtggggaaggtcaggaccacagaggattaggcccagtcttgggtttattgctgtacttgaacaaagtgccgggggctgcctaaactggagcaagagagaggtaattaagagggcctgcagaaggaagtaaaggctggtgtggctgctgcccagggtaggtggaggaagtgttttccataagaataacaagccggtgcaaatgttatgcagaaagactatttcaccaaaacaaaaccaaaaagttcacattctgcctctcaagctgagctgataaacaacatgcaaactttggttggaaccttgaaccagtgggaggtgtcaacccagtttacaaagggtaatggggaaccgtttctgggtacttctctgtttctaccattgtgattctacctgcattagctgctccctttgggggcccttctgacctcccaacctgagcccagcgggagatcactcagaatgcaccgcattcatcaatgccatttctggtaaattggacctcaggttttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggctaacagtcattacttctgaaaagttgttgtttaggaaaaatgatgaaagtttatttcaaccaagcaaaatatcaaatatcagaaactctggattaatttctcagctcttgacattagctgggtgggacagacacaatttcccaccaaaacacaataccccatttgaaatcagtaaaaactcccaccgcatttcataaaag

SEQ ID NO: 5992 - DNA, 11712 bp, artificial
  synthetic oligonucleotide
agcagctctgacctctgaattcgggttggtggaagtaccatgggagtctttgtgaacatctccatcatcactgccccttcaccccggctctatttcctagcccctctggttccttctcataggctgctccttcttgtccttccttaagacagacactagctgctggcttccctcccatgcctttctttcctcctgttaatgaggtctgaacccacacacctggcaggaatcttggcaccctacctgcttggagaggttgccttagttgagtaaacttccttggcttctggggccccaggggagaggctagaccctgactgcagccccaggctggctcaggtggaaagtgggcacaggggccccaacgctgagcaggctggtaggccctcaaaaggcttttattgaagcctgttaaagggctttgggcttcctctgatgaaaggcgcttaagtgcatctggttatgattacaggggaggagaaagccaggcggtctctggggggttggaccagtcatctggctctgccttcctcagggcagagctggctgctggtgaggccaggaggccaggtgtgggggcaggcaggaagcaggaccagtacaaaactctccaactctctgaggctcctgaccccagcctctgactttgtcaggctggactaccagaaacagcatcggggctcagaagtgccaggctcctttgagaaaatcaagttcagagtggctgctgaccacccctgactcacagctcttcactgatctccacctccctccatctccaaaatatcctcccaagaacccctgaccctccatctaccttctccactgctcttctccctcggaggaagttaaaataggcttttgccacaagggtttctgacagtgataaaaactaaggaaatgcaaactttcaaaagttaaaaaacctcaacgtttgctttctctttttcaactagccaggtattgtttcccataaaacagacatcgttaaggctgtttcacgtcactgtaactgacaaccatgccgaattaagggaagagattaatatgaacgtaacgtggctgccctggaacgtcatcgggcagtcccaagccactctgtgcccggcgcctgtccctgcgcggaactccacgtgtgcacaaaatgctctggggaggggaggatcggatgggttaaacacagtccgcggttctagaaacgaaaatacatttccttattcccgccctgatttaatcctgctgcgtgttattattgtcaagtctcttcgcaccactgtttctaaaaagaaaacccgtgggtctgcgcggccctcagccgcctgctcggcttttattgtgcacgcagcctggtctgcgtggatccagcacgtcgtgaccgcctcgcaggcgcgcacggacaccctcggattggcatttctataagagctgggcgcattgtctctgcggcgacacacacacacccacacagataataaagggccacggactcctgaccaaccctcctcgcaacccataattagagatgacctttgcgaaaggcaattaaaatatggtaatgatcgatgggctcgcctgtttccaaaaaggaaaatacacaggtgttggcttcaggaggctccacctggccgggccgcgaggcctcctacagctcatgaatgaactctttctcctgggaagcttcgattccccgctacctacgctagcgctggctcctctcctccctttcccctcccccaccagagctctggcagccaggagcttgctggcggcggcggggctttgtcatcggaacgcacacacagacacgcacacgcgcgcacccggccaccacgggaccgcggcagccgcgtccttcctcgctgcgcttccttccctgccccctcttttaaagagctcctccagaccctttcttttcttccgtcctttatgtgtgcggtccttttgcatcaaggagctcaggaagcattttaggggggccttccgcggagcgccggacagctcctgggaggcagaactcaggaccctacacgcgcggagaggacgcggggacagccgggctttgttttgtctcttgcctctgccgggagggcggagaagcctcggccgagctggggcccactggcgaattggcggcggcaaacacccccctcctagcctaagtggaacctgaaactccggacttggtccgggtggggcacaaagctacgtggagggtctcccagtccacaagtggctctccccacacagacaaatgtgcagtgtcattatggtggctcctgttgctcgaggcctcgggggtgctccggcggtgcgcgcacacctcacctccacaaggcacggagggcgagaggggggccaaggggctggggctccccggggggctgcctggaggagacgccacatcgggccttcccgcacccccggctgccttcctggaccgcgagcacggagccagggcggcctctcgcctttcattacggggcctacgaaagcagcagcccaggcaaatatgtagctattaaaattaatcgccccgcgttgtcagctgaacataatgcaaattatttatgggctgtctgcgcaatatttatcatcgtgcaggctccaggcgcttcgtgcctcctggcctcccccgcccgcccgccctggccggcgcagggcgaagctgcgcgcaggctgcagcggcctgggggctctgggaacccgagtggggttccaagggcgaggccgtgcgtcaggccgtcttccaggccgagggcctcactttagtttctgccattcagtacacatttatcggaggcctattacgtgcaaaattaggaggtccgcgaaatcggggtgaaaaccaatttggagaaatctaaaccaaacagatgagctcgggctcgaggggcgatgcagacagaggctcctcagctgcacaagagaattttctctggctcaagtcggtccttcaacctgggaaacccatgtttgctaaagctggattcgctctaggagaaacagggagcatctgatgtgctcaacagattcgagtacaacgctatcgactggaacaggaattcggtgtccttcgagcctcaaaacttgtttgctgatcgcagataacagattaactgttaattgtcgaaatcggccaaccatttagtttatcactgttgggggccccttggtattcgctgcactttttatatgtaaaaacagtcttggtacctcctaaacggcttttgtgtggcttttgtttctctttcaaatacggtgttttaaaaaacagcagcaacacgccaccccaccccctcttcaaccaagccttctggtttaaaaaaaaacaaaaacaaaaaccaggaggagaaataatctataggacaatcccccccctactggtcggagctggcgttggggctttttacgcagatcgagtcgcccagggctgcggaggtaaacaggctttctgcaccgctgctaaatgaatcacgagggggaagaaccgagactgctgggcgagggaggcctcgggatctgggccgggagccagggcggggacggcgctgcacggggggcaatgaggtggagacgggaccagggttaaccctggtccaaggccccaaggccagggaagggagagtaaggccggtgggcggtccagccggaggcccctactcgctatctgcgaggcagggtgaacgcgcagcctgggcctccatccccagcgcgcctgggcaccacctggggccggtcacgctgcctgagcccatctgcgaggaaggaggtcacgaggcaccccctcccacagagttttaacaactccaggccttcaagacgcagtagcaggcctgggtcttctgatgttcatttaaagcaaaatgatcgcctttcttcactgtccccaccccagacgccaacaacaccttgcacctagcagaccaagcctgagtcaagacgtccttcggtcctggggctgggggaatggctaccaacgggcatctcttctgcagactaacagaaggggatatagccaggaagctactataaatttatattcttcttccggttttgttttggttttggtttttttttttttgagacggagtttcgctcttttgcccaggctggagtgaagtggcacgatctcggctcactgcaacctctgcctaccgggttcaagcaattctgcctcagcctccccagtagctgggattacaggcgcccgccaccttgcccggctaattttttgtatttttactagagacggggtttcgccatgttggccaggctggtctcgaactcctgacctcacgtgatccacccatctcgcctcccaaagtgctaggattacaagcgtgagccaccgcgcccagccttcttaaaatgtgatttgacccaatttaaagcctccctttcttccccattaacctccagtttttgacagattttcttagaacattccaaagattctctcattacttcagaaacttatctcgaaatgatgtaaaaggaggttcaaaatattaggttgcttttgggttccctttatctcgaacattgttgcgtagatttgagaaagggctgatttctactttgttttctaatcagcaagtcactggtttttctacctaagagagactgaacattaaccacagtgaagcagaagggttgagccgcatttacaaagtgccttcacattttggtcctcagaaacccatccgagggggacagagtaggtgttactgttctgattttacacatgaagagactggccactcgcccccacaaatttctggaagctagtcttcctcactgaactggagccagaagccatgtgaagccagcctgctcctgcctacaccctccttcctccaggtcaatgtcatttagaatatattgcatccttttcttggatctgtctgctaggacccgggccaccctcctgctggaggcaaccccgacagcccatattttaagcagctcttttcacagcctgcaaacctcacggattgtctcttacaactgtctgtttactcacttccctccacccagtcaattccgactccaggcccgggaggacaattttaaagtgtttctgcagacagaccctctggccgcgccggaagtgttttatggacctgtgagccgagttaatcccaggaggcgcggctggattagtcccgggtatgggtgggggattcatgtgtttaggtttaatccccatggggggggggcgtaaggagaatgggggtcgggtggcttcagcaatgtgtgccccctccccattaaactccgagatttgcgctagagcggatggaaaccgaggcacgcagccctcgaccccggccaggcgtggagtaggggagcagggggtgccccgcgtgggcgcaccctaagaaaccagtgcggacatggcgagcgagaccagagcgcagttgtgtgtggtttttccccaggtttttattcttccagccctgtggaaaggaggagagccgcaacccggagagggagccggaaagaaacacttaatcaccggcgtctcgctgctcgtcacgcgaagatggcagcggctcccctgggtttcaaggttccgggaaaggcgtgtgttctgccttaaggcgcgcgggctgatgcgctctctccctcggctcggcggccggctccggctcacagagcctctctcaacgccggcaagtgcagccgggccgcccagcccccaggccagcctggccccctctgggcctggggttggcgagggcagctgggcgtctgcgctgcccagcccagccgcggatccatggggtttcgcgagctgaaagtaaaggcttgagggagtggggacacccacaccgacccgcggcacgcaggggagtcaagctgcggccaatgcaagacgagcagggtagactactactagcggtggccggaggctcagccaccttcgcgggagaggggatttaccgccaccctcatccacgcgcaggccccaccgcccggtcctctcctctgatccccgggccattgcgaaacacggagcgaacaggtcctcgccagcagccgtcatttcccgggaagatgggaacccacaagcctgactgtgcttcctaaggatactagcgtgcgcgcagaccttggggggaaagagggcagcgcggtctccccgacccggactcttccctggcgcagcacacaaccgccacgggcttccgaagcgcccgagcggggaggaggaaggaaaagcggaggcccgggaggcgggctgcgcgcttggaagccgtgtgtgtttatgtgtctgcgcgcgcgccctggccggacgggtgttgaggggagagtgatcgtgagcaacccggaaccagcagtcccaacctggactgacgaactgggctctccagtcctgggccgtggggctccatgcctcgggctggcgggacaagcggcggggagcccggagcttcggagccgccgccgggcatctagccagctccgcgggagaagcccgggggcgcgtcgggagccaggggactggtgtgaactagccgcccccgcaggcggacgtttagctccggcacccgggagcactgacactgggcgataaggagttcctcggcaatcggctgtccccagtccccagtcacctccggcggacgtgaccgccggatgctatgcagctaggtgggccaggggggcctttgcattgccttccctgaccccttccttgccgcggaggagccacagtaagatgcctctgtacgactctccagaactttcttttgcaaaataaaggccaaatgttgggccttctagtctcttcatattttcctttggaaggttggggtccaggcagtcctctcgaaacaacccccaaacagatcactttcattacaaaacgctagagaggcaacacagccctatttctctctctggtcaatccaggccctatctctccctctggtcaatccaggccctattatcccaagctgtgcggctttgggcaaaccgcttaacagttcgaaacctcggagtcctcatctgtaaaataagaccaatactattatctacctcgtagggttgttctgaggataacatgcctccatacataaggtgcttagaacgctgcctccagtacaatgctacgtgtgtttgttactatgatctggcactccctttggatgggtagggagtacaaagttccgggttaaagttcctggaagtttacatggagccagtggtcttggcagggtggaaagggcactattgtatggccactgaaaagtgaaggccaaatgccctcaaactgtctaggtctccactagaccgtcccataaaggcttgtgtgtgtgtggtggtggataggagggagagtcctttttaatggtgctcatttagactggattaatagcaagttccgtcagggctcaggcaccattacccactctctccctgcagccctggggaagagcgctggtttccaggacctccagcctactcttccaggacaccttttttgatggctgaaggccacctctttaaatcagttctcggaggagttggccaaaagccatgtcctctgggatgtactttggtctaacactggtgcagggctggcgtatggcaggccttgtccctgggccgctggcgggccacattttactggtgcacagatgcaaataccacttctgtagacagaatcggtcagacttctaatttcaaaaggcttcccattacctttgaaatggcgactctggcaaaaaggggaggagttgcggcaaataagagcctagggaggcctcggcctcccctgcttggcctctccagggtcacccataattcattaggtgaggctgccttttccttttcaaacacaacgcaaatggcctttgccttaagtggctaccggcgtttgcctaatcactgaaatgtgctggcagtgcgctctagctctcagtagatccttatcggaactgtgcgtgccaagctgccagccccgagaaagacaaagaacacgggcgcctccaggtttgcttctgaggcctcagggtcacctctggggcttccccttcacagcctccggcccctacaagacgctcccagccagcctccggaacaaacccgcagccctaaatcagaattccagttctcgagcgccacccggagagttcacatttcccctcctccgaggccgcgtggtgcgcaagaaagagcccgagggcggcggcagcacacgtctgggcagccccctccccgtacccagcagcgtgtacgcaggaaaagaaaaagccaagagaaaaacgtggactgtaaaagccaaaacgcagaaccatctactactaactaccgacaaccccaggcgggagtttgcaaggagtaagcaaccctctaatagaaactacaactaaaataattcctctcttcgcgttctattaaggtcctggaaggtggaacgcaaaggggaccctgtcttcttaggacacagactggctgcgccgatagtgctcagccccgcacctcctgagcatacatttaatgttaggcaaagagcaagtttcctatctaccgtttgaccacagtttctcacagtatttctaattgattcaacgtgtattagattgaaacaaaaatgatcttggttggaatatacacgggcaacctgtatttagatggggtaagttcctgcagctatctgaccacatttgtctggtccctctgagaatccacgttttctagcccgagaaggggcaggcggccctcatggcgcctccttcggcggtttcctggcgaagcgcccatcctccccaagcaccaggaacggaggccgtccatattaatactcgcgggcagcctgttctgacctatactgtcattttttccatcggtcgggatcgggctgggggtggggtggggcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccggaagagccgcccttactcgactggggtgaggggcgggaaactttgcaagaagactgttccgcgccttccccgcgtggcacctcagaagaacgtgggtgggtttcccgtccgaggccagaccacgctaccctacttttccaggtttcggacctgaacctcgtggactacgggagggagagtacatttcgggccactgcggggggcggagggacaccaaagacaggcgtcttcaagggttctggcagatggccaagtttgtgtcctttccctcccacgctagagtagcgcacgccactttggggaagcgtgagaccgttcaccaccggccacgaggccaccaatgtcttccaggtggggccgatggtttgtctgcagcactcccttccgccttgcggtcctcgcctggctcccacagtcctggggagcccccagagctagcccgcgtcttccctcgcccgctcttccgggggaaagggaggctgtttgtgtggtgtgtagccccgctccggcttgcacccccgcgagccacctcgcagccctccccggcctcggcctcacggatcccctcccggagtagccccgcgggcccccccgccatgcgtaatggggcgcccctgggacgcaggcggggatggcggttccggtcgttccgggatttgcgtgcaagaagaaaacaaggccggcgactacaagagcggcgactccattcttggggttcagacgccctcgcagcctccgcgtcggttccgctctcgccccgggagcccgcttccgtgtccctgcccccgccccccaacgattcctcgtccggcccgtgccgcaccacgcggagctccgcgcgccctggctcccacaccggtccctccataactcgcgctcctccctcgctccgggctcggggagccgctcgctcccagcgcccagagtcagccggttccaccttcggctgcgagagccgccgccccgcgccacccccgcccggcccggcccttgtcccagcccggctcccccgccagctgcgccgccaccgccgcacgtgacccgcccccgtcgcggcttccgctgagctgcctgttccggggcacaaacaatttttgctctgacgcggggtctctcgggggccctggcgtcctctactccctgctccccaccccaccccaccccctaccttccgggtaggagaactcaaaacaactcgctgaccttcgggccgaccagctccgtcttccactgactccagcattccgttcaaacccagcagccacggcttctaagatttcactccgctctgggctgggggggagggggcgagttctccgggagggggtgtctcagatcgaaagagccacttcacgctctttctcctcctccgaggtgagtttttagactatttggaggccttggggaaacgcgagcagccgcgtgcaaaggagcccccccgccttctccccgcacatgcagccttgtctagtgtgacccgatttccagggtcagcagcagagggcctggccagcttcggaaataccaccaagcggtggactgtggcaccaggcagagctggggtggaggactgtgctaaataataatggtagctcctactcacgtggtctgtgctaagttcttcacaagccttccaactttacagagtgagaaactgaggcatagggaaaggtcagtcgtgtaaaactgggtaaagctcagttactcagctaagtaagtgacttagtgaggatttgaacccaggtctctgagttcagggtggttaaacatgctgtaagtatgttacagtgcataccttggtatccacagtacaaacctgtctacaaaacccagtgtttgcttgagagctgtatatttggcgtgtaacattgtggctggcatatagtaggcactcaataaatatttgtggaatgaatgggtgtcagaataaatgattgacagaatcattgatgacaagtgatgagagaaaacagtcctaaccattgttcttcctaagagaaataaaaacctctagctgttttttgagtgttcgcaggtaacaggaaactcttattcaaaaatatattaatctcctacccctatcccctagccaaccaccctggtagtcatttgaacttgctggggcacatagccaaagcagcttctacttggtctcggccattttttcccaaccctgttcctgttctgtaggattct

SEQ ID NO: 5993 - DNA, 1342 bp, artificial
  synthetic oligonucleotide
tccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccgggccgcctcagaacaggaagccgtgcgccgaccgcggaagcccgcccccatgtagcgagaagtccgccgaccccagggacaggagcgaggggcggggggaggcggggatgggggggaagcagggcggccccgcagaggggaagctgcgcctccgcaaacgctcagaagcagcttcgccagacagccgcaacgtacatgttgactgcccgaggcggaagtcgatcggcagagcggaagggggacctgcagaggaccttccgacaggtctgtgtctgttctctcagctgtctagcaccgcagcgctggggggcgcgtgggagtgaggcggtacctgtgagcgcgcgggagagcggaaaagggagccgcgcgccgccggaaaccagggtgagggctgagccggagtcgtcaccgggaacgtcagcagttgccccgcccttaccctcgccgctctccctcccgcctccgccccctggcgttgtaaaggcgacaatttgcccagagaaatccaccatcgcttcctaagtggggcacaaacacagccaggggaggcctcctctaaatgttcgtgaattctggttctggaatcgcgaagaaatgggagcggccgcgcgcttgtgattctcaggcctttgctcctcccatacacgtccacggcgcgttacgtgggagaacgttttcgcccctttttttttttttccaaactgtgggaaaaggtgctagaaaatatgattgcgggtagagacagggccgctggcagagtaactcaattttaatagagtcgggtgtatgctgaggtcgtcaccatcccccaaatcctgtcagtcccacacaaaaacggcccttaaatcccctgccacgggctctcatatagtttttgtccttgctcttgcagtcaccgctctattctgaagggcttttcagttcatccatgcctaccgacactcccgtcccccccatcaaagtccacgtttaattttttgtacctgctttaaaacagcgattctcaaccttggctgcactttgcaattatctgaggagctgttttttaaaaaaatacttagatatatgggttccacccctgtagattcagatttaattggtctggcttgaggtctgggcttggggaatttttgaactttcctaaggtgattctaacatg

SEQ ID NO: 5994 - DNA, 1120 bp, artificial
  synthetic oligonucleotide
gggagtttagaacggggtcagctgcagggattgcagctgggttttgctgattaaggtaaccggaaagcaaaggagcgggtgtcttaggtggataaacccgtgtgaggccgcggaggtgggaagaggccatgtgcctgacacaagataactcggtggagggcctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtgga

SEQ ID NO: 5995 - DNA, 1183 bp, artificial
  synthetic oligonucleotide
gaggcggtggcccagggaaaggggagcgggccgagcggcgcatgcgcggggcgccggccgcgtcacggcgaacgggcgggcaccgggattctagagggcgcggggggttgagtggggcgcgccggctgcagctgccgaggcggggctggttggggtcgtcgcctccgcgcctagccgcgaccaagccgcgaaaggggctggagacaaaaggtccacggctgcacgctcgttgtccggcaagaggcacgaaactctggccgctcccctttccttcttttgtaatcgcagggagcctttcccagttttttgctgggaaaagaggcagggaaagggtgctaatgaatgagaaagctaaaagagaggtggagagaggttgtcactgaatccgtgcttggcagcggatgcttttagtgctaccctgtcattccttaatgaagatgagggctgggggtaaggggaggtcgtccaagaaaaggactaaacaaaaactgcctaggaaggtgtgcgacagcaaacggtcatctatagagacagcttctcccacgttctgccccaaactcaacaaatatctatccagcgcctaccctcactagagaccaacctagagagaagctaggaaggcagggacaaaccgtgactttaagctcatttgtatattgtcctcaaactcccaggacctactctgctctctatactccctataaatgttagacttgtcaggaacagaatgcaactagagggagtgcaggcacaggagcagccagggagtgaggttctgggtgttgccgctgtgctaggttgcattcaatatgaagatttctgttcaactgagcatgtgcggaatgagccagcgccatcagacaggtatatgcctcagttgaagaccaatagtgtctttgttcctccgcacagcaaaagtgcccaattagttcataagtcagtttccagaaatcgtctggtaaatttctcagtgcagtattttttttaaaaaaagtatttattaataccaaagtggagggggtgatgtggagactcacagcctattttctcttcagaaacgtttcgtgcaaacccttgaccactccctcaaaaggctgagagatttgcctgctaaggatttgggtactaaaccttttttttttttttaaatgcagatcagaggacaagtgtaattgcacacggt

SEQ ID NO: 5996 - DNA, 2282 bp, artificial
  synthetic oligonucleotide
aaaacagaagaggcagtgaccttctccgggtggggtctatggccctttactgggtacattctgtacacacaggcccctcctttgcctgaagtcattgatgaagacttcattacggagggtttggggaaaggtgggggtctggctgggtaagccggcgtcccagccccgctacagccccgcccagatctggcagagccgtgggcgaacccaggcgggcagaaaggcggggcgggcggctgccaagccggccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtaaggtggcccggggcaaggcagggaccgggactggtcttccgggagcctggaatggcctggggagggggaagtgtaggggggagggtaccatgctggatcccattctatcagatcaggtccaagaggatgggaaagtcctgctcgtagaatttggtagattcatcggaatctccagcttagcctcgcgcctccttagagggagatcctgagatgagagaggatatttaggcgtgactgaggtggaagccaggtctctgcattcccattcccctgtatgaagtaggaggtttcagagggctgaggagagtagagaaggtttgaaa

SEQ ID NO: 5997 - DNA, 1567 bp, artificial
  synthetic oligonucleotide
cttgaggtgtgatttctgtctgcaaaataaaaccaatcctgcctctggccctggaacgaagataccgagagacaaaggaggaacacaaggtaggcaaaattcccaagtcttctaggctttcgccggccgcgcagtcctctactgcctaagaacgtcctctacagcgccccatctgccgatcccggactgaccccttcggggttccgtccccactacccccccccccccccccgcctctcaccttctcatacaagttttcgtcctcgggttctgggtcctcttgccacggtgtggtcggttctgggggccgctttcccgccacagcggacggggcgaccacagtcctggagaagctagattcccagcggacgcgggcggccgggagccctcgcgtcgccgctgccgccaaaagacggcgagcgctcaaaccaaacagcccagccgccatgacagatggtgctgcagggtctcaggggcggggaaagaaatgcgactgtgcgcagctgcagtgggtgcgagcgcgacaatcatcgccccgcctccgccacgctatataggtcccagatctgatttggttttccaatgaggcggggcgttgagcaaccctctttgcctccagttgtcgtggcttcgtggggccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggt

SEQ ID NO: 5998 - DNA, 1075 bp, artificial
  synthetic oligonucleotide
cttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagta

SEQ ID NO: 5999 - DNA, 2678 bp, artificial
  synthetic oligonucleotide
cgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtc

SEQ ID NO: 6000 - DNA, 3031 bp, artificial
  synthetic oligonucleotide
agatatttaggacttgttccaaatacgtgagggccaaggaagaaaagcttccgataccttctatcactgctgccacaggtggccccgagggagtgggctgatttggcctgagcctccatcccccttggcctagactgctggaacagtcttccgacttcctgcctctgcacctcccaaatcacctttttaacacaacctccatcatggctgtgtctctccccggctcaacaatcttctatggctccccgttgctcactgactgagctccttaagatgctgggggtgtggaggcaagaaccactatttactaagggaagggaagagcaaagagtacgctggtattaggagtgaaaaagaaaaaatatccttttttaaaaagcccctaagctttgaatttgtagaaagcggggccctggggagagagcagggatgcatctctaaagagaacagggcgctcctgcggcgccggctcagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcaga

SEQ ID NO: 6001 - DNA, 2770 bp, artificial
  synthetic oligonucleotide
tggttgtcgtccgcagcgggaatggacgctgcggaaccccagcactcttccactctgccctccctcgcgaagcgcaacagcttggcgtcggggagccagggctgcgttgttggcgccacagctggccaaggtaagcagtgcattcccacctctctgtctctctctctctcgctctcgctgtcgctctctctcgctctcgcgctctctctctctccctctccctctgtatgtgtgtgcgcgtggtgtgtgtgttggagaaagagtgcgcgcgcgcgagctgggagtaagggggagtctggtactgctgggctcgggattcggaccaagtccttggcctcatttgtaccccgttgtaaataactacgcccttaaaaatgaaaaagcaaattcttatactgaatatgcaaaaccattgaggatacggatctttccaccatccaggagataacactttctggggcccctccggtgaacgagttttgttgacactgagtcttctgcgggcagtagggagattatatagggggttcgatcttctccctgccccctccactcgagatgttcccgcaaattcatcggagaagacctgagcagactgatggcaggaactgcgggacagagggattttgcagaatgtaaagtatgttggaaagagagaattcgatttgattgaagtgtatccgaggcgaattttaaaagattaggtgggatcatgattttacaatcccctcccgctctccagggctccaaattaatttctccgcccagtgaaatcacagggcttgggaaggtgcctaacagctgagggggactgggtttgtttttttttgtaactaccaaaaagcagcttcgaggggcagccaagttggtgcccgaaggtagctgtcccccagtttctataaggaaaggagtcgaagggtgcccctccccctccattccgccctgcgaggaaaagcgcgacttcagaagatgcgcgggctcgcgctggatgtttctttctcgcgctctcactcctgcccctgactcccttttcacactcatgcacattccgtgcatttggagcagagtaacaatcaaattcaaagaatgttgatcccgccgctgcagagggcagggctgggctgtcttgagtgattcctcaggaattcccctcccctcatccccccctttcttctcacccccgcccatcccccagagttgcgcaacccgccccccccccccaatcagcgaggtgcaagtcaggcccccacccaactgcatctctaaatttcagggcagcttcaagagagttgggagggggcgaggaccctgcttctaattgtcgttagtcgtgagctcttagaagtgaccaggactttgcaaagagggagtgtcgaatggaaagcgaaggcgcaggttgcagggaagtgttttgatcctcagattgctgggatttaccaccgactgcaagtctgtagacacacgcacacaaacaggcacacacccgcactccggggcagagatactccgacgcaagcttggcgctccgatctccgcacgtcgctcccgctgcagccaggccgctcccctgggactctggtccaccacccagacgctggggcgcgaagaccaccccatccatgccccgtttcccgctctccggcttttggggcagctggggcgttcacagtccagaggccagggcactcaacccctgctgccgccgcccgaaggaagggccgctagacttacccatggaatcgggcagggacatgtcgctggaccgctgctgagtcagggactgatgcatggtgaaaactgcccggttgccccagtccccgaagctgcttcaagcgcccccggctctgggcgccccgcagagcatcctactccgcggttgcctctctcggtccttccgagagctgagagacactgcctctggttgcgagctgcagcccaagtgccgcctccccctcccttccactcttctccctccctcctcttctgcctccctctgctctgggaggcagcagcattggcggtccgtgcagccgcgtgcgcttgcgcaagaccccccccctcctccctccccctcagtctccccatcctagttatccacctcccagccttccaagccagacagggagcagttttagccccttggggccagggctgcgcagagaaagagggggaggcttcagtatgaagccaaccaaccttctctatagttggacagggtcttgggtaattatcctgttctaggatttataactggggagggggtcagagtcagaggttcagagctgaggaacacacacacacacacacacacacacacacacacttgagcaggtctggtcttagtgcttccagaatgacataatggagctggagatgatccagagaagggccactctataatcaaagggatggtgtgtgtggggcggggggagggtggtggctgacatatgaagatagattaaacaaacgcagactctttagtctagaacgatgaaggctgggaagtgatgtgaccagagtgtataaaattatgcagagacggagagaaggagcacagccttattcaccagacctgagaattctagaaccaacagcccccaatctttagctagaaaattcagctaaagtataactctgcaccagaaccccagtttgtactgttcaagtgcttttataacaaggatctcattttatcatcatagcagccatgcaagggaggaagaggagttatcaataaccccattatgcagaggaggaaactgaatctcag

SEQ ID NO: 6002 - DNA, 1787 bp, artificial
  synthetic oligonucleotide
cagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtattta

SEQ ID NO: 6003 - DNA, 4295 bp, artificial
  synthetic oligonucleotide
tcttagactcttccctttcttggtaacactggagtatctactgctccagatcagaagacttcggactaggaagatgaactgggctatttcagccaaaaaatataatagagcagacatttgccatgttctcctcaaacacgttaagagtagcaattgattctcacagtacattgttacctggcttgttaattataatcatagaacaagagtctaaaattcaaggaagctgtctgcgacacttactcgtcacaaacgcgatcaattaaacgctaatctaacagtacctattagagtgcactgggatgtttcgtttccttttggtctttaaaaccaaatggctactaatttcctttctgtagcactgagaacttctctttgtatttctttgggccacctcaaaaacacctccaggttggtatcccaggaaaacaacggttaagttcaggacgtttactgaccaattgcttcatattggagatgtagagcttttctacccctattagcatatcgccagtagcagtgatgcagatctgctcaacccgaagctgccgacggcgagtacgagctgcaaaccagcccccgcccccgcccctactctcccagtggcgacacagacgtggaaacatctactagtggagtgagatcctctgtctccgcaattgtaaacaactgactgcatcgggttcactgaaatgtttaaatacactcctgactgcaaacacatccactcaccaagtagcgctaacaatctccccttctccgcctctaggcaaagcatcctgaaactaaattggcaatcctcctgttatggagtggaagaaagtgaggttacatttccccaagcctgcctagcgggtgcttggcgctcgcagatatgctggccgttgctgaatctcggggaccaagtctctggatgaaatgcggaaacacacaaacccgcacattggagcgcatggttaaagtcaacaccgacggctcctggagcaccgcctgggttgtaatgactatctcttttgacaaagattgacaaaggtatagggaggacgcatcgggtggggccctcgacggcggcgtaggttaggaggtcctgcagttcccccgggaacccgggctccctgagtgaggctcaaatagaaattcagaagcaaacaggtactaaagtgcgtcctagcccttgggcatattctctgcggagacagcaggacctggaccccagtggcagagccccaggcgaacgctccagggtgggagggatgccagagaagcgcccctttctttctttttagaccgagcctcccatcctcaccccaagcacccaggtccacttgttagagtgactgggctctgcgcgagagccgaggcgaggaggctccctctcagaactgaaggagttggttggtaaaagtgccgcctgggaagcccagcgagccctcgaagggcagcgtccccagggcccgctggaagcttgaactgcgaacaaggccgacctcccttctgccccagatggtccagagccccatggccggcggagaccgggagaagaaggatgcggaggctctgccacctcgggcaggagtcccagagcggactcaaccggccgctaacagccaggagccgccatccgccgcctgcagcctcggggcgaagttcgcctgtagtccttggggtagaaggttgggggtggcgggcgggagcgagaaggaatggggtgggagccaggagaaacgcacctacctattccaagcgcaagtttcggcggcgtccccaggtgctgttcccccgccccctcgccaggtgctcggctccgccgggcgctgccagtgcccgggacttagggcgtctcggccgactcctgcgggaaacgactgtaaatccacattactgttcgagctgccgctcgggcccccgcattgctctcctccggctgctggcagcggtgctctaaaccggcggccgccggaggcaggaaccgaacctagctactattgcaccagcggacgaccgctgccagaagggtgcttgcgcccagggtcctatgtgtgtgcgagagagtgtgaatacgtgtgtgtgtgtgagtgaaagagagtgttcgtgtgtgagagagcagaaggggtgagctcagcccccggggcactcggaggtgaactccgggctgagccgaagctcgccgcgctcccgggtgctgggcgtctgctcggctgatggctgggctgatgttgccgtggccgccgccgccgcgctctaaggctggtcgcggtggtgcaaaaaatgtttctccgctactcgagaccaaaaaacctgccctgtctactgagcatgcccggtttgacagcttcacagccgaggtttttttttttttctccttttccccaagactccaggttttagccgcagctgagatgggaggtggagggaggtggggggaggaggagagggagaggaggaggaggagaaagaggagaagggcttaaggagcaagtatcgggcagaggaagggaagtcgcaatgagaaagatcagggtgttatagggtggagaggggaaggagaaagctggatatggaagcagaggaaggaaatatggatcaacaaaatttagatttcctactacagtggatagatgcctggccaggtgactcactcgatgttttttttttttttttttttttaattactttctcctgagggtgaggggtggggtggggggttcggatgagtatttgtcaaccccaggatcagcctgggacagtgttacctagtcatgacatacacaaacatcgcgtgcacacacacgcgcgcgcacacgagcgcacacacaggagcacaatcactgcttctatgttcaaagcctcaggactgacttagaatgcgaagtcttttgccagtataactttggcaaaaaaaaaaaaaaaagggcggggggagagaaattgtttggtttccttttcttattctcctctcccccgccttccagaaaagccaaaagcccgtgaatgcggtgcataagcgacccacaagctctcgtgcgtctgtcggtgagagtgcaccgccgactgcgtcctgctgacagtgtgaccccagagcgccaaggccggccggccacatgcagcctactggcggcgcatcagatcagcagtaacgacgtccacctgaaggtggttgggggaagaggggagcgctaagggatcctgccctgcctggccgcccaggttcctgggctccctaaacggctccgcccctcacccagcctggcaccagggcacgtactcgggcgaacccagcgcgctgccccaagccctggatccctccctccctcccaaccctcctcagcttcctcgaaaaagcggagaagcggaatctgcacgcccagaaactcgcgtcagaagccttagtagtccgactgggcatgctcgggacttggggcgcttcgcatggaggcactctccagcggctaacatctgtccgactgggccagatgtgagtctgaagtaggaggcttggatgcacgctagagcaggctctggttccgggaggggtggcggcgacgcccacagcagtcttctttccggcttcccacagagagcaagaccgtgggagataccaagtgccgagccaggggagctgcacaaactggagaaataggagtctagcggattcccaggcctcctgccccgcggtgccaccccagccgtaggcaggtagggggcgcgcagagcagctagggagcaccgcgtgtgctcccaagggactgctgacctctaggtaaagaaaagagagcgtgaagagtcgaacattctttgggcgaaggacgtttactgatttttttttttttaagtaaagaaagaagggcgtgtgtgaatgcgtatatgtgcacgcacgttttaaattttcctccgcaagaacagggacaggagagcgagaagctattgccgagttgggaacccgctagaggttacaataaggcaggcttggagtcgtggctggtgctagttaccgggaagagttcctcttggcgcggtgggcgaacaccaaagcttccaactgttcccttccctgggtggcggcagctgcccaaggtcggcttccgggctggtctctgtgctcctgagcagggggaccagattcagtttcagaaagagaggtagtacagagtgacgccagggggagttctctgaaccgtgtgttcccattttcccagcttttgatataggtatttgcaaagagggagcattgtaagaccatcacaccaccaaggggaggaaatacaaagagctgaacactctagggggaagaatca

SEQ ID NO: 6004 - DNA, 3651 bp, artificial
  synthetic oligonucleotide
acgaagtggcaggctctggaccagccacatggtgttcgggcatcctggctgacttcccttcccttgaaaccagctctctcccctttgctagtactgtcccaatggctgggacccaggagggtctgagtggttgtctattggccaggggtctccccacagcctctggggggagcaccaagtgtgcagatccaggagccctaccttcctctggaacactctctgcacccagtcttcttcttccctgaaggcaccaccctggactatttgcctgtggtggtattgtgcaagtgtcatgccttgccaatgacaccagatggtaggctccctgaggataggctggtatggtgtatcattcgtatcttacattcgtatcttttgctccctctgttacctgcctgacaggagtttctgtggaaaaagcctacccacttcttactgtggtggtggctcacttcgtgttcaggtcttgaatagagaaatcaccggccagctacctggaggcaggaggtgccagccccaaccactgcacctttctgagaagccaggcagtgttcccagagccacagcagggccaaaaagcaagagcagagaaaggaggtggcctgcgatgagaggcaggcagagctggctgggcccctcggaggctcctgggctgcatgccatcctcctgttctggagggtttggaaccacttagggccctgtgcccttgccccaggaaactcactgccctgccttctccttctttctgctcccacctccctgtgactccagccatggtcctggcgttagtccacctggtcttggccttccccttgtgtggtgccaggcaggcagcaatgacagccagatcataggactgtggcagctggaggtgggagctggcagccccaggagacattgacacagaggacaggcagcctgggatggggctgctggggcgtggttggggaccaggctaggggcggacatgggcactagtgccaagtattggcaggtgagggcaaaaggactcccctttcctgagctgcagggaggggtcgggtcaggtgctgtgcttcctcctttggtgcctagcggcagggagactaaagtgaagcatgtccgtgcctgggacagaaaggaaggctggagccaggatgtaagagaaccaagtctctgggggtgggatggaggctatggggagggcatcctgtgcaggggaggagaccagccaggaccttggggttagggaggagaagaccagcccagcccggctgggcccggccctgcctgggggaggctgcctctgctcacacatgcaggccgaaaggagcaacagctgggctccatgccgccaccccctccgcgcactcctgcctatgcaacaagtgtcacgtctgcatgttggcacatcatccccggtttcccgcgcccctggactggcgggaggctcccagccttcagggaccagaagacgttcaacatgggagcccagcccactcgactctggtcagttccttccatcgatccacgagggagcgggcatgtcccccgcctccacctctaccacgcggggtgcagggcgtgggacacgcggcgcacacctgtggtcctgagctcctgggactgcgagcgacggttaggagggacaaggtgacgggcaggtgatgccaaaggccgagttgagccccgcaaaagaagcagtccttgtggccagccgccccatggctcggggcgctctgtcaatctgctgcctggcgctggccggcgcgtggctgctactgcacggctcgcgccgggctccccgggaggcggggagagtgcgaatagggcggagggaaaggagcacgccggctgcagcccgggcgagcgggagggcgcgcactcacctccacacaccgcggtcaaggagagccagagcagcaggagcgcctgcacgcagagccgcagattcatgctgctccttgggccgccgcggccccggcgagccggcgcgggggaggagaggtcgggcgcccggaggccaagaaaggcgcgagccgcggctggcgcgtgcgggcgcagagctcgggaggctccccggccgctgagtgtgcgcgctgagccccgccgctcccgctggccgcctccgctcttctgcagcctcctctcccgccgcggggcagcgccgcgaagctggcctcggcggctccgggagcggcagcggcgagctctttcttagcggctggctgctcggccgcggctgcaactgcccgtgaccccggctgccagagagaatgctccccgctcactccaggggctgcattttgtagcttgtggcttggccgcgagcccacttggtcatgtggtcatcgggagggctagagggggggcaggaagagggagagggagcgagcctcccgcaccgcccccctccaggcacgcactctgcagccccagcccgagcgtgagcgcgagagggaaccccgaggtggccccacaacaaaggctgcgcggcctctctgacaacctacaaccgctccccggacaatgcccgcctggccgggggccagagggtttgcagagacctgaaggatttcaaacacaggaagcatttggggcggtggaggggcacacttaaccctttctcaccttgcttccttaacagctgtcaggaaacctgggcgcttagggaaggactcagtctgggttgccttcactcacgccctctacctctgaccctggtccttgcccttgccgctggccagcttcaagggtttggtcaagacaaccaaacactggccctcctctctcctctgcattttcaactggctttgaattgggggtgactgcctaggcttgtgcccaaggcttgattaattgcccaggcccctcatgttccctgcatcccccaggaggcaccctctacctggaatgcccccaccccacccttccgtgagcaattcattctttgcagcagcacctcaaatcccatcgcatccagaagccttctcaggataacactaatccagcaggggccgcccatcagctcctccccactgttgggacatgggacagctcctatggtctaccctttcttgttccctggagctgtcctcattctagttccccatcaacgtaagaggcaggtggtttacccaactccacacagtcaaggctggattcattttgcgtgtacttgcgattccgctttagaagcgggtcctgaagttgtttgcctttccagactcgattgttagctgcttctatagcttgggagctcccaaggcatggggctgcttccctcattggactgggaaccccctaaggtaggatactgtcttctcactcttctggatctctccaaagtccccaatatcttgctctgcacataggtggcactcaacacatattaaaagactgaatcgaaaggtgtctccacctttcagcaagccaggcagtttgcttgaagtgttaagtccagatttacacaaaagatacattggacagggtgcgtgtgtgccataaaagacatgagagaccatggcatatttaaaatatctttgaaatgttgcaaaaatcctatatatacacaatgtatttattatcagtctctctccaccagaagggttacctccacaagggagggatctttgctttgttcacagctgtgtccccagacctagaacagt

SEQ ID NO: 6005 - DNA, 2384 bp, artificial
  synthetic oligonucleotide
gcggccgcgccccgcggccccctcccttccgcggccccgtctccgccctccgcgctccgccctcccccccgcggctcctgcccgccagcccggccggcctccggttcccgggtcgctcctcctgcggcagccgccgctccccgacccacccttcccgggccggcggctcgcgttcccgcgcggtctccccacacacgcactcccgccgccccgctccgctcgctcgctcgccgaggccctgcagcggcccggcccagcgcagcgcgcagcccgcagcccgtcctcggggagcctcggcgccccgtggccgcaggcacctcgcggacaggcgggctggcggcccgggagcgcgaacccgagccgggctgggtgtccctcgcccagcctggccctcggaagcctcgcggggcgcaggggcccgtcggaaatgtttgggggacgggccggccgcggttcctcccgcagcccaggccgggccggcgcgtcccggggagtcgccgcgaccttatctccgaggatgacttgatccggagcctcctcccggctcccgccccaaacctgtgccaccaacgcgcgaagcgcagctgagactcgcggctggcgggaggagggcgggggactgtcctgaaaatgcccaagccgtgagggatcctaagccgaccgtcagacccggagaggcgaggtctagtgacacgtccctgccacccagggaaagagggcgagcccacgccaagcgccacggatccctgcctctccgcccagggttctccccactacgcattgcagagcccttggatagacctcgccggacccagagtgagggacgtggctcaagtcgacagaacacccagccacccacccacatgccaatagacacttttaaaaagtctgatcgggtcgggctcggtggctcacgcctgtactcccaacactttgggaggtcgaggtgggcgggtcacgggaggtcaggagttcgagaccaccctgaccaacatggcgaaaccccatctctactaaaaatacaaaaattagccgggcgtggtggtgggcgcctgtagtcccagctactcgggaggctgaggcatgagaatcgcttgaacccaggaggtgtaggttccagtgagccaaaatcgcgccactgcactccagcctgggcaacagagtgagactctgtctcaaaaaaaaaaaaaaaaaaaaagaataaaaagtcttcgatgatgcccaagttgaccgtgtttcctcgcccgaacctcttctcccaagccctcactcagtcttacctacttacccaccagactggaagctctttgaaggggttcctgtttgttgcagtggctcactcaatggatcccttgtgattggtggacaagtggatgtatttgttaactgctcgcctttgggatctgtgtcattgtgtgacttaaggttgtaaactcgggagggccaggaccgggtggggattactagctcgtgccaggcacagcatgatacccaaagggatgggccatcaatgctttttgagactgatgtaactaattatgcaggaggcagatgcctacctcttggtccccagaactgccagttccagggctaagtctgagtgaggaagaaacgaaggagctgtcttagctcatccctaatgggaggccgactcgctgggactagatatggctgcagtcaccacacgaacacaccgggtgacgtgactttctagtactaggaatactttgcagggagccagaaactcgactttaactccagtttgcaactggagctgggaggcagaaagtagccaggtttttctcagtgtgaagcaaactgtcccgtgtaaggatcaaacctgtagttcttcatccattaccccaaggtcgacctgaagcccgatctgtcagaagagggaggctgcaaacaaactggacctgaggtcaacagcacttaccccaggggccggggggtggggggtggacagtggaagcactccttcctcccatttacggatgcaagattcaccctgtactttgcagctcatttgtaacctggtcgctttagagttggtccagctccctgcccacctcacacctccacccccagccagacgggtcctctctgtccttcctcagccctacactgtcttcgcccaagtcagcctgctctaaatggacaaggtcagtgatccaagcagaaactgaaatagtaacaatcggacagtgtcaagagactccggcagagatgcctcggagcgcccggcctcctcctctgccttggcacagatgttcttattgtcctggaaagaaataccaaattccctccccaagcgtgaagcgaggatactctgggacttagcctccaaggacagagtcgccttcccagcccagttcccctgc

SEQ ID NO: 6006 - DNA, 5332 bp, artificial
  synthetic oligonucleotide
catcggagctgagagatggaacctctgggcctagcagaagcgaggtggagtggggaggaggaggaggaagacattaatctggcagggcttccttctagtccaaatgaccctctgacttcctcagcatggataaatatctaacaaataatatcaatatatctgcacataaagacttttttcgaattcctgctattcatttcaaattccgtttacaaagcactgaatcctccaggaactgctgggcacctcccctaataccctctaggctgaggcgatgcctttgaagtccctgtcatgggctcagggctggagctgctaagaaacaccctaagactgagagcaaatcggccggcagcttcagctccttcgcaagctgctagctgctagctgctctcctcggagtcaatgtaaagtcatgagagttcgaatgtggaccgcaagcttctcagcccttcagtcccagggatggcctgggatgtaaacacacacgacggtttattcctttggccaggcagagagtcgttagggtaaagggtaagggtcaagggagctcggattggtgactgaggagcccaaggaaagccggcagaagccgagtcctctagagctgggcttttggctctgaatcgtgcaggcttcccactttacacagacctttcatccccttcctccttcttcctcactcgggtctctcgccaccgacccctacccccccgcctccatccccagatgcctccacgcccaggtggtgttacccactgagggtggcccagggggtttgcagccgggggaggttgccaccaagggtgggccgccctggagacgagaggcaaggcggcgagccctggcattttcctttccccagcacctgtcccacttcggcgccggggctggggctgcgcccgcgggcggcctcggagcttgagcgccagaaccacgcactgaggtcgcccagggtggggaagtggggggccgggggaggggcggggcatccggcggggaggtctcccccaccgcatgcaagaccctttgcccccccacaacatacactgaggctaaaacggggatgagagtcacacagagcaggagcgaaatctttcgctctccgacccgaacggcgcgttgctcgaccccccccttcctggagccaggggctggccgaggaaggtggctccgttcttcccccgtggccagtgcggggtctgcggctgcccggcgaggttccggcttccccgggactggcagggggagccccgagaactgcaggcccgcccccccttcctcctcctccttcccctcctcccccacgtgtcctccctgagcccagcagcctgatcccagcaccccccgccacctccctcctcccgcttcgcccgcttccccggcggcgtggagaagagcaaagttgcgacagcggccgggggctctgcccaggtaaagggggcgccgtgaggcgggggtggtgggggaacggtgcggccctgcggcgggggcggggggaggataaagaaacttgcttcccgcggcccccaccccgcgtgggttccgatcttgcgtggaacgagcccgcgtggcgagtcgcggcaacactgccgggaccgaggccggcacctggacccggacccggaccgcgcgcttgggccggctcggcgggcgcaggcagcgggccaggccagcacccaggcaagggcggggtgggtggccgtacaccggaccgaatcggggactccggtggcgtgggcgcgggccgaaccccgaccgggccgagttgggtggcgaagtaggacgtggattcgggggcggggcgcggcgggagggggaaaccaggcctggccagactggcctgggcgtgggggcggggggcgagttcggggcacttgctgggctctggaccgagcggtagggcggggcggcgctaggggctgggccggacccgcagggagagggcgaggggagggagagccgggggtggagtaggggcgtggagttgtgagcggggtctggcctcggccgggggcgaaggtagatcggcggggccgcgagcggagggagggaggcccgcggcggcgcggcggcagcgaaggccagcttccgcggagtttgtgcccgggcttcccgggctctggccgcctcacgcgcacaaatggggctaggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccgggg

SEQ ID NO: 6007 - DNA, 2192 bp, artificial
  synthetic oligonucleotide
gctgggtgagggtggtagcatggagcctgcttcatggtcccccccacccctgcccccaacaagagatcccaggctctgaatccagccccaaaaacaaccagatgcaaggtagcctcttcctcacaccagctggctgggataggaagtcctccctgataatcttcactgaactccagagagctccccctacgctgctcctgtactggatgcactgaatctgaattaatggttgagaaagcactttataaccaggaaaacccagtgtaactaactgcaaggaaggactggcattcttgctgggcatatgtgttccccgggcattttcagtgccaaagtctccccaaagggaagagctagaactgttcccttcacccacctccaacctggcactcgggccaggggtcagctggcagggggtgagtccccaatgggcgtgcccaccagctgttggggctgagcagtggtggttcaggccctggggtggtgacctcacttccgctcctacctccccacctccccagcactcctcccatttgaggccccaccaggccaaaatcgagaagtccaaggttaactgttctttcccactttaagagctaattaaaataattagccacaatgaactgtcaaacattaaccagaagaggctgcaggaccagacaggcctctatcacaggccgagggatgaggggcaggaatcaaatggccatcaaatccctcagctggggtatggtgcggggcgggggcggcccaggaggacctcgctgagccgaggtgccaaggggtcaggaggtgactctggtcaggaaggtgatgtgcaggcatacggtggtgagaaaagggagtcagggttagggtgcggtggaggagccaggaattcataaagcggtcaccgcctcagcagtccctcaagcctccaaagcaaggcgctggcgtgaggggaccccgcacggtgcggctgctgaatcccctaggcggcggcccaggagggaacccggaggcgggagagtcggggagagcgggaacgcgggagcgggaaggctggcggctggctcacacggaaactccggcccctgccaagaggtctctattttggcgatccagttctccacatcataggtctgcgtgcgcgtgtgtgcgtgtgaccctaaagccctggccccagaagccccgggggcagtcggatccatctagcagctccgccgcggtccgccccacctcctctgccctcgggcgcccagcttctgggggcccgctgtcatgatcggccccgtcacggaacccaggctgccgggggcgagggaaaacaggggcccctaccccgactccccgactcggggaatccattccacttccatcccgggatcgggagcccgggttctccatcacacgcgcggcggggcgactccagggcggctcgcgacactccgcgactctcccgcccttccctgggcccccagccccacgccggggccccggcgctctcgattccgccctcaagcaaacttttccacgtcccccaaggctcgaagaaccggcgccatcgacgtacctgaggccgagtggctcacgggcccagctcggtcgccgggccggggtctgtctccgtggtccccgctccgggggccgagacgcgggtccccagccccgccagcccgtcctctcccctcggaagccgggccgggcgagcggcgccaggaactcggcgccggcgaaaggagaagtggaagttgagcgcggcgcccggtcggtccccgcggccgccggggccgccgtcccccgccctcctccccgcccgcccttcttccccgcccgcctgcccccgccaccccgcgcccgtgactcacctcggcgccggggcaggctggtccgggcgggcgaggcgcagggctctcccacacttcgcgccgccaatggcaagttggagggagagatgcaaataccaggtgagacggcggcgcccctgataaaacggggcggggggcggggtggagcgcgcggggagcggggcggacgccggggagggccgggccaagacacggggcggcaggggcgcccggggagggggcgcgaaccggcgcagacatgcaccgaaacgagcgagcgaaaggggaaatgcagtagagacacacacgtccccgcaggcggcggatggggcgggcgcgaaggaggcagggcgggagggagggaag

SEQ ID NO: 6008 - DNA, 1477 bp, artificial
  synthetic oligonucleotide
aaccatcatatctttctctatcattccatctacccctcaacgtaggtggctgctagaaactggatggtcttaggcactattatttctagagtgaaagtgagggcaaagcaaaacaggagtcatagggcaatcttagccaggaaatagtcatgcttttattttctggggcacaatggcacatatttaggagactgggttggggctgggtcagcaattggggtggagggaagtctggacagtgagcagaaagtttgaaactttcctgtgtggagtattacatctgaaaccttggtctcattaacactgcgaggagaaactgcagagtgagaattggacttaaggtccagttcttccggggctgcattaggctgatcaaacatcttcctaaaagaagagggactatttcaagagtgtcagacaagccagtaatgaggaaaattggcagtttagtcagttggctccactccctgaacaccatggttgagacactctgggctacatgagaacgaaaaaaagtgcagaagggaattaactaaccttttcttaaacatttactgtatctgttaaccacttggctggtggtttctatggtttacctcctttagtcatctgagcaattctaggcaggtgttaacatctccattttacagttgaggaaactgaggctcagagaggtgaagtatccttcccaagatcacacagcaagtaagtgctcgagctgggataccaacacaaagctgtctcattccgaagcctgtggtctttctctgccctccccacatggaaaaaacaaaagccctgattttcaagggctttactctcatggggaaaccatgatctctctccccacaaaaatccacattttggtgccctgctcctccagattcttatatttagggtgaaatcaaacaaatctctgtttatattggacagtaatgggagttagtaaagcattttcacctttacaattccccatataatcttcatgttatgggaacacattttctgaactccaaagagagagagagacttatgacagcgattttaagctccaaggaagtgtgtgtgtgtttgtgtgtgtgtgtgtgtgtgtgtgtgtctgcgtgtctgtgtgtccatcccatggtggtggcatattgatagggattctgatagcccctcttattgccccaattatatgggtggggggcattagagaaggatagctttcaattattctaatagcccctggcccaggactgcatctttggagacatagcctggagcttttggcttcttcagagttgaagtttgtcttccattgcacaggcaggaacactgagctggagtgaaccagatggtctttatgaaccaaagtggaacttacacaacaggatttagatgggtagtctagcgatgtgtttatgcatttgtgcgtatgtgtgtgtgctggtgttgagaagcaggggcagaacctctgaggaagagaggcctcaca

SEQ ID NO: 6009 - DNA, 2683 bp, artificial
  synthetic oligonucleotide
agttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaag

SEQ ID NO: 6010 - DNA, 2571 bp, artificial
  synthetic oligonucleotide
cgaacctggcggagctctcatcctccgagcggtacgggtccggcaccggggagctgaacgcctgcaggcggaggagctggcattctgtgccggggcacacgtattggaggacgatcacggcaaataggaagagcatcaccaaagctagcagcagcttgttggatttctcatccatgttcccgacgctgggggaaacccaagctcgttacgtcaatcccgcagctcagcccgcgctcgtcgtgcccccgcaccgcccccttcccctggagccgctgctgcgcccctctccccctcccctccgcaccgagtactccacggcggcggcggctgcggcggcggctcccttccccgcttccttccttcccggcaggctcagcgctgtggcttctgcggcacacacacacccccaccccgactccttcccgcgggccgttcgccccctccccccgccagagctctccggagctccccggagcccctccacggggtttagccccagtgggacccctccgggcccagtcgccccactcctcaactcacgcccccagtccgggcccccgcgtgtctcgctccactctcggtggctcccgctcccatccccatcccgcttcgtccgccggactctccgggctcttctgcccctatcctctttggagcgcacacctctgtccgggtttctccccgcatgccccgaagccctccttttgccggcgcccgcgcccgcttgcccacccggtaggcggcctcgagggagctcggagccgggggctcagagttaccctgggggaatgagccggccggcagcccgacttgctatcggagacgctgcgctgccggtgcccgcggaacagtagcgacggagccgcggcgtgggcaaatgcgcgccgcacccctccggagaccctagccgggccaccaatggccagctggaactttacgcccttctctaccccccgcggctgccttccctccccgtacagcaccttcgcgccctggcctgggagcgcgaaccccgctttcacctagaacgtacctggccatggggccgaaaatcttggagaagatcgcaccgagcacgtgcttcagcgagtggcccagggcggccaggccccgagtgagcagggcccggcagagggagcccaggtcccagcgtcgcctgaggacgtgcatccgcctgcggcggccccgggacagcagcgcgaaaagcggggcgcacgcggctcccgccagggaagaagacgcctttcggggcttgtccaggagcggccgggtgtggaatccgtgagacacacccctaggagggcccgcgcgaactgaggcggcgaccgacccgggccggctcgctgccaattcggcctctactctggaatgccggcggggacaggtggtgcggacgggcgctcctcgctccggttgccgcggcggctcgaactcccggactgcacacgcaggcagtgccattccccccttcaggcaactcagggtactaaggatcacgagcgagcttgaatttatataataatgcctcacgcctaagagctcgagccacttcacaagcagagaacctgggttttctcttttcttggagtacggaggtcactccgcttagcgcatcactccactttggctcgtaatttcaacctctcctaaaatagcaaaggcgcaaattggagcttttccgtctctctttgccaatttccattctccagcggaagcgggggcattttctgaaaaggtaagtcagcatgataaaaagacagcaggaccaaaaagcattacagaatgagaatctgaccttttttagagcacagactgtcttcttgctgaatcctgtgtaccaaaccctgtgcctgcaggagggcttgactcataaaaggtttgttgaatgaatggatacataactaaaaactccatcagagtgagaccgtctaatccaaggtaatgtgacacatgaggaaactgaggcccagagaggggtagggatgtgcccaaggtcacacagcagagccccagggtttgaacccaagaaacccagcaccatccacctatttcctgatactaacaccaccttctctaataaataggcacagatcttcctcaagctccagtgtccgaaaggctcttttctgctgctggaccaggaatgcagggtttaacagggaaagaatggatgttccttcaggaaaaggaccctgggaactcaggagtcagtctgtccccatctgattgatcaaaggggcttgctgtacatcaggacactggtgtttccgtgactgagtgtgcaactccctccagtcccactgctacagaaggggcaccggttggcagcagtgtttctgagcagtgctgttggcactggggccactgagtgggagaatgcagaccacgagctgagtcctggggtgggggcatgtccctcctggagacaggctctcccagtatctcccttgctgagctctgctccatccgtttcctgttctatctatgccatgaagcggcaagcctaagaatagtccagaagtcctgggaaatctgtccctgggcagcactgggataatcacttgcccctcc

SEQ ID NO: 6011 - DNA, 1991 bp, artificial
  synthetic oligonucleotide
atacgcaaaatatccctcaggtgatttctggggatgatgacaatcaaagggaacacctagcacagagtctctgagcacccttcaagcttcctttttcctgagatgctggctggggaagatgccctgccacagcgaaagactgcacagagcaaagttggggaaactggggagggcagtttcacaaccccactcgctgaatgcctgcagtcaatatcaaaggcacatattgtttgcatgagcagaagatgaaaccttgtcacattcccattaagtgcagagctgcatctaccccttcaaaatgtgggaatgacaactgtaaccttcacgccaatcatctccgctgtgcccaggcctaaactgtgcagggcacaaagaccccaggtttgacctgcagagtccccaagcttcagcggctggtggttcacttcattttttttctggcggggcaggaggaagggaaagaaagagggcttttcagggctctacaaccaataaaatcgtgccgctttgaggacatacttgagctccccaaaagacaggcagctgaagggcaaacagtgtctaatcagtagtgagcatgttatttggtaactgccaaggtgcagtgggcgcctgggctgctccaacaatttcttcgcttctatttctagacagacgccagttacactccaaaagtgcccagcaacttccctcaattacctttgtaattaatatgtaattgatgactgcacttaatctccaaggttattaatagcccttccaaaaaatgacccccaaatcttcctaagcctttggaagcgcctggttgaaattacagtatttcctttgctggctgccggccccctgcccgccccacccggagaccagcacggcaaggcaaaggcgcgctccactcacttccatgaaaggttcggagtggaggctcagccccccccccgggctcgaatctctcactcctccgttagattacgctggccaccagccagctagattcgtggtgctttctgagcccccagggcgaacgggctacctgcgcggccggcggggctgcgcgcaacagttggccgctgctaagaagacagtgcgacccggaggggacccggccggacaccgccgccagcttcgctgggagggacgcagggcacccgccgaacgctgcctccccagcgctccgagaggggctttcacaaatacccccatacaccccccatcccaccccaccggcgccaaaatccggtgaactttctcacaggctaagccgtctctatttgcataaccatctccaaactgagattcaggtttcctgtaatcagtcctttcaaaggtctgtaattgaaagtgcaattaacccttaaaatgaggtaagaaaaaagaaagaggggaaaaatactcctctggtctgataccttccggaaagtaggagagttcccaaaagtcagggtttggaggggtggagagtgggggtagtcgtttgctttttaaaggcgacttctgaagcggttgcggctactaaaactcctaatccttgtcagcggtgcaagagaggcggggagagagttttaaaagaacatcaatgaaacatcaattcaagttccacgttttgcgacccccagaatctagcaagctccgggacgtttccctccaccacaccccactggcgacccccacccccacccggcctctcctcacccatacaacaaagcggggcgtcctataaggagttcaacccggaaaaggagaagtagccggtgacacgcactttgagggccacagtcctcaggggcttcccgggacggcgaataatgcaggggggagaggaggagcggaggcggggagcggagcgcgacagtcgcactgggcaacccggcggcgcccctccgctcgcagtgctgggaaggggggagcgctgcgcccgcggggaacgtcctgcgcccgggctgcctggctctctcgctcgctcgctcctgccctctcgactgcccatttctccc

SEQ ID NO: 6012 - DNA, 1160 bp, artificial
  synthetic oligonucleotide
cctcctcacctggcacgggagtttctggcacccacttgagtccgggctgcagtctctggaagaaggagcggacttggtgacaggtggcgtccggcggcggcggcgggggctgcgcctgtcccgggaagtccaagctgagcagcatcgccaccaccaagcacgcggtgcgcacggtcccggccatcctgcttcgcagggagctaggagagcgcgggagagtggcagccggagcgagagcagtcccaggactcggcaagcctggcagtggccctgaggagcaagagacgtgctgctacccagccgctgcaaaagtttcctcgcagctacctgggcgctgggcgagggcgggaaccgcttggcggcgcggggcagggcggggctgactggggtggggcggggcgaggagggacggggcggggcgaggcgagccgcgcggccagggggcggtggcggttgtgcggccggtagccggcggggtgcgggggcgcggcgtggagcgcggcgggggccactggggcaccgcggcgcggggaccgggcgaaggcagtgcgagaggagggtgcggagcccgcgcggtggctcccggcagccgagcccagctgcccgctcgcagccgctctacacagggcgctctggcataactactgcagaggggctgcaggctcgagcgcgctgattggcttcccagcagccgtccgctctgactggctctgggagaagttccccagcctcactcctccttcccgccgctcattggcctacagcctggagggcttttccctttaggatttttgtctccttttcatccttcctgggggcaggtgggggtccctgacttaggtccccctccgcttcgccacaggccttctttcagcttgtgccagctctttcctggccaccagagccacacaaggtgttccttcacacaaaatccacctcctcattctactctctgaggagcttcccgggaaccgttttcctaacgcagctctgaccgggttctcaaagccaacctgcaaatagtcgcgttcagggacagccagggaccgctgggcttttcacagcctgcctcacctttgaatattgtatcttaaaagtctgaaagcctctgtggcttgctagatttgattcagtagagccacacaaagtcagagaaagca

SEQ ID NO: 6013 - DNA, 2993 bp, artificial
  synthetic oligonucleotide
gggtcgcagcgtggagggggcgctggctgctgccgaagctcggagagcggcgtggcggaggcggagcggagccgagcgaggggccagcacggaacgctcccttggaggcgagcggcgcagccggcggagaggctcccggagccgccctagaaaaagccggctcggggggcgtggccacgcgctgtggcgctccccgccccccggtggccccgctcggctccggggcccgggggcggaaggggggaggggaggagaggagctgtagggaagggggttgtgcaggcgctcgacgccgcagccttggcccgctgcgggggagggccgagaagggcactgggcgcccagagtaaccaacaccgagacgaatagcgagggctcggggagaaaaaacggaggatggcaaacggcaaagccaagggcacgaggtagcgcagcgcgcacccagaggctcctgggacggacaccaccccacgctcacgggtcctctggcggtgtcctttgagctgccgggacggcgcaaggtggctgagcgaagctttttgctcggtgcttacagggagtacctgagatggtttgggaaaggaaacagggggtctcagaccgcttgggtgcagcgctctccccatgcgtttgagtgcagatctgtcgagacgccccagccctcgccaccccaccaagctctcaggtagagaggccccgggacagggtgagccccatagtcctttggtgggcataacacagagggaggagcaattgtttacacatgtgcccagtacaagaagggaaactgatatttaagactgaagtggggaaacgggagggaaaggagcccttatcctggatgttagacgctattaaggaccatgctattttgtatttgtgagaatgatattgaaggtaaggaggtccttatccttgaagatgcatgctgaagtgtacagaagtgaaatgtcacgatgtctgcagttttcaaatgatgcagctaacatacgcacacattatgagagagagaacagaaaggaagcaagtattgcaatatgttaacagttgttgcatcctgttgggggtggggggtaaacagacgttcgttgtaccgttctttcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtgcggggtggggacttcctggcggctctcagcaacccctggtccgaccagactcggtgggctcggctgcaccacggatgagcaaagaaaccggcgggccgcgggaactgagccgcgcgcctgcagccgtcgccacggcggcccgcggccttcccccgcattccccgagggaggccgtagttgtcgcggcctgcagacagcgcgcagggtagcccagaaccgcgtgcgggcgctgggggaaaaaaaattaggtgccgaaagaaagcagcaacgcacgcgcgcgcacacacacacgaaatcagtttacaaaaataaaaccgcggaatctgccgtgctcggcgcccgagtttgagctacttaactctcgcatgcattttactgtcatatttctgtagagctgatggaaaatctgaaatgtttttgcaagggcgatctcgcagacccaaggcgttgcaagcgttgcgcagcctttcgctggcgtctgcggctcttttccggggcgcgaggagggaaaagagtagtgtctttcagggtctgcaaagctgttttgaaaagttaaccaaaaaggttttaaatagcaagattttcttttcaggaaaagtttttaaaacggctgatactcgtccagttttggtgggcgctaaaaagtcttattactaagctacaagtttccctgttaagattttcaaaacccctcgtggacagggctgaaagtttgccgggctgtgagacgtgactgaacacgcttctaaatcctcagatagatcatttataaagctctggtgcccttgggatgaaaggcttcgctgagtttttaagacttgccttcgtgggtaaatttgcttgggttgctacacgtaagcattcatttccccacctaaattagtaaaagggcagaagattccaacgacgtaagataaaagttgggtttatggcatgttctctaaagacaaattgcaacagctttctttattaaactccttttgctacctcagcaaattggagagccagttgaatattgatgaattctttgagggtgagtaatattgctacaggccggagaaagtaagggaggacaagcttaagcatttactcaagtgaacaaccttcaaatgtttttcaactatgatgtctcaaggattttcttaggacctttgaagcaaaccctgattctgcaaatggcttcttatttggtaggcccttcccaacctgacaaaactcacaggatataaattgccctaagaagtggtgagaaacttaccctagcattggaaacaggcacagcccaccacctggggtgttaggggggcctccaactggtagtcaggcaacttctcacggggcaactaggaacctgaaatgaaaattgcacaccatctattgttttttttggtcccttctgaaatattgtttcaaggcagctgttttcaggaaaatagcacatattttcctttctctttttgttccgtgaaacgttcggaaattatattgataaggaataatcatagtccgccgagggagcaatagctttgaaggctctgaaggcacagctgagaaaaataaattagctctagactagagat

SEQ ID NO: 6014 - DNA, 2181 bp, artificial
  synthetic oligonucleotide
ctgcctctctctccattgatctctaacactctactgcttgtctcacctgtctctcaagctatctctttagtgtgtgcactctctcgttggtttctctgtccttcactttcctgtcaccccaggactctggctaaacacttgctttgtatctttgagtgtgtgcgcatctctatttctctacatctttttcccatggcccctcaccttggtttttctctggctggatctctgtctctttggatctctgtctccctgtggactttattttgccgtggaaaccacctgccgccccggccaccgcgggctttggttaaaaaacccttagtttatcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctccctctttctccccctctctctgccaggtactgtgttaaactgtttacacagagaataccgctgaatctttaccccagccttgtgagataagtaccgctattatcttcattttatagagacagaagcagaagccaagaaagattaccctacttgcctaagttcaagtaaatattgcacacgttctattagccaagacattctggtctctcctaaacacatactgggtatttgttgtatatcaggactgaggaggccccctcttccctgcccccagaaggtagggaaggtgacccagaccagggatcatttgcattagatttccaagggattaggaggtgttttctaggcagggcacaaggggaaatgtgttctgt

SEQ ID NO: 6015 - DNA, 1530 bp, artificial
  synthetic oligonucleotide
ccagttacatcatatcattatgcccaggcagagggagcaagaggaaagaataagagtctgtatccccaggattttgatatatgctggggcagaggggcaggaaaagatattaaagtcatcctggaggagctctctctggaattgtggtggtttcccatccacgagatttccagaaacagagctgttttagcatcctggcacttgtttccttcctctcaggcctcctgcaggacctgggaaatggtccctttctcctaaaaggcacaagatgggttgcacagaatgatctgaaggctgtgtaacattcaccctagactggattccctgcatagggatggagtggagaggagtgctgaggatgacaggggcagcttttcattctggtatagaaatctttcagagggatgctttgtggtttaaggctgggccatgtcgctgttgccatgttaggtactgactggctgcccacctggacagattgtaatctccgtaagtacagagaccgagtcagttcagcaccatacatcaaggccagtgcttggctcacagaaaataaatgtttattgaatgaaaactgtgttctcttgctcagaaaggctggggaacctatggggagggaatggtttgcaggaatactctcagagtacatacattattcttccccaaaactgggggtggggagggcattaaattccatgatccattggttatctcagtgccaacttagacaaaaatctttcctcaaatcttccttctctcttcagcttttctaccaaatcttccttctctcctcagcttttctgccagacaaagacaatttatggccactattgtttttcctcagtttgggttacaaggttttttttttttttttttttttgtcaattttcttcttcctacagaaacttgattgcagctgggtatagcatttatgtaaatttcaagtgccactcctgtttgtctctgggttaacctaatggtttatgttaatctcaatcaggtctgccactcagacctcttatccccttcacctttcacctaattgccaattttccttgaggaccaggctatagaagccctgtctatctcttcttccccttgcttcattcatttcttctctgctgtatattccatctgattgttccctggagcagtgagtggatgatttcatgtgttcctgacacatgataactacatgcaaccgccatgaaactgtgcttcccaaatggtctatgtacacggtcacatggcaataacagggacagatctcccaaacacaatgttgagtgaaagaagcctgacacaaaaaaggagcatcttacaagatgccatttctatgaagtccaaaaccaggcaaaattaatctgattaacctgcgggcagtgtaggggggcaggggaggcagtgagtgggaaggggaagtgaaggtgcctctggagtattggtcatgttctgtttcttgatctgggtgctggttacaagaatgtgttcaatttttgaaaattcatcaaactgaacacttatcatttg

SEQ ID NO: 6016 - DNA, 6698 bp, artificial
  synthetic oligonucleotide
tcagtgggccagtgctaaaatctttgcgaaggagatacaggcacccgcgaacgcgcgcgggcgcgcacacacacacaaacacacacacaaatacgcacacgcacagccaatctatatggcctagtgccttccctcaggctgtctttttctactctctttttgcctggatccacgtgttgggggaggggaccagagacaaagttccgcagtgctttcctccccctgcaactcaagcgaggaggtcgggacttctcctcccctccccctcccaggaatggccctaagcatatctcctccagctaaatcctccttcctcacccaagtctgattgatgctaactaatgtcgagttagttcctttaaagaagttatcttgctaccaagtgtgagccagtccataccggaggtggaggacggggggcgggggcccgggggcggggggcggggagagggggacgaggacggaaggtgaggaaatggagctgggagtggcacctcacaccaaacaaaaacgacgatcgttacattgtatttaatttctaattaatcctcaagagaaatatagccgttttccttaccaatggatccctgttcttactgtgggtatctcgcgcgcgcgaacggtccccaccttcccggagcctcgcagctctaaggagagcaaggagtccccagataactatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggccttagagggtatggagctcgcggcatcccgcttagtttgaagttgcagccttcgcaccccaagacttcccccttccccagggatcagctgcaaccccaatccaggcggcccgctccccctgccgcagcgccccctacggtctggaggtgggccctgaaaggttccgacgggcgcggggagcccaggggtgggggccggggaggccgagggaagctggtgtgctccggtccccgtctgagaagcggtcacccgctggggcttggcttctgaaagtgcgatttaggtagctgggagtggagatttacgatcctggaggacagagcgtgaaagggttatcatcatcagttttgactgaaagaaagaaaacatatctttaacaaaaagaagggctcttgccattcacccgcgttgttaggacaacgtgaactatccttgaaatgattagttccacttcaaaggaatttacattcaacagtgaaaactcagcctctttttatttattcgaaaagacttttcactacggagaaaagtctttcctgctatttatttttccgcgttcacggtgcacttgtattaaatcaacagagaccgcgcaacgcactcagtatgcggaccagtccagggttccggggacgcaggggtacaggtagagcgggggagggggttgttggggttggggtttgcaccacgcaggcacctgcctggcccaggggatggggtgggaagcagtggatcaggtctggggccgtggggggaatgcaaccgaagaaacctcacccaagcccagcccaagtgcagtaatcagagattttgaatgctcgcgattctcatagagcctggcactctctacgtcatttgtggagaaagtggacctgaagttccccagcgacaccttaggaacatctgttaaaaactgatcaggttggcgtaacttcgctgggcaaaattaaagcctatctccacaaattgagaagacaaatcccacctcttagtagcttgggacgtttgctcacacacactctctcagggcccacacctccgcgccccaccccccaccctcaggtcgccaattgtcgccaaatccaggaaacctctacccaaaggaacaacagcactaagtttacgagcggcgcgtcctcccggggcgggggagggggcgggggagggggtggggagttggggaatgctacccctctaactgtccccggagtgccttgagctgtggctggaatacttcccacctcctccggaaacgagcagcagcaaccaactctcagcttcacctcacacacccacccgcccaaccccattcccacctcccgcagcaaaatcttttcttcaacccagggctaagtttttctcaccaaggacaatgatgttaagctttcccttgatggtcttttccagcttctaattaaataggaaaaaaaaatctgggttggacattggattcaagtttttctaccattccttaacatatctggatttgtacctggcaactggccccatatcttgaaatattgtcaacatgaatcgtaacagttgtcctttctaacacagtttttggacggctcctcagtaggttcagaagcagtgaccacaggctgcttggctgggagttaaaggtggccgctgtttgccacctggtaacaaaggtgtaagttggagcagtgactggggcaagcccttattctcctgtgtttcaggttgaataagaactcaggttttgttcaccattctggagctactctcatgttccttcttcctcctggatcttcctgggcttatttcaccttcttggtctgaaggtttcctttgtttcttctcttgctcaaacctaatcctgaggcatcccctgctccctctctatctctatcccctgctccctccctatcatctcctgttccctctctatctccctccctatctctctaaatctctctgggacatttcctgtccttcatgaggaatcaaactacagttacacttg

SEQ ID NO: 6017 - DNA, 2127 bp, artificial
  synthetic oligonucleotide
aaagaaagtgtcatttaccaggaaaaaaggcgaataatggtgagtttcaaggacatgttgcaatgagaaacactttgtgctccactagggagagacaggggcaccaaattcagcgtcctggaataattcccttcctggattcaaagattcatttattgaaataaatcaggaagccttggcagaacggaaatccgcttgctgggtttaaagggcctttaaaatgttgcgagtgttagattgcaagtcttttctaaatacaaaacagaagaaaagaccgcagcgtttcccttgaacttaaagaaaattactaggtcaccgaatcaggataatttcatgtccaccacataaaatgtgtttagaaagaaatgctgcatgataacacaatgtgctgtgtatgttctgtttttcggaggttcgacggaagagaaaagtgctgtggagttgggctctgggttgtaggaagaacccggtcctaccctactgcccctcaggacgttctgtttccctactgcttcttcaagatggattctaaaaatcgggctcaaaagctttgctggtttagaagtgatcagtttttctgattttatttactgctttagatttgggcataaaaataaatctttttcctatttaccgtttgaactcagtgtgagggaaaggatcccattatatttcctatccatacaaacatgtggatatttagacccgaccacatacaacttggggacacataaaagagatttattggttaatttacgttgcctactacacatgtaaaccctagtaagccaaagctgctgagggagcctcagctatagaaccacgacccctgggttcgagttgtcctccctgactagagctgtgactcctgtctccacctgaaaaacgaaaacacgagagttgtctccatcccctcacctctgcctgtgtgtaggaaaaacttttctcctcttagctttccctcttctgccaccactctgttctcagactcagctccccaaagcgccctgttccccgaagttgttcccagagtctcctcttgaaaatcaagtttggggaggagagaagctctaagtcataagaaaaacttcgcgatttttcccccccaacagcagtgatttgctttgttgggggtggggactttgttttcatgtgcagtaactagctttatctggagggattttgctttctaccctcttttaagggtcaggggtccccctccccaaataaggaaactcccactcaaaccaactgaaaccgacttagaaatggcctgcctctgacctgctgttcacaaagcccccagcctcgtccttttgcgcgcatctgggacccctgcgtcccacagaacaacgacaccccctcagaaccgcactctcaggatgggcccggctgtcccgtgaagggctccattgcccgggattttggcctggctgaatcgcctcaggtctgcccccttaacaagcatccacccccccggcccccacctccccacttctcggttgatgatctaattgaattatgcctttttgttccagggactacagagcacgtgctggaggcaattaattatcggaatgtggccgtatcaaaacggacactgggcaccgggtaggtcagcggcggcaacttccccctgccttgagctcaagaccccttcccaaataggggcatgatgagctccctcggctgccccccttctgagcccttcacccagttgcaatcgcgcaaggccctcgattctcggggtacctggcgggactccccggaaactctcgcatcagcgctggcccggccagagctcgacagccgccccttcccggtcccctagtctcgagaaccgctgtccgcgggaccagctcagtgaggaaatccaaactttttcaaaccaactacttagccaagggcggttggggttggtgggaggtgaagagaggtagagggaagagaggaaataaaggagaaagtgaaaagaaaggtggggcgggggggggggggggaagaaaggcaatcctccttttttgtaaacctgactccaggggattcatttgcatgatttaagcatatttgttctctgaacacaccagcgcccccctacccccccaaagaaaccctctgctgagaggc

SEQ ID NO: 6018 - DNA, 4342 bp, artificial
  synthetic oligonucleotide
tgggcagcggcgagtacggccgctgctcacaaactaaagggtcaacgcttggcgcagacggaagtaacggagatcagctctaattgtaatcgtttcttctcctttgggtctcggacagctgccgacaggttgggggcacaaacggcgaactatcccggcctgggtcccggcctcgaggccatcagaactcgcagtgattggaggtggacgcagcggctggaccgggagcgcgaaactgctgcgctctccccaggatctgcgccctgcagctacagaggggacatgttctcaaggtggtgaggcagcgggggcccaagcaggactggacgttgagcgccgcgtctcctccatcggcgcagcagtgggaccgatcctcgcggggcaaagagcccgcgaggggtgggggaaagcccgcgagagtcccggcggcgtcccgccgtttgccggctggagcctggccccagttccccgcagccactcaagcccggtggagcccactcgcggccgcccggcagccgccgcctcacctgccaggcacccggcggctgcccaatcagcgggggtcgctcggccgcggctgccatgttctccgctccgcgctgccaatcagcctcgcggcggccaatgggcagtccggccggaggtcaggtgaccgcgggccagctggctccccattggcgcgcgcctcgcggcctcccgctcggtttatgtgcgaggagtgagtgattgactttatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttcta

SEQ ID NO: 6019 - DNA, 5386 bp, artificial
  synthetic oligonucleotide
cacttagaaacaaggataaaggccttgagctgaagactttgacaactttccgcgggggagggctggtgctgccctagaatctcccgggaaagaaagctctgagagatggggagaggcgagaaggaggagaggagaacaaggaatagagaaaggagtgggagtgaagggggcctgagggctcaggaaggaactggggcccccatgaacaaaagctgggactccctgcgctgcaacctcacttctgcagtggggactcggcgtgggtcgctgcggtccagtgtgcttggggccctcagggctagtccagcccactccagcgtctgctccgtggccattcggacacttgcacctaaggcacctgctgttccccactgctcttccatattccctctctgtgcctctccgcaccccggtctccaaggctgctgtctccagtttacattctggagctaatcccggtcctgagaaaggcaacggctagaaccggcaaagggtgggggggcgtcccctgcctttgccttagttctccccagcctgagcaccgctttgctgcgcctccccaacccgccgatgggaggccctgggcagaggcgcgcactccagggggaccagtggtcgggtgccccgggcgcggtggctgaaccccagcaaacagaggaagaggactgccccctcccgcggaggcccactcacgctgggcactagtgacaaggggacatcagcctttgttctcctggggcttggcgaggctgcgctgccaaagcgcagcgcgggcggcgccagggcaccagggttgctcacctttgcacgcggcgtgtcgaagggtgcaaactcctgccttcccggagggttggggtggataaggagtttaggattaggaggtgtcgggtggcggggggggggaaggaggtggtgggaaaggaggggggaggggttctgcgtctcgaccaggctctttgtttgcattgggggcggggagagggggctgaaggtgggttcaagcttgggttctgacagcagggcagattcctgagtatgtcaccatgttgcacgcgcgcagcacacatatgcacactcgcgcacacgcacacacatgcactcatacagacaggcggccggctgtcagcagacagcgcggttcccggcgctccaggctgcagcagcttcgtctgcccgcagcgccaccaccgtgcgtccagaggggaagtggaggaggctggaggcactcgagggtcgacaattccgcgaggaaggagggaaagtggtgcaaacctagatccaccccctagcgacctctgcccccccttttctcccggggtcgcagaggtcatgggcagcttaggctccgggaaggaggcaaggagccgccggagggcggcgcgcacgcgagggggcgagggaaacgaaggaaaggaaagcaggcggactcggcgggcgggcttacccttagaagcatctttctcctctttgggcttggtcacctttccactcatagatcccagcttgcttgacaaggttcgctcagaagacggaagtcctcgccgagcgggtcggacttgggagagtgcttagggcggcaagtctcgaccacgagctcccctcggtgtggttcggggcggaatccgcttttccccaccgctgccgccgccgccgctgcctacgagagagtggggaggaaaggaaaggggtgaaggaggagccgccgtcgccgccgccgccgccgcgatcccgagcggccggccgcgggaggagccgctcgccgcgctcaagaagtgaagagacaaagcggcgcggcgcttcctccgcgccccgcgccctcagcttctgcccgcctgcggagagccacgctcgcaacccccggggcggccgagaggagcggccgggactccccggcttcactgccggcctccctgggctccgcgcgggccgctcgctgggagttgcctgggtgggctgcccgcgcactggcaggctgctttcccccgcctctcccaatccgctgcgggccgccaactcgatcaaaataaaaccccgaggaaggctttttaaaaaatcaaaacaaagataaaaatattcacttaaaaataacaagcctccctgaaagggaaatgtttgaacatgtgatgagcaacgtgtgagcctgttacaccgcagagtcgcgcagcttctcgcccgcggggaatggggaggagagggtcgcctcttttctttctttctatttaatccatttccaggttcctattattttgccaaaaagggggccggagttgctcgccggcggaggagtgggagacgatggcccttacctgctctctttctctctctccctacacccacaccccctcggagctcgcccgctccctcgctcgcgctctccttccaaagaactctccggtcctagagagccacgaatcaacaccgcggcgcattctatataaacggcaaggtgtgggcacgcggagggtgggggctggcgaaggcggggcctcacaaagccgcctgcccgctgtagtaaaaggagagctcggcaggggcgcgccgacgtcagccgccggttggcaaaaccccggcgagccccgcgtagtgcgggcgagcgtgtctgctgggcgtaccctggcccctccggggcagggagggcccgcgggtgccactgtagcgggctcccaccgttggccaaggagatggaaggccggcgctccccccaccccggcccctgtaactcctctactcctagcgcctgctttcccaggcccgtgctggtcgccacctacactttggggactcccctgttggcaactgctcgcaccgagcagtggaatctcagtccgggagtcgacgacttttcgcttctggctagctgctcaagttgagacagtccggctctcagtggggagagaagggctctctgggatctgggtgtcagtaggtcagagagtgaaactgaccgcggcggctgccacctcccacccccacccccacacgcaggcccctcctcctagggctggtcgctcttgttggtaaactggaagcaaagagtgcccaccgcccaggatggccaatcccaggcaaacgggtgaggtgggactgggggcgagtgctgaagaggaataagtaggattgaaacgttgcctgaggaatacttgtgacaaaacccagagaaggtccctgaagattagaactagaaggaaaactgctcaagaattgttctacagagggcagatgaggaaggaaagagagagagagagagagagagaaagagagagagagaaagagagaaagaaagaaagaaaggaagagagagagagaaagaaagaaagaaagaaagaaagaaagaaagaaagaaagaaagaaagaaaagagagaaggagggagggagggaaagaagagagaaagaaagaaagaaaaagaaagaaagaaagaaagaaagaaagagaaataaagaaaaagaaagagaaagaaggaaaagaaaaagggagagaaaaggaaggaagggagggagggaagggaagggaagggaagggaagggaagaaaatgaacgaactagggaaggagggtgagatagtagtcaggaaatagcccctggggcgtcctggaaaaccttttctgcgatggccttttttttgtgcatgcgagtccctggtagcctcgcgctctgttgagggactggggtggtgactagcaggacttggtcctcagaacagtccattaatcagaccttaggcttcatcctggccatgaaggcgcggtagcgactcccatgcagaaaattcgttttccctcgtcctactcagctccacccccttcttaattcggttttgttaatggcattaaaccaggcgaagaaatcatatagatggattagtcttactgcatcccaggcggtaactcaattacaagagcctgctgtggctttcaagaccaggagtgtgggctgcccctgctcccagtccaggtctaaaggtcggcaaccctctaaactcaatttgcagcctccatcctcagtctgagaggaactccaggcccatttttcttgtaaataatatctaataatctgaggcttgatgacacgatgtgattatccaagccaatgttagaccattagttcatatcagttgtctgggaaggaaaacatttctcttcaaatgatcgaattcaaaagggttggaggtttagatgggtttagaggaaaggtcgaggggaaggggagtcctaccccaaatctcagcattatgcagtatacccatgtgatgaacctgcacatgcacttcctgaatctaaaataaaagtcaacattttttaaataataacaatttataccccaaaacagtaaacatcaatttagcacctaacctgtgccaagcagcatgctaaatgcttttacatcattatcttattccatcttcacaacaaccccaaggacgtgttggttttgttattttcgtttcacaaatgaggaaaatgaagctcagagaggtaaagtaacttgccaggaggtcacacagctggtacatggtgcagcatggatcacaaagatgggcagcaggctaggatgccaggtgggtctgtctctaaaaccagtgatcatctgttataccacgtggtctctcaaaactcctagcagcctcttaaagagaggtgggaggcacattttcactggtcctgtctgccaattctaaactcctaggtcttttaaaacttccctagctcagcacattcaatcaaaagcatacacacacatactcctccgttgtgtacataccatttaatttgtccacatccctccagtaagcaacaataccttattttgggaaaagggtcagtttctgtcttggaagatatcaagcatggcattgatgtggacactgggtgtctcagctttcctgccacgttaagatttccaggaaagttctctccacagataagacccctctctaagccctatcaacaatgacacctctagcaagggtaacttccaactggaagctagatatcattctgttccttaaaggagactaatcttcaatatatgactaaacctaggttagttaatatgatcaaggtgagttgagatgtctgctttggaaaattagtggagtctgtctgtccatgaacacaaacaggtaaaatacagtgttttgcttcactgtaaaccaccttggaaaggaaatatcagaagataaaggaaatacacacttcatgcaagaacagtatggtggtttgtgtccatacagagacaaatcaatgacatcataaggacactcatgtcagagaccaaggattatgaatagtcaagtgcagggacaaacattcttatctaaaccaagcttctgaagattctgctaaagaggtcactggcagcttgttctgtgaaaggaatgggggact

SEQ ID NO: 6020 - DNA, 1018 bp, artificial
  synthetic oligonucleotide
tcaagtcttcccctaactccctaagtgaagccaatcattttctcttctggttgccccagggaagattctgcacacacatatgtcattagcttattactctgtagtataatttctgggcctgagcaatccacaaatggtcatttttgacgtgattgttcagaaagttatttaccacaatgaaaaactttgtaaacatattttaatatataaatagcttcgaagtatatggaaatccattttacatttaaaattgttgtactatagtgtgtactctaatcacatggctacaaatcccttccagggcaaatgctgaaaaggtacaaaagtattgcaagcccaggtaaaaacacagcacagcaactggtgtcatttaggtgttatgacacattgtaatgccacaggaatgggggcctgtcaacatgtaggagccttcaaaagtgtgaacagatgacacatcacacaactctagaaataagagaaatcactagcagcaaaaatatcaacttacatttcatagcataactaatttaacctttgtgattaagcatgcattcctccaaaggagttttttttttttttttttttttagctcccaagatgatgcagaaggtaaatgagaacaaaacgcaaagtactttccactgtactgcacggaatgtttcagcaagatttttttttgtagtctccaaaaactatttaaattgctcttaagaccggaactagtttgtgccccatcaccacattgcccttaatgatttattacatctagaaaataatatagaccagctcaaaacaaaacaagcaagaccaaagagttctgtgtgatgaagatgcacagaccacagccttgaattaattcctctggtctaactgaagatgtttgcatggcctcctttagatttgtggatagcactgaatagggaggtatatttggaacatgtgttgtggctatctgatttgtgggaaattgccaccaagtctattttttgaataccaaaacttccactgcaaggcttag

SEQ ID NO: 6021 - DNA, 1831 bp, artificial
  synthetic oligonucleotide
tttagaaatcaggtgcagttcatgagtagtgaattgagtgtgtctaattacattttatagtcatttaacagctgttaataatgtaattttgtgttatgcccaatttgcactgaattactttaatagcacacattgtatttattttccttttggtgaaacagtaatcaaacactagggactcaagttggacatggaaataaatgatttattatttttacaggtttgaagaacagggatttttaaaaagaaaagagtaaatcctattataaaactaagagtagttgaacacacccaaatgcatttgttttctcaggcattccttttcgtaaaaataataatactaataatttaatgagcacaatacatttgtttcctatccaagtctgtatcgtttgatgtgcaccaagtgtttgcaaatatacatttgactgacaagctaatgagatttcccctcccacccccaaatatccttctgaaatgaaaagtccagatttctaagtttttggtgtatgagtgaaagagacacagcattcatttaaatagactccgcaaaggaaactttccaaggtgaggctagagcagaaaagcagtgtaaagacaggagggaatacagctttaatagaagaaaaaggcaaacaaggtaagcaggtatttctcccacaagttagaagaaacttctacgtgagaccttaattagggtaaaaagaagggtcaatcctggacccccctgcccccaaaatggtgggataattggaatggtacattatgaaaggcctgctgtacatttcccattcactttaagcacttgaagacccaagcatctaatactgtgcccatatggaagtgttttctgcagcccacatggatcaatgccctttgtatttgaagcaagctacaagagtagaacagaaaggaattctctctagctgtgggacactggctgccatcactccatccaagacttgacttagcattttctgcctttgcccacttgcttcctagggcctatgtgggaagaactacaaatggatggccttccctccaggagagccagagttattttgcaatctgtcgatagtaggaggctaatttcatctccactatttctcaggccctagtgattggggcaatgttgtgtcaagtgggggagagtggtgggagagttccaccccaggtgcaggcaataaggaggagaggatggcactgcctgtggtgaatttaaaaacaataataaaactgactcaaagtctgtctgcttttcatgctcatcatgtgctagccatcctaaacaatgtcagtgataaaatccttcttcctgcggggttgcctgctcccactgctgctgttctcacgtgggtattccattgggttgtgggtgggggtggggctctgagccctcacactatgggagagttactggcccccaacccctccaggctgtacccctttcttgtaatggtgggcattattatgttattctgcaactagcatcaaagtcactctcctctaggcctcctgctggtcctgattagcagctgccacttctgtacccatgttctttagcctttgcagggctcttctcatcactgctgttgctcttgccagtgtgtgggtgggttctcttcctgccaatgtttgcagctctttattagcttcgtaaagggtgttgtggctcttttagttgacagagctttctgttgaaaaatttgggacaagttgccaagggctggcttgagggcatttaagtgacaccacccgatgtcttacttctgccaacaatcagccactgtccccagccaaagcacatggcctttggatctttcgtgcttca

SEQ ID NO: 6022 - DNA, 9805 bp, artificial
  synthetic oligonucleotide
aaactaaaggcccttcggggggcacagtggaatggccaagggtcagggactggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcagacttcactaccgagcccatggggcccaggctcatggcggctgcggccgcagctgcggccgcggcggtggcgggctgctgcccgtaggcggcggccgcggctgctgtggctgagggcgccatgcccccgtagcccgaggcggcggcggccgcggcagcgacgttcatgtagctctgagcgccgggcggcatcattgggctgtactgcaggccggccatgtcgtagcggtgcatcggcggcagcgcgggcggcggcggcgggctgctcatgctcgggggctgcgcgtagcccagctgctcctgcaccagcgagtacgcgccgttggcccagccgttcacgtgcgtgtacgtgtccaggcgctggcccacgcccaccggactgctggcggcagcggctgcggccgcggcagcggcggcggcggccgcggcaccgggaggcaggaggccgctgggcagggagtacttatctttcttgagcagcgtcttggtcttgcggcgcggtcggtacttgtagtccggatactccttcatgtgcacggcgcgaagtcgcttggcctcgtcgatgaatggtcgcttctcggcgtcggtcagcagtttccagtcggcgcccaagcgcttgctgatctcagaattgtgcatcttggggttctccagggccattttgcgccgctgcccgcgggaccataccatgaaggcgttcatgggccgtttcacacggtcctggtctgtacccccgccacctccgctcgcaccaccgctgctgccgccgcccgagttcgcgccgccggctgcgttcgcactactcttgcctgcgcctcccggggctgcggggccgccggtgcccgccgcttgtgtgggtgtccctacggggttcttgagttcagtctccagaaggctgtacattgccggggcgggaagaaggtgcgccagcgtggcgggaggagaaggcgctcccggggctggagcggccacggtgaaaaggccctgggactccgtcggagcggagcttgggggcctgtgggccagcgagtccggcgggaagggtaggcttatcaaaatgctccgcgccaaatcagcaggaacccgcgggcttctcgcacctgatgagttctctcgaacaggtcgcattcacagtctgcctgggctctagctgggccccttatatacctgctcggattccccggggttggggcttggtccgcccctcgcaacccggaggacccgtgattgacaggttcgcagtgatgcgccctggccaatcattaccgagcccccgttcggcctggctggaaaaaaaaaagttcggggagccctttcgttcaccccacgcccctctttggcctagtgacgtggtaagagttacttaggaggcgggagtccacgaggcccactcagaggccaccaattagggtttcaaaaagtttgaaagaacgaaacctgaggaggtgacggggggaggggggagggggcacgcaagcagattggggggagggggcagaggggcgccttcggaatttagaaaacaactttgcaaccctgtcaaggcagaccggcgccccatcccccggccagcccgcaaagcttcccgttgtctgcacggaggttttctggccgcttctgctgccagcgctaggaacgcagggcaccaccagctacccaggccggcttagggactccaggctcattggaagtgctcctggctgcgtctccaagaagctctccctggaattggccgctggttgtccagatctttctctaggagggccagtgcgtccaggacgcagcgtgggtcaggggcccgggcatgggagacaggcttcaggactgcggggtgcattcggctgtgaggctcttgggggtttgcaggagggcgggcaagcagtcagtcgcccgtctcctgagcctgtcggaggcgctcgcacaaggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagccaagcccagctcggggtctggcttttaggaagtgagaacaacttatcctggggactctcggagacgccttgattttcaacagacaaacaaaaccaaaaacaaacccgcaacagtttgcgtttcttaaagcagtcatttctatcttttcccttgagaacaccccttgtctgtttactctggcttctagccaagattgtgtatttaggccgctgatcgagagccttgatcaaaaaatcataggcttaggtctattgtagaaccatcccttgtaaaaaaaaaaaaaaaaaaaggtcagaaaggtcaccatcatttcaacggggtggtagagacagcaccttccagttcctggagcattcagtaggaaccccagccccactccgccaacgcgtagcaccgtctccagcggaagtactctttcttacaggtcacagaagcagctgaagaccctaggctggtgggtgtagattgtaataacttagtcgatggtctctaaagaaaggttgctaggagctgcgaggtatgggaaaacaaggtcctcgaggtaccataaagtctcctgcgggctgtacaactgtattctatcgtagtttggtgttgctcttttttgggagggtgcgggggtacttttaaaaaagtttccgcattcaattcacttggttggctgagctgtacttggaaaatacactgggagtcccctcggcccacacgttggcgctcagtttccttccacccacagagtattcaggtgttaatcaccagctctcttttccctatgtgcgcagcaactccaaggaatttgacaacctttgccttctgcttttactcgctgacctcaccacccgaaagttgccattttcccggaggaaggaaggctctgcccatgcactgggtcccatttccagcgggctttgctgagccatcgctgtcagcctctttgcctctcacccccctcctacacccgtctttgcccatccccacaactctcctcacgcgctcagctccgcagactgccaaacccccacccctgcggagcaactcggggaactcggccccctacgtccaggcctgccctcccactgggcctgttgccctttccacttccttttgtgactgcagaggcacagcgctcacctgtacagaggcgaggtgacctgcaggaagccggggccaataaagtaatcttaaaatcgttatcagtatgcaatgctgtttgagtttttccatgtctccacaattccattcgggtccaccaggcaaggcagcgcttctcgggaaagggtgcctggaaaatcagtggacctccaggcacttccagcgtgaccaagcaaagctatcgccccaaccacagggggcgcaggatggcagggggttgggtagagcatcctggagaaaattttaaattcgaaggcagcactcagcggttccttttccactcttttatttatttctttgtttttctttttatttatcattttcttttaagagagtggaaagccgtggaatttggtgcgcagaatttctatgttctcttttcatctcttcaacgccctcattttttttttttttttttcatttcactaacctttgtcatccacctgctatgtgctgagttgtgcaccaagtacgggacggagaccctgcactttcccattccgtatcagatagtggcaatggcttgggaaagtctcaagaggactccggattcggagagaaagaaattttcgcctgatgctaccccatccccctagttgatctacggagaaatcgggcctcgcgagaagcgcaacatcttggacaaggacctggcgtgagcggggtcgctacgccccgacctgcaggggccacgctcattccccagcgcgcgcgcgctttcccacggcggcgcagagtccagctagcggagaggcggagggggaagcgcccgcgtgcctggagccctggcggtccagcgtcccggcgttgccgtctgagtggcctaaaagggaggctctggggccgctgctcgcgacggagagcggggacgcggcccaggaacagctaacgtgccgcttgctgcttgccaggtatggaggatgcctatcctcaggcagacccgtttccccgcgggctggcggccagacggcgcgacaaaatgagatctgtcgagaggtctggccgtgatggctttttggcgtctaggccgctgtcatcccaattccatttctccgaaaagcatcgccgagttaggacgtcggggctttgctaatgtgatgtttgtgtaattaacaccatctccccttgtttctgaacatatttcctcccgcagcacagaccagctttcatttgaaaaagcaacgggaagaacgtcccaataaccctttctaatgggaaaaaactgccccttttgtggaatggtttctttacaaagccaacaaccaaccttattttctagttccaatggctatccctttatgagttatattattaaagaaatccgacactaattgtgccgatttaacttgttaattagttgcaaataaactattcattagtggtaaaataaaataaaacccatgtgtctagatatcattccacattcacatattgtagtgtctgcataacataggcatactaaattaagttcctaaaaggtttctcctcaggataaataattaaaatatattctactttaattgacattatagaggacataaatgagcttttccttttagaaagaaatagccatttctaaataaagcttgcagtctggagaatggaggcttcagccaaatgaatagtcattactaccttttcaac

SEQ ID NO: 6023 - DNA, 2291 bp, artificial
  synthetic oligonucleotide
tgcgtcccgggtccgggtccgggtcctcagctctgtggccgctcccactagctgattttgacagtggggggtgggagagggttcccgaaaggcaggggcgggcgcggcgagcccctgccagatccggggatgataacgtgcctgctccatgtcgcggcttctagctgtccaggctccgccccctgtgagtgtgtaagtgtgtgatgctgccgcggccgccgccgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggataccacggttttatcagctctgtagaaatacattgttacattaaaaaatgctgttatttgaaagtaaaaattactataaaattattgctcaattagatattatgcttctgcacacagcctttactctgcttcactaatttattttgcagacaa

SEQ ID NO: 6024 - DNA, 3918 bp, artificial
  synthetic oligonucleotide
cgcgctggcccgcccggcagttcccaaggaacctatgttcctgcagaagccgcaggtgtccgtcttgggataactgcggagggagccaatccagcccagcttgggcgggagcatcgcgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttgg

SEQ ID NO: 6025 - DNA, 1319 bp, artificial
  synthetic oligonucleotide
aaaggatgagtgtggactagtcaagtggctggatgctaattttatcacctttgctttcagaaaccagatcccattctggcagcaatggttcacatccctggctccttactgtctttaggtaatcataatattaatgtcccagtgcacccttaagccctttgcatctctcttcaaagcctttttcagacatgcaatacttatctggggtgaggggttgaacttcccactgagagaccagaactgatcagatgggcgggcctccaatcgcgagcttggctttaggcttgtagtcctcacttttctcaagtccagccacggcagcctgccaggcctgcctgccacaggcagccttattcaattgaatggggtcttaacaaggggaaaagccagagacatgaactggcgcatggagcacaatgatgctgactacccagcaaaggtaagcttgagacactctgaagcaccacactgactgtaaccacattgcataaaacccaacacaatccaagagaaatggaatcctcgtggggatagcattgggccaatagctcaacagccacccaaagtctccatggaacaactcaaggccagagcaaatttagtgacatgccttccctgttggagcacctgtatagcagccccgcagaagaggttgtctagtcccttccaggactcatgggagcccacgactctatagccattcttctccgccagattccacatcttcatagctttaagttttttcctttgccactccctatcttatttcctttctccattgtgtgttagcatacttaacagatggagaacagcatatacaagtggcttacaggactgtcaaggtagcagaggcacatttgaaaacagctcatgcaaccaaatgccaatgattgagcaaaccaccactcaggactgactcccccgcgttggccctgaaaatctagctactcagtgcttccatttgcagacataaacatccacttaggagttctgaaaacaccatctaagccaacatttggactcaagtaacaccaacagggctgcataatcagtaaactcacttttctgctctgtgcctttgcaacactctctgggaaagatgcagtagactcttacagataaaagttgacatggaggcaagttactaatatatagaaatgttggattttaagtaaagtatatttcactctgcagataaagggaacagagattctttttttcttatctcaaaacagactctttttgtagaattgatgaaatggaagtaattgtcaagaactgagagcattaatcaagaaaaagatgaaaaaaaaatggag

SEQ ID NO: 6026 - DNA, 5923 bp, artificial
  synthetic oligonucleotide
accgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatct

SEQ ID NO: 6027 - DNA, 2458 bp, artificial
  synthetic oligonucleotide
tcccagtggaaatggaaacactccacttccccttgccgctggaggggaaatccagagggtcttcaacattgcactctactgcctttggggttgtgggagtctgactccacagattttgcctctgtaatctagccccatagagggaaagcagcttcatcccctggattccttctgacactcaccaggcagacctggggttccagggaggggtctgggatcctcagtggagttggatgatgaaacagggcaattcagctttcggggcctatggctgtcggcctcccaatagtccctggggcttgcaagcccttcttctgtccctcagggtgcccacacacatccccgatttctcatgagcttctcagcctccctgcaggccaggtgacaaacacagttgtcctcatggcccaaatcgccagctactgaagatctccgtgcccacctggccctggacgcgcaggagcccttgccctcgtagagggacttggccctttctctgagccttcccagtagtgctttttagagagttctttattctctgttacctgaagatattgagaattgcctgagttcaggagcgaccctgccctcagccatagtggtcttgacctgcttcatattccacgcccaggattttccttctccaagcctcacctgatctcccaattggaacgaggggaaggaccctgggtagcagacatccccagaacctgggccaccgcaggattgcacataggtgagtgagaggtgctcaaccagctccccatcggggtaaaaagaaatagcagtggcaaagggggcgggggagggtaccctgccgctttgggtgggaaatcctctttggaggcagatgtcaatctccaggtgtcacagcagccccgctatctccagcccatcctcccgccccttcatctctcctgtctgcctgtgtgatggctttctgttctgtggtcaccttgccccatccccctatgttctcacctcctgctcgttcatctctctgacttggcatgagggtgacactgcctggtgctctgtctttccaggtgacagaacacagagcaagacgtcgacttcaacgcagaagcattctggacgacaactccccggggccgatccacaaggtggcaaggaggggcaggcggcgaggtcgtctgtgctccagagaggtgcccagggcttggggcagagttcggctgcggggccgcagggccccaaaggcgcggagaagcggtacctgtgccagcagtgtgggaaggccttcagccgcagctccaacctcatcaagcaccgcatcatccacagtggcgagaagccttacgcgtgccccgagtgcggcaagctgtttcgccgcagcttcgcgctcctggagcaccagcgcatccacagcggcgagaagccctacgcctgccccgagtgcagcaagaccttcacgcgcagctccaacctcatcaagcaccaggtcatccacagcggcgagcggcccttcgcctgcggcgactgcggcaaactgttccgccgcagcttcgcgctcctggagcacgcgcgcgtgcacagcggcgagcggccctacgcgtgcccagagtgcggcaaggccttcagccgcagctccaacctcatcgagcaccagcgcacgcaccgcggcgagaagccctacgcctgcggccagtgcgccaaggccttcaagggcgtctcgcagctcatccaccaccagcgcagccacagcggcgagcggcccttcgcgtgccgcgagtgcggcaaggccttccgtggccgttcgggcctcagccagcaccggcgcgtgcacagcggtgagaagccctacgagtgcagcgactgcggcaaggccttcggccggcgcgccaacctattcaagcaccaggcagtgcacggcgccaggcgccctgcgaaggcggagacggcgcggaggctagcgggccctgggagcaccggccctgggagcgcggtggcggccaccagccccccgcggccgagcacagccgccaggccttccaggcccagccgccgctgactccccgccagcgcacccagggcgcggccggtctgcgtggggggccttcctggggacgtcgaggctcagcccccttcaggtgggaagaccgccctcccagggcctcgattgcggccacagccctgacctctttggccatcagaagaccccaggcagagcctcaccctgaggctgagaaacgcaggaaggactcagaaccgaggactgccgcctgccctggctcctccatcaacggcagtgcgggctgggaatggaggccctctactccctcctgagtcctgggccttgcaactgaggcacatagatggcacctgggccactcgtccctgagccacaggtactatcgagtgtgcacaggcgtgcgtggaggggatgcgtgaaccatccctcggatttgcatcagaatcgcctgctgcgggtagggag

SEQ ID NO: 6028 - DNA, 2134 bp, artificial
  synthetic oligonucleotide
gactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtg

SEQ ID NO: 6029 - DNA, 1144 bp, artificial
  synthetic oligonucleotide
cccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctg

SEQ ID NO: 6030 - DNA, 1169 bp, artificial
  synthetic oligonucleotide
gactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggc

SEQ ID NO: 6031 - DNA, 911 bp, artificial
  synthetic oligonucleotide
aaagaaaatcaaattggaggtggcaactcctggtccctcgctctgcccctcaggcacccaatatagcaaacccttgggagccctgccattacacagcccctcaggcagagaccggcccagcgcacctggcgctccttagggctcatccttggatgtcccccatgtctccatgggccgcctcccccaaccccgtccctttcagaacttacacgaccaggatcctgccactcactgtgagatccttcccaaccaccctttggtggggctcggcatctggtgccagggacccatgggcgatttccgcctccaagggggtcgggaaaggcacgctgagggtgctgggggtcattcggttaaggtgccatctgatacgatcttgcctatgtctcaggccttcttgctcctctgaagccccctctcaggtcaccctgcctagtgtcacccccttcactccttacctcgcccaggccaccgttagcagagcttctccctccatttcaatgtcttcccctcctccgaccacctctgaccgtatacgccagccccggtccccccctgctaccctttccgtcggccccccgcccgccctcctttccttctccccgagtccagccctcgctccgccgcaagcagcccccagctcggaaaggatacaatatgtgcggccgcattcgtgaccccctggccgcagacgcggcgtctctgcccggacctggcgcgtgcgctgggggagctccaccggccggagctgcggctgtgtccacgcccccgcggcagctgtggccaccccggccatccccgccgtcagcgcctccgcctgcgtctgcatccgcgtcccgcatgaccgccgccgcgccgctccgactccacccccgaagcgcaggtcctacgccccgccctctctgtggctc

SEQ ID NO: 6032 - DNA, 746 bp, artificial
  synthetic oligonucleotide
aacagattgtgaactagacatttgccaacttttcccccgtgccagaccatttttaagttatgtgtgcacagaatggcatttaaaggacttaaataactctccagggggagaaaagagcagaaaatagcccacaaggctcctataaacgggggcaggaacagcagaaacagaatttggggcgagtgttctgcttgtttttagttgcggcgggaggggcttttctattaggttgtgtttttgttgtttttgctttgggggtgaaaaaaggggacagagaacagaaaggaacctagtttatagtgacagctgtttaggaaagtcatttctagattagaggggagagcccctaggggctgcttctagattccactccttggggttggaggggccgggtgagcaggctttggggagtgcctgggtgactaccccaaccctgcctcaacggcaccccctccctgtgcaccgacaaataaatggtggctgtaaaaaaaaaaagaaataaatgtttttttaagcagtgcttcctgttatgttcaaggaagactagggccgttttattattaagcaattttctctttttaagtaaacacacacacgaccacattgctgcaaggctaaaatctcttgccttactcaagcatcgacgttttcaatctcctattttctcaagccctcaatgaagccttccaagagcttgcctatgtttaatttgcattccgaaacagaaaatctaatgtgttttaaca

SEQ ID NO: 6033 - DNA, 995 bp, artificial
  synthetic oligonucleotide
agattggtgattggttgtacctggaaaacaagggcaacataggtttatgcaggggtttctgcaccttggcactattgatattttgggccagattattctttattgtaggggactgtattgtgcgttgtataatgttttgtaacatccctggcctccatccactaagcaacagagaagctctctcctcccagtgactacgaaaaatgtctccaaacattgccaaatgtccccctggaaagcaaaatcgcccttggttgagaaccactggtctagtcaaatgacagtttttcaaccttagttccacattaaaatcacctgggaagctttttcaacacactaatgctttcccctcatcccctacccactagaataaaatctctgagggtaagaccacagctactttctaaaataattctaaagtgcagcttgagagagctgttgatataggtagtttttaaatttaaatttgaaaaacccagattaacatgcctccacaaataccacaccttttattaaattttaaacattttgaagtaaaacttctaaatgtccctctcttcatagtgaacataatgtaaatattcccttgtaattcagaacgacaatgatgaacatttgaaaatatattaatattcaatatatagaaactgttgttaggcattattacaatggcccaagactatgattcattgctggttttccatttttaaaaaaatatttctagctagtccaacaaattatggcatttaagggccatttcttgttgctatcaatgtttctataattattattttcttcccttactttctctcagcaatctttattcactacaactcccactctaatttggggttttaattagctgtagactgacctaaataataaccaacatggctttcaggaagatggtaagaatgtcttctgcaaagtgatataatatttagtacatgggaagcttctcaactcattctgagagtcttttataaggcaagcat

SEQ ID NO: 6034 - DNA, 20776 bp, artificial
  synthetic oligonucleotide
tttaagacccccttcattcagacacactcacttttgggtatacacataaacacatgctcatggacttttttttctcctaaagcaagttgggctaacctattataatttgtttttctctcacatcagccccttttgtcactctagtaagatcacatttaaaaggatactaaaaagagaactacaggtgctttggctcttgatactacaaatcaaaaacaacgttagccccagttgggtggggggtgattagtacctgaaaaaaaatgggaaactgttccgagccaatttcagcatggactttagtttaagtctgagtttcaagtcccaaggaggcccaaagtttctcaacagtcactctccctaattattccacttacctccccacacacctaagatgcccgccctgactactgtccacagttcgggccatgggtagttggtgatggaaggacacctctgataatattatgccaaatgcgccctttttgccttccaggacctcctccagatctggctaacctgtctgaaaatgtagcaaattaacttactcctttccctcaaccctcccacagaggcctgtcccaggcttcaattacccctcaccccaagatgctgtgggggtggccctgggaaagcaggtgttgggccattctgccttgggtgtgataggacacagccatgccctgaactgggccctcgcaaactccctggggctctgcatgtcctccatggtggaagaggtttgcttaaggttggggggggggggtcagccgctcccagcattgtgaccaagttcccagatattggggccaaattgggttgccattcattaataatgctcacaataagattaaatcattctggaaaatctcataaaatccccctaagtacgctccagtggctctttccaatccccatcattcagcacttggggaggtttggaaggagaagaaaattggtttctttgcttttaatgctgctttgaaaagatactcagagtttttcatgcgtgacatgtcacatgtttaatgtggacttgctggaagtcagggggtctttagcgtgtgatatttatggggaatattaagtgcagaatgaggtccctccagctggggaaagttgaaagaataggaggcccaggactgggcttgtttgcagcatcagaatgacataggattaagagtttgtaaaacaaggcgaggggttctcattggccagtaataaatgtaatccttggaggtaatttcacgcaatttgcttctgttccatggaagggtcaaatgagaaaaaatgacttaaaaaagagttcattaacaggaagaatggtactgtttctcgtataccatccaactagcagcctagaggggggaaaagaagccctactaaacaaaaaggcaaaatcgacgcaaaattgatatcgaccacaacacacacacacacacacagacacacacacacacacacacacccaactcctttccctcagtcttctccagcagtcccgtctcctccccaaactctccagcggccctgaccaccccaggaaagcggctttcactcagggagagcctgtggatgtggagtctgagggttttagactctcagacctccagtaaggccctagaaagttcccaccgggcctactaaacccgggaacggagtgtgtggtaggaatggtagttggcggccgctccccataccccaggccggggcccttcttgcgagtgccgcccccgtgagtccagggctagcgttgggtggcggtgatccacccgacgacccaagtgccagaagcggccaccagccggcgagccggttccgtgagctctccaacgtttcgggcgggcggggtctccgggcgtctggacccggggttggagaggaggggattgaagttgggggtgaaggggggtgcaggataggaggcgagcccgggacgtgcgggctccagcgccgaagctgccgggcgggctgcccacacccaggtgggcacagcgcctggcaggccgctgacctctgcccaaccctgcaccctcccctcggccgcgcacacttgcgccctgggccgcgaggggacccggcccccctcctccagggcgcgcgcggagcccgacggccccagcccagagaggcacccgcgccccccgcggcgaccgactggccggcggcggcggcggcgtggcggggctgccggccccagctccgcaatcgcggtagtcacgccgcggcacccccgcacccctcccgcctgcccctctccccaaaggtccggcgcgctaattacagcaaattgaaactaattaagcttctcttccctttcccatcaccctgggagcgtcggcgagacccagcccccgcgggcgggcttccaccaagcggtcacccggaggggcgcgggcagggcccgggggagggagaagctgcggtccccgccgcgaggagggaggcgtgcgccgaggtggttaaggattgcaaatctgtttgggtctcctcacgaaatctgagttgtttagatttttttaaatgtatacatttaccaatgcctggataagtgatgtaatgacatttgtcgagttaagatctgccatttggatacccctcgctgcctttccatcactactgctcccgcatgtttctctctctctccctccctctctctctctctcacacacacacgcacacacaacacaatacacacacacactccctcctccctgcgaacatgccgtggagcccgccccctcggaagggagcgcctgggcttctcgctctcgccattacctgtcatctcggactgcgcacttcacttcctggctacgtggcactttccaacagctcccttcgccttccgagccaagactcccgcttgcttcaaatttctgactccaccgtcaacaacgcccaccatccacccacccatcctggaacccaccccacctccgtggcccgggacccccagctcccgctgtgacacgacccgggagagcccaggtgcgcgtggaaagtaccgcggcggcgtccttaaccttcgtaggaaatccggttccctttgaggatcggattcaaaccaggggcctctgccaggaaaacgcgtgtgcagataatcccaggagatgcctggacgctggagcccacccttgactcccggggggtgggggtgggggcttctactgtcccctcagcgcctgtatggagcattcacacttcgttttgttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttttttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaaaaaaaaagaaagaaagaaagaaagaaaagaaaggctaagtggggtgtcaggaggaagaggttgggctttttaaattttttacttcaatatcaggcgtctgggggagaaaacctccccgatattttcaggaaagtaagaacaagagagagtggatgttggagttggagcgaggttggcagtagcaggggcaggggcaggggcgggtggacagccagccgaggaggtgccacgtcccggagcgccgagggctgccatgcccgcatccagactgctgtgaaggcggctgcgctctctcagtgccgtctcgggagtgtgctggtcctctgtttccatttggtcttgagtggtgctgagtgaggtgacctttcggggcgcgcgcggggcgcgggtgtggagggcagcctttagcacacctccttgcccgtgctggtgcccggcaggatgttgagctgcgtgagctgcgccgcgtgctccttggccttgagcctcagcgcggctatgctagaggcgcgtctgtctgcggccgccgtggccgggtcggccagggcgcccgatgccactgcgccctccacggcgggtgtgggctgtctcaggagcgcggccgcggtcgacgcgctggtcaggggggccattgtggaaaagagcctgcagggagagcaaacagcgcggtcatggcctcgggagctgtgcgcggcgcctcgggcagcgtctcccgccgcttgtcgccggggcagctgaggggcgcggtacccacgggacccggatgggccgcggcggggaagtgggcagagggcgcgggcggaagctggaccccgcagagagggctttcctggggcagggaaccgactggggggaaaagaccgagtccagatattccccgaggggccgggccgggccggggtccacaggccggcgtggagacctcaagccccacggcccagtggcgtggattcggtggtttcgcttaaacggacggtttattccaaggccaggggctgcaatgacactatctcccaggagagaatgcggaaggagaaaaggagaggagagcaaaagaagggaaggtggagggtgggaggggggaggaaaaaaaagacggagaaggtgggattccagctgcccggacgcacgccgcaggctctgagatctccctccggctccttggcccgggactttctgcgccctgaagaaacaggcctagctcgccggcctcccgggccacccgcgccgccgcggccgcccttccgcgcgggactcagctacccgcgtctggccagcgcctgcgggtgagagtgaagggcgaccgcctgttgatttcggctccacgggcgggtgtcacctgccagcagccccacatcctggcgcggcgaccccagctgtcttccccgcgcccctgtagcctctggcctcagggagcccccgacccacgaccctggcgcgcggcgcaaggcgatgcccaagcctgggacccacgccagcgccaccgcctccaagcggcgaccgaattactccacgtgacgcttccaccccatgcacacagcaccgggacattagctgtggccggagccgcccggggccaccggacaccacccccacgcccaccgccttggagcgcccgcgagctttcccgaccgcctccctgaggggtctggctccaggcccgcggggccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataat

SEQ ID NO: 6035 - DNA, 2319 bp, artificial
  synthetic oligonucleotide
ttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacgtttttagacaaacatgtaaaaactctccactgtgctaggcactgaggactctgtagttaacaagatgcctcctgccctcaatgagcttgttggtagacagctggagagtgaggagattgaattattgagttaaaaagttaactcca

SEQ ID NO: 6036 - DNA, 1261 bp, artificial
  synthetic oligonucleotide
ctcccttcagttgctgggtttctgaatttctgtatagttaacccttatcttgcctcccatttgttcaatagaaatgatcacttttacttgaatcttttggtagaattgtataccatgtgttcctgtctaggtttaatcatcagattgtggtcaaattgctctgccagactgtgtgaacaaaaaagtgaatggaaattttcgttttaaaaaataatacttttggacttagcccgtggctaagaagaagtaaggaagccaagcgtacggatagcagcgaggggtcaatccacgcccggcgttgggtcgggggtggaggagtcggaagtggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgac

SEQ ID NO: 6037 - DNA, 4711 bp, artificial
  synthetic oligonucleotide
tgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaa

SEQ ID NO: 6038 - DNA, 834 bp, artificial
  synthetic oligonucleotide
ggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagcctt

SEQ ID NO: 6039 - DNA, 1528 bp, artificial
  synthetic oligonucleotide
ggaaggagattcttcccagagaaaagaccagaagccccgccccgtcccccgggtcccccgtgcgcggctgtggtcatggcgggctcagcgatgtgtggcggctttgtggaacggcattcctggccaacgggcctcagctctgcctcgggaccccaccattcagcccccgcatgaaaggccgctgcccgggcccgcagctcccactctcccccaccccaaggacgcacccattcacctcctctccccaccgcaactccctttcccccactttccccaaacgggaggcgctagccatggaacatggcacatccagggctacctcctcccaagttacccagaggtcatgtgtacaagcagcaattctaacaacagtccctcaggcgtgagcggcattttacagtttgcaatgcctttgcacatccaccaggccagttactcctcgtagcaaccccgctaggagcttctattattatcagttctcaaatggggctgggggaggggaaagccttgcccaaggcccctgggctagcaactcaatagagctgggcctaacccaggggtctgcaggatgtctccttccacccccaccccaggctgcctctcccacacgctggctgacacgcaggcaggactgttcttctggtgcaatccctgggccttgtggtctgggatcatttcctgtggcctaaagtacttatttgcaagttgtaaggactgcccggtttctggaagcctggctgaatgcttccagctgggaatttaaccttctcagacccagctgtggatcttgagagctctcttagttcccaaccattttcctggagccccctgagataaattagttgtgtctgggtggggacaatggaggagtactggactgggatccagaagacctggcctgggcctggctctgacacccacttgctctgtgaccttgggcaagtcccttcacctctctgatcgcaaatcaaggcttagaaagtgtgcttccctgcctgagtttgcaagcccagcctcttgttttcactggagcatgaatggaattgaccttcccttacgcagctcctccacagctcaaggtcttgtgagaaccttggaattgttgcacatgagagctgattaggtaggcccctgaagatagtggaaaccacttcccccatcctccagcatcggatagatgggcaaactgaggcacaggaaaggggagccagttgctcaaggtcatccagggaagctaatagtaaggtcaggattaaaatccagatcaacagtggtgataacaaaggtagtgtgagagattttagcttcctataattttccaccacttccccaagacttccttttattcacattttacacattattattatatattattaattataacattaaaaataaatgcatagttaaaatcctgtgtaaaatgtttataaagttatcttcagaaaactttcctatttttatgtatctgtaacacacatcctctgagcgtatacagtgtttgctcagcacttgcagcctcaaggga

SEQ ID NO: 6040 - DNA, 1334 bp, artificial
  synthetic oligonucleotide
gttgtttccatccagcatgaataccccaggttgcatcaactcgtgaccagaatcattatccccctcactgctactgtcattctcatggtactggagccaaggaatttctccttcttccagggatgcctgctcttcctgaagagatggttctcgaacttcttcaaggtaattgctgccattgctgccagcactggccccggcgccagccccggcactggcactagcaccggggccagggctggtgccagtgctggcactcaccttagcctgtggaggttcccgctcttctttccccggcagagtctcccagctttcgccactggaggacagggtttgctctcggcttcgatatttccgacgcagagcagcaatccactctttgtcactgtcagagtcttcgtcgcagtatttgtagtaatcatcactgtgcgtccagaagtcagggtcggccatggtgcgtcgtcgtctcggcaccttttctggtttcacttggtcactcctcgcttcccgtttgtcttcagggtactttggctcgggatagccacttgaactctcgcctctccctcttcttgccaggccatccgagtggccctcattgtcattggcggtatccctccacctggaagtactgtgtggcatatcgtcatcatcatcagtatcaaaaaaaatttttggtttcacgcagtttggacttgccaggtttctgattttgggcctgaccacaggttcctctgcactctttgaggtgttttccccaccaccacaaatactcacaggagccctgctgggacgtgcaggtaaattttgctcccttctctccctctccgagctgtcaccttttgtagccagcttgccttcagaagacgactgtgaggccacactactttgtggcaggaagtcagctctgctagctgagcatcttgctgcagggactgggtctaacttgtctcgctcctctctcacatcacggctaaaactagagaaatgtggaggtggcccagccaaagaccttgcccctttctctgggtcatacagcttatcatctttaaacttgccagttttccctctcactggcggtcgctcaacaggcccagccccctcctcctcactatcatctgccccataagagtcaatatgtccataggccattcctcttctgctacccgaagctctgtactctcttggcggatacctggaatagtcctcattatcaatattcaggttggttcccgaactctcgctgtcgtcccaactacgacgagtagtggaaaatggcgatcggctcctcttggtggtttgactgggggctgatctgtgcattgggacttcggagt

SEQ ID NO: 6041 - DNA, 1520 bp, artificial
  synthetic oligonucleotide
gggcggggtcggccgggacctcctccttcattccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagc

SEQ ID NO: 6042 - DNA, 896 bp, artificial
  synthetic oligonucleotide
atcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagc

SEQ ID NO: 6043 - DNA, 3695 bp, artificial
  synthetic oligonucleotide
tgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgc

SEQ ID NO: 6044 - DNA, 1289 bp, artificial
  synthetic oligonucleotide
gaatcacctttaacatttttatggctgccttcggagtgcaaacgcccagcatgtccctgagttattaaacatttgccctatcaccgtgggcaggagtattctgaataccaaaacgattttgaaatttcaggctatacggccaacattgaaggtgtctgcattcaactggccctgtgaaagcttcagtctttttcatcgaagtgctgaaatcgatggccgagtcacaatgaagacgggctcaaatcggaaccctctcgctcctcgttttgagcagctgtctttgagaggcaatcttctgaattgactggctcagaattgatccgtgagagtcgtaaccatccgtttttgtacgaatacagttgataaacttttttagacgcctttggcatttatgtttaaaacgacaccacctgctaagtaacaaacactcttcttaatcgcggtggcaaaaacgtatccgtcccgtgtgtgtttgtttttacccttccgctacactcttaagaaacttggccgcttccgccccagagagtgccctaaccacgagtcgggttgacagggctgctcgcatgcgcggtctccaccgtggtgtttgtcgcaatgggcgctgcgcggaggactacatggaatctcgactttgcagcttgaagtcattttgttggcggcgctggttaccggctacctccgcgcgggcacttgattgtaacagaaagtagttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatg

SEQ ID NO: 6045 - DNA, 1198 bp, artificial; identical to SEQ ID NO: 5960
  synthetic oligonucleotide

SEQ ID NO: 6046 - DNA, 1899 bp, artificial
  synthetic oligonucleotide
ttaatttctcttggtacagacacttagaaccagagaacagaatgttagagttaggattaatgagcagccttttcatacccccactgcctgtatatatatttttattgagtctcatggcaagagggtgtggggtgaaatatatattcttaaaacttagataaaacacagtgcgaccctgtagttccagctacttgggaggattgcttgagctgggtagttcgagttcagtccaggcaacatagcaagacgttgtccctaaaaccagaaaaaaaaaaaaaaaacttagataaaacaattgactgtagaggaatatcaaagagaaagccaacatctcttcttagccaccaagttgctactatctggcatatttgagaggtagcaacatggaggcagttttcttgtttctcatcctgaaataagactgagggctgtactgggaagctgggtaggttacatgaggtttgctcataaattttcattttgcagctgtggaaactgccagctcaaggaaggagaaatggcatatcctgtgtcacttatttattctttcaagttcatttttattgaaattctaggttcttagcagcagctaggaaggcagattgggagatgggaaggaaagcagaggccttactggtcttgagtggtcaatgctcccatttcctcctgcctctctggctactccttctgtctctgtttctaggtcggatccatacctgattccacaggggcttaggcttaggctcagagtgcaactccaaaatctggtgtcaggatgaactgctgcaggcctggagcatgggagttggtgggtgcgtgggaagcatccagcactttcaggtctggcttggctgtgaagggcctccccttctcttctttgcaccttcattttctctctctccttctgaatgtgaaatgccaaggtttataggcaaatcaaagcaaatgttgaattcacagagcactttctggctacttggctctggagatgtgagcgcaggtggggcgtagcagccttggcctccacatgaaaagttcttaagcacttccttccttgtgtcaggcaatgttctactccagaatccacaacgactctctatagccccttcggctgagttgaatcctttagtaaggctcttcatatcttgctctgcctataatcctccatttattcattcattcattcagcaggcattttcagagtacctgtggtgtacccgtcactgggcttggcactgggcatacagcagtgaacaagacagaagtgattcctgctgccatgcagctaacaatcatgtgggggagacaatattattacaaaggaatattagtattactattaaacaaggatgttcatatcaccctccagtacactgtgccagatactgtgctagagggtgatgtgggagcacaggagaggacactttaccctagctgctttcctgcccagccagcttggctggagcacggtatttcaagaactctaactttccctccacataccagagcctggctccctacgctccttcctctgaggctttctgcatctctgctcacctcttgaacccaaggcagccccttattcgaggtctcacctttcctgttgggaagagactggataagaagcaaggtgacaacttatattcccttggcttcttccatcatacatgcagacccactctagtcctggcaagggaggagggactctgctgtgaagtgactccattgcaaatacttgatgtttccttgacgaaagccagggccatctcattgatgaggctggagtgagagcagactaggctgggggaaagggggtagggccaaagctggtttgcttggaattgggcttgttattatagatctctgaaagattcatcagcatcaggaatcagagtagtg

SEQ ID NO: 6047 - DNA, 3071 bp, artificial
  synthetic oligonucleotide
aactatggagtggcgtccctctatctgaattaagtctattgttccagaaaatgggtttgtttctattcatccactccaatggctttacaatgtccagccactgtgggactccctagagacattgtcttcttgaacagtcgaataagatatttggttttttggtccttatttccaagctcctgggtgctagaaggttgtattcacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgat

SEQ ID NO: 6048 - DNA, 2358 bp, artificial
  synthetic oligonucleotide
cttatctcctcctcctcctctttctgtttcatttcctcttcctcctcctcctccttctcttccttcttcttcatttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggttcctttgacgcgggcggaggcagcgccggcgggggcgggatgggcagcagaggggggtcagcgggcccgtcgggggtgctgcgatcctggatcacgttaatcaaaagatcatccgagatacagtcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctct

SEQ ID NO: 6049 - DNA, 8466 bp, artificial
  synthetic oligonucleotide
gacagagagcaaggccagcaaggatgcaccacaaacagataaacagttgctacctccgtggagaaccagaggcaatcaggattgagggggagatttggtcaaagggtactttagccttatctgcaaagcttctactttttacaaggagattggataatggatttattgcttgtgaaatatgaaaacaaataaagcagttcaatacaaggagccttccccagacttcccaggcagatggagctgtttccttttctgggattgaatagcaccttccccctctgttctaggaaatgctgttttattataatttgtttgtgcctgtctttctccttctgagatgaggaactccctcaaaggtaaacttcatctaattcatgctcccagtgtctagcaaagtgcctggcccagagcaggtgctcagggagtgctgaatccaatcaacgcccctgctagcacactcttttgaaagtgcttgctagggggcaggcctgatgctagtcctgagaggctgattagagtcgttttcagcattcaaggaagaaggctgtctgggagtccgaaacatggacagagtgtccaggacattgggttgtatcaacatgaggacaaggctttatcagtgtatcacaaggccaggatccagtgcagtgccactgccttgccacttggcatgcttctgaagccactgcttcctcagcagttaattgaaaggcaagggatagatcgccaaatgttgaacttgtcaagcctagttctgatctgtatctctaagatggagaggccagctcaaacagggtgggtcaggaaggtaggagttagggacactcaagaccagctcagagtgtcccaggctgggaggactgagcagctatgtgaggaacctggagaaggcacctcaaaccccagtttaatgatgggagtctcttgcttttgcaattttccagagaaatctgagctcccaggtcacaggatccttcttcagccctatctatctattgcacatgggcaagagggcaaaggaaaggccttaatgggtcagttggattggggctagagagtgggtgggggtggcttttacagttggtgaagtgtgtgccacgtggccaggaatgtgcctttagacttggatgtgcatgtagcaaggaggctgcacaaaggtctgatcagtctctcttccaagaaagcccccaaccagcccctgtatgccatggtgttcctggagtcttagggcaatgagaccaggtactcctgaggagatagccacagtggtgctggcagcaggaattcagtgaacagcccccttcaccctcccttctccttccatcccatccagctccttcccagctagccactcacaaccccgccatgggcctcagaattgctaaagggacatcagaccatactacacatcattagatctcaatgaagaacacctctagttggcccgtctctttgtaagtaactttatttttatttacaacagaattggtggctttattcctccatctttagggacacttggcattagcagctagatggaaagtccgcagtgaagtcaaactcattctgccccagccacagctccggaagctcattggctcggtccaaccccagttccaccaccagcgacatcagcacttcctcatccactgggtccgaatcgatgatagcagggctctgggcaccagcagaaggagagagtgattctgcccctcccgcctgggccccaaagtcccagttttgcaggggtcctgcctccccgggttggcctggagtggcagcagccatcccctgatactggctattaagtttctgcaggtgcatactagccagcaagtgaggggcggggtgcaggttgaaggatgggggtttagtgggaggggtggttgtaggagagcctattggagatcccgaggaactagtgggagccccactggccttggttccatttgaggctaccccagggtagtgcagaatggccactgctttgcgatctttcaccgcaaggttggagtaggccacggagctcatctcttggttggcatcctagaagacagagaaaagcacaccatagtaaccctgctcctggcttgtccttcaccattcagcagatttagaaggttcctacctgcacttcatttgggactagaggtggagaggtagcaagacgacccccttgaaaattaggctcccacctcaagcatccttttgctgccatggctctgagcactgaggccagagcccagttacagtgctggagcacctgccatcctaagtgggttcactgctttcagctccttccccatagcctccacctcaccatcctaaaaagggcacctcctgtccctcttctcagcctcactttagtctcttcaacagagtggttttgctcctactcaatttctctgctcccttccctgccatctttcaacacccctagtgggttcaatctgaccacaatttaggcagaagctgttctcattctccccagagatagtcctgttgtctcctctctgctcaaggacactgggtaatgcacctaggagggcctggcccatgaccccggaaaatttgtctttccctgcctcatctgtaaaatggcaaaaattacctccttcgcaggtgaggtgccacccttgacatcaagtgcaggcctcgacgttgttggcatttcagagccttggcagaagttggataaattggcgggaagtgatgctgccagctggagctgttgtgctgcaagtgaggaagaagcagtggtaagggcaaaaggcttcactgaccaacaaagcactagcaaagcccaaagcagggcaatgccacgcagctatgaggcaaggatggtgactgagttagaatcaagaccagagatcacccgagcacagggaggagatcaagctggaacttttgcctgaggcaggaaaggtgcttgattcggccaggtactgcccaggcagccacctacccatatcaccaagatgggacatactgcttcctcatgcaagtgacttcacagtcccaaggtgtatgtgtgggggtgagggtggcactgttcctggttcagaggacaggaatgtccctgagtaagcaacatattgtctcaatgggctactagcatccaggctggagagttggggcctccactgggactgggagaatgtgagaagaagtcagggcaaggaagacctagaaagctagaggctgcagcacagggaaataacaagtctctagcgcaaatgtcatggagctccaaagcatgaccttgggcatgcctgtgagaagccaggctgattagggtggtctgggggctctgaggcagctggagccagagaagctaggaatgtgtcactttcctccatgtctcaagccccctccaagacagccccagcattgggctttcctaggatgcctaccccagaaacctgagtccagccattcccatctatagtgacaagtgaggcacagagattcaatgcctttttagtcaggtagcagcggttctgggagcagaatctagcacccctatggccacatgcctcacctgaccactggctaagtcatcatacctagctggattcaaaaggcttccaaagaagtgatttcctggctcaagtgccaaaggataagggaatgaaggcaaaagaatacctccaaaccagaaaataaacaaacctctgaaaatctcaacttattttcctggaggcctgtttacaaagaagaaaaaaatgtcccatagctaggcacagtagcaccctcctgtagtctcagctactcaggaagctgaggtgggaggatcacctgagccctggagtttgataccaggctgggcaacatagcgggaccctatctctttaaaaaaaaaaagccccatatattctagctttcatgatcaattagagatgtagaatttcatatttataaatacctcttggtccaaagaatcttgaggaccttaaaaagagtctctaatctttccaaggaggctagaattctccgtgacactctccactccgcagcggtcattaagaatctgctcagacacttctagaaagtggccacttactacctctctgtatcatctttgcattgcttacttgggtggatgggggtaggggagggaaaaaatagagaaaggggtaaacatttttttaaaaacatgaggaaaaaatatcagctgttgggtcccgcatcattgcttgattgaagccctgctccttctctgaggcaaccgtagaaaaatatttcaaaagcaagtgatcaccagacaagaagtctaacacatgtcgtcttcaagagccctagcacaatcagtatcagacaattttcctgtcctaagaaaaatgtctgggggccctgtccatcttttcctgttcctatccagccttccctctcctttttgccgcttggtacccgaatgtacaaaacgaagaaaaaacaacaggagcagcagcaacaacagcaaaaccaaaagagaaacattagaaaaatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccgttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtccc

SEQ ID NO: 6050 - DNA, 1337 bp, artificial
  synthetic oligonucleotide
ttaagcattctttctagactttttctgtaaacaagtagctaaattctgaaagattgttcataataataatatgcacatattctactcaatatctttcatctgtaggctgcgacttcttagcaaaatggtgattatactttatagaaagggaaattctatgaatttacctcttgtatttacagaggagtgtcatgctaaaggcaggaagtaaaggggccttgcctggtcctcataggcctggtcaaacaaagcatggaatatttttggccactcctagataatgaaccttgaaatataacattgccactagtcccaaataatactgtggccttcctgtgatgcttcagtctcaggtggtctgcctgagaggggacactctatgcaattaaccttctgataggtgctgaggactcattcagtgctctccctttgtgctaggggttgtggtcaacacaagatttctggatcctgcccttgagttcacaactgagttgaatcaagctataagactaatacacatttttaaaaatgcataaaatgtgcacgagtatgagttcaattatatcgtgcagcctgtgcttgtctccaccttcaaccatctagtccaaacctcgaagctgtcttctaagaggctcagaggacttatgatctcatgtagtctcattagctctatgtgaagtaggggaagaaaaggctattcctcttttacaattgagaaacaaataggaaatctaccccagagcacttaaggagttggccaaacgttgcagagcgttgcagagcctctggcagtcccgtactcctcctgctgtctgtcccctcctgggtcgcacactttacactgctaattagaccttcctaaagcacaaccctgacaatatcactaccctgcttgaaagcctctcagtaggtccccatgcccacaggaagaaagatcctttcttttgcgtagtatgcaaggcccttcataattttgtccctgcctacttctcagtcctcttatctcactattgccctcaagtactcaaagcttaaccacaccaaacttttctctcactttctaaacataaaatgttcttcaagcctctgggcctttgtacatgcatagttttggacttgtagaatgacttccatctcctctgatgaactcctactcatcctttaagatacagctgtgaagacatctctgaagttccagcttcctttcccaggcaaagaaagttgatccctctttttgtgctccagcagtttattcaaacctctaccatagtacttctcaaactagtttgcaatgattacttcttgtacttgtcttctccactagactacatactctt

SEQ ID NO: 6051 - DNA, 3032 bp, artificial
  synthetic oligonucleotide
tgatggagggagtaaggagagtaagggaaagctcttttcattggcatcctgggccagtgccatgcagtaaacccctgcgagggaattgggcagaaggagactgcagatgcaggttggacgcgggaagatcggtgaaagggaggaggccgcggtgtaaggactgaatcctagagagcggaactttgcccggtttctgcaggtctctatctgactttgaggggagctggtcagaaatccctggaggagttcctgtccccaaaagcacaatactgacgctatggggaccagatggacagaatcaagaaagatgagacagaaaggcctgggagcttggggagtgggtgaacaagttcctgtgaaagtgaaatggcccttcatttgaatgcaaatgctatgtaaaagcctgaagccccttgacgtcagcccagccattggtggcctatctatacagggctgctagtcacctggataccctcgtaagaaacgtgggatggagtagcctgaggggtgcaaaagagcttgcggcacaactacgtactgataagtttattctctgctgcttctcaaagtcgagttggggccttacagggacttcaggatggcttagggagcgccttctacccaagacacgatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctccagcactaataaatggctaaagccctcataactatcaaagcaggcgtctctcaggcgtgggggctgaatgcaggtctgcggcagcgcgagagaagtcaaagcgatcgcgatcacagcctaaccagcaagccagtgggcgactgctgggagccagggcgagggaagtggccgttccactttaatcttaaccggggctgggggaggaatgtttgttttcaactgttgttcttttattacattcttattattccaaccctcgctccctgtcattagagaaaattagtaaaaatcgactctgagtattttcatccctctggggaggaaatggcatttcaatagcatttgtccgcaatgattatgctcctgttctcagttctgcactttgtctttcctccaaaaagcaaagacaggagggtgggaagtgacccatttttaccattaggagaacttttagccaggaagaggaagttctgtgtattagaacctcactagagtagcgatcccaaggtaaaagtagagttgaaatacttggctttaaagcgtttgcaagtaaatctgcattttaaaaaaatatgagtgagtctgtcgactaagtagaatagaaaaagaggttagggtggggcactcccagagtttttattacatctaatctcggggttgtaattaacatccactcactaaaccctaacaatcagcaaaagacacaaaagctagaaaagtagttgctcgcagtctaggattatgttttgaaacacattaagaggaaagtcactggcgtgctgtttgcaatagagaacaagagaggaaatggatgagataaaagaaattatctccagccttgaattttctatttatgaggaaaaatatgacagttttatctgcttaaaggtcttccgtttacatttgcttttattagcctgagtctctctcttgggcaattctaatgccaggaaaggtttcgaaacgggctccttagtctcttgcatctttgagctaaaccctcaaacctgactttacaatggcaccgtcacaagattttctatccaatttctatgagaagtttaaaatggaatgatattggaaccatttcgatttttggcagcctattctatagatgaggcttcattaaattaaaacttcg

SEQ ID NO: 6052 - DNA, 1417 bp, artificial
  synthetic oligonucleotide
agtggaccttcgtggataagatatttggaaaaattttaaatgtcatttacagttttttttttttgcctcttgaaagagaagaactgttgcaaagtattaattttgatcttaactctgacacatttattaacaccccaaaaaagcaaagatatatatgtcttgccagaaggctatacaaaatattttaaggttctatcttctataattcctggctagtagatacagttatctaaactacaaaaagttataatttgttgcttattgataatgttatgacttttttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctccgacttatttttaaagttccctaaataaaccaacttttgaataaaaatgggcttttcattttaataacacatactccttgatgataatggtttgattcatttctcttacagaactaatttcttcctacttcacacacattaaatgctttgtttatactgataatgtcgtgctcatcctaaattaaagtttgactatgtctgtttccccagagacacaccatctgattgggatgcagccgtagagtagcagaaagagcagtgaagctggtattagaatgcctggattacagtgtttgttctgttacttagcagctgtgtgactttactgtcttaatgatatggatttttgtgctgctgccaagtatgaaacagtttggcacactatttagatacgcaaaatatgtgatccccacaacattttagtgagtgtaaagaagataggatagaccatttaaaatggaaaattttgaacaaaaggtcaccatagacttgaataaattacttaaacttctgagacccacttttgtcatgtaataaaatagatataatgatacttacctctcaggattaagggttaactgaaatattgtatgtgagggtctagctcagtgtctggaaaatggatgatgttaattaaggtttccttaggttggaatgctcctttcaccccctccatccgccccctcccccaaaaaacactccaaaattcaaacatgcatattctgattcatcttttaaggaagagcccaagaggcaccattctacaaaatctttccaaacaacttcaggcagtacagccctttggttaagagtactgggcttctggaatcagaagagaccaccaaatttaaaaccaggtctcccatttagtagctccctgacactggacaaattacttattttc

SEQ ID NO: 6053 - DNA, 750 bp, artificial
  synthetic oligonucleotide
cacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaat

SEQ ID NO: 6054 - DNA, 1995 bp, artificial
  synthetic oligonucleotide
catttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaacaagtgtcagagtccgcgtccagctgagtgggtggggagagcagtactgggccgggccgcattcccgcccgggcctgtcagagcagcggacagacagcacctgtcgtgggcctcctcgttccctcactcctgccagagcctgtggcccccccgcggagaccggggactacacttgggagcatctttccccaactctcgtcaccgcagagaccgcgccgagcccacctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttcccccagtctccataaaaactctttcagaactccggggaatcaaccatgctggtgggagctcccagctcaggcctactcccccatctcacagttcccgatcacacaggggagcacgcgggatttcctaggcttgagaaccctcctccaagcctggacggagcctcaagagtggtgagaaggaccagattgactcgaagagccgccctcctcagtttgctcctctcctacactcctctaccctagtctccaccgacctgcttccttctgcgcttgcctagtggggggtgaaggagaggacaactaccttcacttctccccccaactttcacatacaccctccgtcccttaaggtggagtctcctgggaggcgggcagcctcgcagatccttctgccttaaggccttgcaaaggcagagtttcctcctgtcagtct

SEQ ID NO: 6055 - DNA, 2811 bp, artificial
  synthetic oligonucleotide
tcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaaagcaggcagtgtagggactcatgctgttgcctaggttacctccaagggcacctgctgagcattgccctgtggttgaaggcaggctgttggccttcaggatcagtgagtggcaaagtctgagtgaaacttgatgagaagcagtagaggctaggctgaagctaggccctggcatttatatggtgtgaggaggcctagagctgtgatcttaggagtgtataataaaacttggaaaaaccactattttaccaggaagaggctcactgctggggaacagacttcaaagtaggtgatcatag

SEQ ID NO: 6056 - DNA, 1679 bp, artificial
  synthetic oligonucleotide
ggggaggggttataattgtgccagtcctccagggaagatacaatgtacttaatggggtgataagtagttactctgtctataatcacgaagaatgaaagaaatgattagtagcagtaggtttattatttcttccccctttcaatcagtccaaaacactgcggttaattctgattcaggaaatgcgggctccttacttctggcaaaaaatcattgtggggtcttgcaaatggaagatgacaatctgatacaactgcttcctcttgccccaaaatgaaaaaaaaaatgacctcaataacaagactgctaggcctcagattcccagactaacctgtggaataagtatggtgaaactgtctagggaaggaacgtggctgtctcctccatcttgaaattaatcagcataagggaaaaagggaccgagtattcaggaagcagaagcccaaccggttaatactagttactaagctatggcatgcgtggcaggtaccgtctgcagaagcagagacccccctaggcttttttttttttttttaatgggggagggattgagttgttggtggattaaacacaaattaacttgaaaatttggcccaattccatcccttatccaggagaacacaacaaacacctaacggcttttccctctcttttgcggggggatccttccagtgatacctggcaaaggatatgccagggttattcgagcaagggagtaaaccacatttgcctcagatcctcagggaagatgtcatcgcggccccagggggcgcctaattggtaataccctgcagaagggctcaaaatgaggttttggaaatctaaaggcccaagagttgccagcatctcacttggggcagcctgattttttacttcccttttcccaaacccaagcccgccatggaaaacgcggggaggtcagggaagcctccagagaacagagaagaaaaagcctgagacgttctaagattctgacgcctgaggccaaaactcaaaaactgcctcccccgatttcctaaggctccggagggcctgggctgcagctcgcgcggccaccgagaggaagtactacccacctccttccccttcaaagagcctgtcgactataccactcaactaaaatggcagcggcgactacgccacggagccccccgcagcaacgggcctggggtccggaggcggcgctgagcctctgccacgacgcgtcactcgggccattttgagagaacgcggcagccgcggctccgctgtcttcctctcgctctacatcatttctcacaggattcccaagtcttcacttactaggttttagggtcaggatccgactcggttggttcggccgccgccgccgaggctgctccgcacctccctggccgccgctctcaagcccgcctccaatgagtagctggttgagacccgcctctagcccagcgcctgctcggagacgttgctcaggcagccattatcttccccattgttaccaagcagcgacaggaaacgactgcccacaacaggaagtgatgatgccgcgtcccggcaccgcagccccactcccagcctattagccaatcccagtcgattcctcgaaaaggctccgcgggaggaggagggggacggcagacgacgcggcaaggcgggcggcggtttggaaaaggaaagctgttatgacgcccaccatgtga

SEQ ID NO: 6057 - DNA, 1898 bp, artificial
  synthetic oligonucleotide
gggctgggaatgttgggcttttcaagcgtgttcgaagctccctaattggtactaaatttcaggcattcagaccctctaggaaagagttctttctagctcacaacattaggggaggagttagacacataaatggagaaagtgatagaagagacatggtcagggatgggggttctacccttccagagacaatgcacattttctttgaaacagcttcgggaaaactgcaaatctcaatgatatttaccaattttgagaatctattaagtgcctggcactctgtgtagaagccctccaatcgtaccctaaatctgagaagtatttattattatttccatttttactccctaatgcatctactctaagctccttgcttcaccctaccaaagtttcccttctgctagtgctctcctttggtgcagaaccaccgcatccactttctcaggcccaggggaggggcggggcggggcgatttcgccttgccgcagagccagtctgcgcctgcgcggactgcggcagagggcggggtgtgagaagcagagtacagtgagactagcattcactgctggccagtgcctgcctttttcaccacctctaatttcagcttcagcagttgcttggaactttggttctggcagcagcagcaacatcattaccgctagcggcagttttgtgccgaggcacctacacacctcccgtcctctctgccagatcgcgggcctgtcggtgtctgctcctacacgccaacgccggtgggcaggaccatgtctctggtaagccagaattcgcgccgccgccgccgccgcgttgcaaaggctactgcgcacaacagcagctggggcgaaatgcaggcccctaatgcccccggtctccccgctgatgtgccaggctcagacgtcccccagggtcccagcgattcccagatcctccagggcctctgcgcctctgagggcccaagcacctccgttctgcccacctccgctgagggcccaagcacctttgtgccgcccaccatctctgaggcctcaagcgcctccgggcagcccaccatctctgagggacctggcacctccgtgctgcccacccccagtgagggcctaagcacctccgggcctcccaccatctctaaggggctgtgcacctctgtgacgcttgccgcctctgagggccggaacacctccaggccgcccacttcctctgaggaacctagcacctccgtgccgcccaccgcctctgaggtaccgagcacctccctgccgcccacccctggtgagggaacgagcacctccgtgccgcccacagcctatgagggaccaagcacctccgtggtgcccacccctgatgagggaccaagcacctccgtgctgcctacacctggtgagggaccaggcacctccgtgccgctcgccgccactgagggcctgagcacctccgtgcaggccactcctgatgagggaccgagcacctccgtgccgcccaccgccactgagggcctaagcacccccgtgccacccacccgtgatgagggaccgagcacctccgtgccggccactcctggtgagggaccgagcacctccgtgctgcccgccgcctctgacggacaaagcatctccttggtgcccacccgcggtaagggatcaagcacctccgtgccccccaccgccaccgagggcctgagcacctccgtgcagcccactgctggtgagggatcgagcacctccgtgccgcccacccctggtgggggactgagcacctccgtgccgcccaccgccactgaggagttgagcacctccgtgccgcccactcccggtgagggaccaagcacttccgtactgccaatccccggtgagggactgagcacctctgtgccgcccaccgcctctgatggatcggacacctcc

SEQ ID NO: 6058 - DNA, 1699 bp, artificial
  synthetic oligonucleotide
gagcaagggggtagttctgggagctggactctaagccttgaatgaaagcaggtggagctgagacaggggtgggagctctcgcctaggaggccgggaccgtggctgcagcgcgggccgagcctcgaaggcagcagggctgtggcagctgatttcctggaacaggatcctgcatgggccgtgggcatgtgaggcggtcggccggcacacaaatcgcttttggcccgtgggtaccaggcagctgtggcctccgcctgccttggggtcgctctgtccagggtaggagacaatccaggcagcctggcacgaattgggaatctaggaaaacctcgcggtgtccaccgtgtaagggcacaagtcctggggcagcttttgccggaaactacctctggactccttgcctcagtgaggaaaccgtcctgggcccactcccagtcccagaaacagttgtctcttgggcccaaagcaggaaacgttcaacctccatccaggattgtctgtttgcctgccactatacaaactgttcaacacagctgcctgtctcacatatagaactaattacacaattaatataagccttgatctgagacaaagatcattaggtttctaagcaaatgtgttcgctcctcggtaatttgccatttttattttcaatttccaattctatactaagacatcatggggggttctgtgacagctacctttgcccctccgcatcctccaatgtcctctgcttcctcccaaggaccctataatccaagaaagacaccttttccccaagccagtaagatgttctgcctacactcagacatgacacccttcccttctttttcccaccctccttcttgccaacatctgccccaaaccccccaaacctctccatcctcctattctccatgccttgctagagctgcatctggagtgcacagcaaaaaggggaacataggggccagtgcggggtaaggccaagcctagcaaacaacttaggggcagggttggtcttccttgctgggaacaggcagaaaccctaatgaggtctatggtatcttggaaaaatgcactcaaacatagctagagtacagtaggttgggaggggtaatggaggggtgcaggtgtctgtataaacttgcagcaggtcctcaaaagggtgataaggtggagtgggaggagagggagtgttaacttggctcctttccctttcattgcttgtgattttgcagtccccttttgttcctcttcttaaggaataggactcccacactggcctcagaggcttcctgaaatggcataaagataccagagtaactcattgccgatatgtaaccaaaaaaaaagatcatgaaatgatggagagatgtggggtgggggtagcgaaagtggaaaaattatgagcacacctcccagcagctccaaatatttttctgattttgtgcctaagctgagcccagtaacctacaaggtcaacataaatcagtaataggctcttgggataagtggtctttaattacctccctaaagacacatcttgatttcttttcatttcccaggtctgctaagggtgttaagtttaaggagaaaccaaaggaaataagattggcaggaggaagggacattttcactgctgcttaactgactgcttcatttttggttttgcctttgaaaaagaaaacaacactggctaagagcacctctgcatcacctt

SEQ ID NO: 6059 - DNA, 1141 bp, artificial
  synthetic oligonucleotide
gatagctagagacgagggggaggcaggggcccgaagcccaggacacaaagctgggcagccgttccgcaagctccactggaccgcgaccctctggcaagacttggcccaagcggcgagataggggcccgggggccagggcgcatccccatcaccctctcctcctgacggccctgactagactgaaacgagcgtgcgagccgaccctcaggccctcagcgtggccccgcctcgcaggtccctggctgcacctggcttcgcgatccgcggcttatccttcgcacttaccaaggcatctctcggagcgttcttgggaggcgccatcttgcccgactccatgttatccagccactcgtcatccgcggagacagaggagagaggagagctcgcgggctcctcgctcaggctccacccctgcggggagcgggaggagggaaacggaaggcggggttacgtgccagccgccgggggcgggagtttcagcaagccgctggccaggggaagagacgcgctggggtgcccgagttcagtattggaagaggcaggtaatccttccccatggagcctgctggggcctgaaagaagtagaggggccgagaagctcgacttcccagagttgtttcccggcaaagggcaccaagtgggccaacctcacctttgcgggggtccctcctcacacctccacggctaccacctttgcccctttcggcctcccggaattccagacccagtcggtgttagggctgcttggtccaacacagttggacccgttacgtttgaatgtcacatcaacaaggaatacatttttagtataagtatatcccagatttgcacaggccatacttatgctacgaaataattgttctgatattcatatttaaccgggtgtcctggatttttattagctaaatctgacaatcctacccaatagcttgctctccccacagcaagactttggtcagcccttgtcacactcaaagccctaccgtggctgcccatttcacactgatgaaaaactaaagccttcactcggcccgttagagaccctctagcctctcttggccctggagcagcttcctgtctccccgctgaggccaacacaggacccttccttgcctcccagttacacccttcccagcccctc

SEQ ID NO: 6060 - DNA, 1561 bp, artificial
  synthetic oligonucleotide
agctccaaaacccccctccctgttagactctgaagtgtcactcactgtgttttttatgcttccaatagtttccaaaacaaacagtggaggcagtgaccggctgggtattcactggatgcaacagtaactcccaatccgagcaacctgagccgccattggcggcaggtctgctccctaaaaggccagcacttgccaatctctgctctgccaggtcctggaatcagggatttgaggactaatggtctgcacatgtgcactgggaggaagggagactagactttgaaggacatatacactagtttgatcttcctctcctttcattttgtctattcaaacaaaaaatatatatgtatataaaaaaattacacacacacacacacacacacacacacacacacacacacaattattttctttgaatacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatca

SEQ ID NO: 6061 - DNA, 794 bp, artificial
  synthetic oligonucleotide
tggaaatgagatacaacagtcatttctgctttctggtcctcctaaaattagctgagagatttttgaagagtctattcctccatctccctgggggttttgggttttgggttttaaccataagaagggacttttttttttttttttttttttgatacgggactctgttgcccaggctggattacagtggcaagatctcggctcactgcaacctctccctgctgggctcaagcgatcctcctgcctcagcctcctgagtagctgagactacaggtgcgtgccaccatgcctggctatttttttttttatatattttttgtatggatggggtttcgccatgttgtccaggctggtctctaacttctggactcaagtgatccacctgtctcgacttcccaaagtggtgggattacaggcatgagccaccgtgcccggccaggacttcttttttagggacccctactactgactcattttgttgctgtcttctctcttttcagatcctccctcctcttcctgtaaccccattgtgtaggaaaggccttttattttgcgtctgtaatgggttcaagacctgacgttatcacttattagctgtgtcatcttgtgcaaattactaattggcaactcattttcctcctccatgtagtggggctaacaaatagtacctgcctcatagggttgtgaggattacatgaggtatattcatataaaaaaactttagtaaagtgccgggcatatagtaagtattcaaaagtgttggctttacttttaaagtagacaatagttctaaactt

SEQ ID NO: 6062 - DNA, 4261 bp, artificial
  synthetic oligonucleotide
aaatttttcagaaaaattgaaagaacaggatatctcttagaagctttcagaccttgatatcgaggttcttaatacaatgaaataaactgaaatgttcttattggaatcattggtttcaactttattggtttagggtccaatcgaagacgttactttgctcaaagtttgtagcgacgttttgttttgcagtcctaggcacacaactagcccgcccagacagccgagtgagtctgaaaaatccctattcactgagatcaaaatgacatttaaacttgctttactttttctttatttagattaatctaaataatcaaaaaggagttctacaaccttaattttccacctcactccctgactgccccccaacaacacatccctcacatcttttccccatcaacataaaccccgcggtggggggggtagtaatcaaatgtacggccgccactctgcgctaggcagccaatggagctgaaagattgattcacttcctgcttgggtctcattgaaactccggagcttcaccagcctaatttggaaagcgagcccgacctcccgcaccgctattggccgggcttactcctggccaggcggagacgcgctgcgattggccgtggtgggtgccggtaacccgtgctagcgtctttggctccccgcaccgtagatgtcaaaggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaaggcttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactctctcattcaggcttctcaatgctgatacacagttacattaagcagtccaagctgggatctcatattcctggctccccgggcaacagttccctttagccttttctgctgatcaatacatattgtttactcagagtaaggtttgtttggtcgctcctctctaggaagaacaaggagtgggataacgtgggggcggggtggggcgggggagggattgggaagacagatgtgtgcctctgaataacctttcagcgccttggttatagcagctgtatttcaggtgaaatttgttttacaatagactagttttgcatttttaaaaacttctatagcgtttctaaatgtctgcggtgttttactacaatctgtacacaatatttgtgagataatttgtatctaatcgaccactccatgttattattgctattattattactacttcgttgagctgatggctttttaattgcttagaaaagggaggagatgaatgggaataggcggggagagagatgcctatctactcaccgcccccccccttcccaaatctctatgaggaggagaggatacaacgaagagagttattgatgatgatattggttatattttttttccggggtggagtgcctaggaagggcagaatagggaagcctattaggtttgcaaactagtgcgaagtagcagcggcgatttcgcagctttctgccctccctcctggaagtgtggagcccgcgcaggctaccgcagcatagatcgaggtatctgagaaggattcggcggcaactctgggccaaagaggtggcctgacagtctgggagggctccgcactcaccggactccaggattcctgcgcgcagaaatccaggcccccagcctcgctagggcgaccttccgcgcgacctcacttcggccctcctagaggaaagactttgccttcacacgcgattactttcactggagatcacgacccggagacgctggcgactgggccagcgcctcccatttcggttcacctccagttcaccgccccctctgagtaagaaacccttggggaggggtggcgagggagtgggggataggcattctctgctcagtgcagaacggcaatgaaatgattggcaaaggtcacagggattctggtccatccgcgtaccacctctccccccatgtatataccgctgtctgtgtgtgggctcgtggggagctgtctcggcgtttctgataagcacagctggtggaagcccacagcgacgatccagcgagctagcgagcgcccgggaggctgggttcctgctttttaaaatataaatatatatatatttttaaatctctgtgtgtatgtgtctctgtgcgtgtgtgtgtgtgcgtgcgcgtgcaaacgtgtgtgtgtagatagctgtgtgtatcgcgttactatgtacaaaaacaaaaagtacaaaaaaaaaaaaaaacctggctaggctgtgtagagatcccaaaaatatgcagttgctgtggctttattgctagctagtatccacacaccaggtccacaggcgaacctcattcccaaggagcacacacgtgtgaggccggccaagcacccaacacccagccgccgccggccagacctggctgggggcgctgcacgccactgctggccgcctagtccggcctttaggcgcagctgctgtagacaaagcttcaaactacctaaggaccagaaagcccggcccggttgtcgaggatgcgttagtatgagttgccaggcctctggtccaccacactgtgtctccctcagctgcaggtcgaagagcatgtgttaattcaaatcccggacccttctacttttttgtcaagtctctgcattctgttggtagttaggttttagttctgggattttatttttttttcccccacactgagttcatgttttacaactgttgggagttttttgtttgtttcgattttttttctttgcagttaattgctatggttcgaacctgagttaacccaaatatttctgccgactttataactgtacagttttgtatattaaacgtttttgaagttattaatttaaagaaagatcatttagtttattcatttagtaactgatgta

SEQ ID NO: 6063 - DNA, 1916 bp, artificial
  synthetic oligonucleotide
gatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattact

SEQ ID NO: 6064 - DNA, 2276 bp, artificial
  synthetic oligonucleotide
gtgagcagaggaccgaggagaacattgtatgcccagggttttgctcaggaaagctagcagcccgaaagcggcgcgttttcttcagcagcgggtcccgcacgcgagagtgctgccagcacgctttctgcctccttctccaggaggcgagcagtaacttcctaagcttacctccatctctcccccgcccttcttgctggttctccgtcagcggggaggggccgcccccggatcgatgggggatgtgaggtgcagggagtggggaccagaggggggtactcagcagttggtgctgcgccatcccttcccagcaggcggcccggacactggttcacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttc

SEQ ID NO: 6065 - DNA, 992 bp, artificial
  synthetic oligonucleotide
ctacccttcctttctcttgactagttccctccctgttctcgctgggccactaggaagtgaaatcagtgcctaaccgcagctgaaagtgctctgttaggctccagtcaccgcgccgggcatgctcagtagctggggccggctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctt

SEQ ID NO: 6066 - DNA, 8440 bp, artificial
  synthetic oligonucleotide
agtgtgcatttcagacggtgtcaaatacaaactgaacctacaggaacatattttgactgattaacatgcagacacaaatggcacaaaagacacactgatgtgtaggtgtgttgaaagcacacacacaccttggttgtaaatagcagcatcattcattttcagcaaactaaagaaacaacttttttcaactgtttcgatgagacactgctggaaaaaaaatgtcatgtattatcctaaattggattctaggattctagaaatgcttagacttatgtgctctatccaaatgtaagaaagggcttcagtaagaccttctaatgtgcttatcaggaaatctttttaaaaaatactgtgtttcttcttttctcccttttcctcccccttctatccctctctctctccctcccccccccatacacacacagacacacacacatccttcacacacttcaagagaaactgtaacacaatagcccacagtgacatccactggtaggaaccagatcttaatgccacaacacagtctcacattagaggaaagcatcatcaactctagaagattgctatttttactgaaacatctggatgcaaagtcttgttcctcattgggatgtttggtctccacactaccaaccaaccagatatttgaaaacatacagatgcctgatagaatttcactttatatagccagatgtttggggactagataaaaaacaagccaagaataaactaaaaaccactaatcacctgcatctccacacactcctgttctctcctccccctcatctccctttcccatcttacactcccactcccagtctctctccagagttcatcactgcaacaagacagggtagctgccaacactccctctcctttcattcagtacctgtcccaaaaacactgtgccccagacaccaagttgtggtagttggtggttttcctaaaaatatgatctctctctctctccccctccctctctctctctctgtttttcctaccataacttcatggagacagctatgcaaattttaaaatgataattgcgtttctgctcaccatcattatgtgacagaatccattcaaacactaaatgattgtcttccagcaaattgtcagatcaaaagaattgatcaacttggactgtcacaaacttttcaccctacaaaaagaagcactgcaagtatgctgcatgcatttaagtaggaaacaaaagcaccaggattttcacacagagacacagataaacacaccttattcatccaagacaaagaaagaaaacttggctttacctgcagttgtaggtccggatctctttgttgtctcgcttgcacttgattgccacgaagatcatagttacaaagaggatgcccgcaatggagcccagggcaataatgaaaatcaaggacaagttcacagagcccattgactcttgggcatcgagagcaggggacaagtagattaggacgagagcagaggcagagagagatgtcttgccgtggtcgtgagccaccacgataagctcataggaggacttggagctctccccgaaggtgcgggtggttctgacttcgccattgacctggtctatttcaaagaagccgcggtcgccctcggtcatgtcgtaggtgactcggccattttcgccctcatcgtagtcttctgccttgacaacagtcaccaggtagcctatgccagagttgcggggtatgtagacctcggcagtgccgttaatcagaggtggggctgtgatgaccggggtgttgtcgttgacgtcgaggatgatgacccgcaccgtagcgttgctttgcagtgagggaaggccgccgtccttggccagcaccttgaattcgaacgccttggtctgctcgtggttaaaggatcgcagcgcgtagatgtcgcctgagttgggattgatggagacataggtgaagacaggcatgtcccgcacctgcgacggcacgatctggtaggagacactgccgttgagacccaggtcggggtcgcgagcagacacagagagcagataggcgccaggcgtgttgttctcctgcacaatgacctggtagtagggcttggaaaagtgcgggtggttgtcattttcgtcagtgatgagcacggtaaaggacttggcactctgcagcatgggcacgccgccgtcgcgtgcctgaattgtgaggttgtattggtcgtgctgctcgcggtccagccgtccgtccaccagaatagtggagaagctctcatattcctgcagtcgaaagggcacattgcccagcaaacggcactgcacacgtccattgaggcctgagtcgcgatcagacacccgcaccaaggcgatcacgtagcccgggggggcgctctcgctgacctccacaagctcactgttgactgacagcaggttgatgaccggcggattgtcattggtgtccagcacgctgacggtgaccttgcagtgtgccgggatggaattgggccccaagtccttagcctgcacgtccagttcgtacacgtgcccctcttcgtagtctaaagcgccagtgacagtgaccaggccactgtgcgggtcgatctgaaagagctcgcgcgtgcggtcgttgacgtagccatagaaggagtagaccacctggccgttggtgccctcgtctggatcgctggcgttgaggcggatgacgggtgtgttgggaggcgagttttctggcacgctcaccgcgtaggtggactcgctaaacaccgggttgttgtcattggagtcggtcaccttgatactaaggccaacggtgcccaggcgcggcgggtcgccaccgtctagcgcagtgattcggaagctgtagtgcgactgcgtctcgcggtccaggctcttttccaccacgagttcggcaaagcgggagccgtcgccgcgcgtcttgatctccaggccgaacagctcgttgggcgtgagctcgtaagtctgcacgccaaagcttcctgagtctggatcgtaagcgctgtccagcgggatgcgcgtgccagggctggctgcctccgagatctccagctcgatctgtgctgccgggaaactgggcgcattgtcgttcaggtccttgatctccacctttatcacgcagatttccattgagctggacatgacctcgagcgagatgatgcacttggggctctggcggcacagcagatcacggtcaatcttctgcttggtgaccagcaggccagagctgggattgatgtccactaggtgtggagccgagttggacaccacgcgaaaggctgaagcctgccgggggtccagcgcgaagcccgcctctcgcgcgtctttggccacgttggcaatcaccgtcccggcgcgctgctcctcttctaccgagtacttgagattaatgagggcggcagcctgcgtccacagtatggccagcagcagcagcaccggcagcaggagcgactccatggctgcacggggctctgcctggcctcgcctctccacacccctccgagaccgacgccgtcggcgctccagcttcccgccggctcgggccgcctgttgcgcgcgccccgtggccccggaggccgcgggagaagtcccgcccagggcggcccggcggcgcgcgggggacacccgcggcggctccaatgctgaggttgcggcggacgcggcgggggctcgcgggggccccgggggctccgaggggccaagggagcgccgcgcggccccgagccccctccctccagcccggctactcagttttaccccttcaaagttagccgggcgcgactgtcggcagccgcccagggctgcgggtcgggcggcgtctgcgcggcctggaggacgcaccgctgagtccggacagtacttgaggcgaaggtaaagagggcggaggaggcgcagcctttcaggcactgcccggcccgccgcggtgcaccggcactgaggctggcgaactcgctgtctgtgcacctggcatgcgcaaagacctccccccagcgctcccagttcactgcggagagagtacccgcttggaatgcgccctccggggtctgggggggccacactggcctcttcgaggcctgttcgggagaaagggggtgtcgcagacgggagtcagttactggcaagcgccgcgggcacccggttatagggttgagtcggatggcggtcccggggccagcagaggaagggggaggggagagaggctgccagagcttgagcgcgctccctcgcgctaaggctggcttcgaagggcttgggggcgcgtctgtccaggatccgaggtgggagcggagttccccccacagagcagttgagggtctgcgggcgttttcgtctaggaaatcaaagttaacaacgcagtccgaccctccacgtcaagtttgtggaaacggggagatggcaatttgtccaagaaaatcaaagccccggtctttctaatggccgggggtggcggggaatggggaagagggaaggggaggcaacaacagtaccggccaggagaggcggggccgccgccgtgggtaccgggtgcttctcttctctccgtttgggctggggtgtcgctccaaggtccgccgccgccgccgccgccgccgccgccgcgggaggaagccctcctagctcagttgcacgtcgctggggtccgcctcagcagctgccacagtcgacgattttgtcgccgccgaagtttacttgcaggagcgtcttgatttcatcttcccggagaggcgctggccgcgctgcgttgggctcccttcctcccgggcgctcgcgcactcgggaggtctgtctcgctttctctgtctgtctcgggctgtgtgtgaatgtgtgagagagagaggaagagtgagtgtgtggtgtggggagtgtgagtgtggagtatgagcaagcaggaggcaatgggtttggggtaggaggtttaggatttcggatgaaatcgctcagccggaatgctgcggagcgcaacgcgccaagggccagcgccgggctagggacgcgggtgccagtgcctcccgggcaagccaggcatggtgcacgggagctgtgctgccgtctgtgcccgctcgtccgtctccgcgctgcgccagccgccgccgctactgctgctgctgctcctccggatgccgcaaactactggccgcggagtctggagaaagccggagaaagctcaagctgccgagcccggctacgccaggccctggccaatcagcgcgccgccagcgggctccagtcttggggcggggccaagcggaggcggggggtagcgggggggcggggccaagcggaaacttcacaccggcgggaccaagtggtaccccggcccatggagccctggcgggattcatgggaggacggacagacaggccaggcaggccaggcaggagcaatagggcaggaatgagcagggaggcggtgtgctggcgctgcggctgagcctcgccgggaactgtgcgcttctcatgtttgcagagatttcaggaaagatgaggatgatatgattgtcttatcgtgtttacctcccttacatatcttcatatcttgaatataatatatacatatatatacacatatatatatatatacacacatatatatatccctctatttctccttgtctcttcaccctaaaaaatcgtctgtttttgttttcctctcttctcattctctggtagtggaaggaagaaagggaaggagaaagcgcccctgaggtggtcattcatccagctcttagccggtgtgtcttcacatcaggccagagccacggccgccacccccccggaccgtcacccccatccttccaccccgggcagacgccgcactactctctgcgtgccgcactcccagcagggcccctggatcggttcgctcttgtctgttgcttgttaatcaaatgggatatgtggcacagagaatgagctacggagggggccggacacatttcattgcccctcaccccaccctgttggagaatttagctccctataaataaactgtacgtttgagaagagccggtggagcggacgccgccgcgccgcgccaagccagcagagctcaaagccgggcaggagctctggggcgggcacgccatacatgtccgcttaggtcgccgacagctgggagccggcgccgatgtgcagggcgccccagccttcccgcggggtctcggtcccagggggctgccagctccacttgggcggcggtggtggctgcggcatgtgccagtactgggaagcgggaggccggcgtggccagggctgacatcaagctcatcctgccttctgcactgaaggctccctgggggcagcggggcattcctccccacccgggctctgaggcttttaattaaggtcgccagcggcaaaaaaatcaaaaacgtgcccgttaaacaagtttttttttctcttagaatgtggggaagctgcttctgaattcacaattcttggaagagtaaaaatgtcttctgagtgagtcgtctcggatatttgggagtgggataagcagactcataattagcccagcgacattggctcgagcctgtgggcttcacatgagcgtcatttttgccctctaaaaagcgttaaacaagaaaaggaaaccggcatttggacacataatgggttttctcaaaactgccatcttcttgtggagagcaacccagctgctttttaaaatatttttccttccaagaagagctactttagcagcctttaccttggcggtgggagaggggaaaggcggcttcctcttacagaaagaaattatttcgcgagtgagattgcgatcccctgaatatgtagccgaggccaaagggagagcgtagggagcctgatccgctttccgcgtgggggtcgtttcactgtttcacgttaggatgtgattcggcccagaacaacagggagaaaaccgatgcttctgcaatgagtatcatttaattttggtcatttagagctgcgggtggacaccagagtggtggctcaagggagcccggtggcccgaccggttttctccagacaccgttggagaaatgggcaagtagtagagaatgacaacatggcaggcagcggtgggcgcacctcgcgggctccgcgaaaggaagggttccatttgatttatcacagttatttacctttgatgtcagagcatgggaatgaagtgcatcttggtctaattaaaaaggcctaaaaaggcatttgaaatgggtttgctatctgatcacgggatgtgaattcggcgtttggcagctttctaaaatattgcttggactatttaaacagaacaattagcagcatgctaaaatgtttgcatgctatgcttagaagcttttagctgtaaactttaaggcgatctgttccccctttaagttaaaaaaggatgatgctgcttccttgtggcgaaggctgtcaggaacccactgatcaataaaagtaaactggcgcctccacggcttgattgagcgggagcaaagagtctgagaagtagtctcggccattaacaatcccccaggtaacgagaaatggaagaattactcaggtaaaatgattaacattgtcgtagcatctgaaaagatgcacacaacaagataagaagactgcagacctcttaccttagggagtgctaatagaatgtctatattctgctgtcttttaaagataaataggagaattcaattcatgtacaatgtcattaccttcataattgcaatcacaatgtaaagacatgttctgcatttgcaaagacaaaccctctttgctaaggcgatgccaccgtgttccctgcttcctgctcgctgttcacactccaggcacccctcttttccaaggagagcatccaagtacttccagctaccaaaccacttttacacaagccaggtgctaagggaggcaggggcgtgtgcctatgctttccttctttcctattatctcctccccacccctaatctcaaagtgacagttacacagccttccccatccccacacacaaaatagctcttccatcccccagtctatttctacagataatcctaacaacagcctttgccctcagaatttctttttttctaataggcacactcgatcattatactccaagaatgccattgactaaatgagtagcccaaaacactttcatgatcaggaatttattaactaactgaataaaatcgttctgcatgtagataataaaaacaagaaagttctctccgttttagcttccctttacttcaatcctgaagggagccccgcctcctcagcctctttagagacacaagagggacatctagtgaccatcctcagtattttttaatccaacagctactaagaaatactaatactaatggtgctatgccgcctacggctgctctccaggtcaaagcagctccactgaggccagaatcaaaattggcaaagagaattttttttgtctttaaaatgtcatccatgccactaaaatcatgctgaatgg

SEQ ID NO: 6067 - DNA, 1234 bp, artificial
  synthetic oligonucleotide
taggaggtccaggatgtacagaagactcatttttgccacaaatatacaaggtctagggtcaaccctgccaagcacagtactctggaattttacgtcctctaatcctgaagaagcagggtactgggggaagaaaagcttgattagaaagtcaccacttttcaagccaccagaattctaaccaaatgatttcaccaccccaaatcccacctcattcaatgttaagggttggaggaacacctttttctgccccattacaaaccaacacaggagacagaagcattctgtgccccttctgagatctcggggaccctcctccagtaccagatctctcacagcctgcttgaagagcggcaatataaagcagctccacagcacacagccaggtccccagccccaagcgcagagggagcccactgaggcaggactccagccaaccagcctccagcctttacctgtggctgactggccaacgccagagaagccgcgatgtcgtaggtccgaagagagtgcgggttagcgaccccgctcgacggccgagcgctgtgagaggaacccacgaaaaggtgactggacgccttggagggcgcagttcccgctaggagctcggccccgcccccgcccccagggccagctctcgggaggggcaccagctcgggctggcgggaaaagcccgggcactccccgcgaggggagccgaagaggagaggggaggcggctcccagaggggcacagaccgcattagtgctgggtgggtcagggaaggggccagaagaagccctggagaaagaaaagtggccgggagggaccgcccaagcagacgggagtccaagcctggggatgcggtcgggagaggcggacggggagaggggagacgcggtcagctagggagaaggaaaaattgggggaccagagagcgggtagggaagacgcacgaccccgagatgggggtgggggcgcttcagcagcgaaaaggagctgggggtccagaaggagcaccggaccgagggcgaggggccggccgctggctgttgacctacctgtcacttgcaacaggtgcctccagagatcgagaagtcccagtgccggtttcaagggagggtctccggctccgggaagatcgcaacccagctccggcagccggcccttctcaccctcccgggaggcggaaaaagctgcaactttccctggagcggggaggagctggactcttaaaggggccgcacagcgccccggg

SEQ ID NO: 6068 - DNA, 1737 bp, artificial
  synthetic oligonucleotide
tactgaccatggctctgtgtctagtgggtccaagcctctcccgggtggccagtctttctgtaggttgcggcacaacgccaggcaaaagaagaggaaggaatttaatcctaatcggtggaggtcgatttgagggtaagaccatctggggaccctaggagggacgggggtggcggcgggggtggggagaaggcagagaaggtaataatctaggtacatgtctgagtccgaatgtgtttcttgcactccccggactgtggcgaaatggcgtgctttgtgtgtctgtggttggggggaagtgggggaaatgacagcagggaaacctatcggatagtttgttcgtaatcctcctctctcaacagcacttactctccatgttttcgatctgtcatcctgcaggtctgctgtagcaggtggctccgcttgaagcgagggaggaagtttcctccgatcagtagaggtcggtgtgggcgtgggggctgcctggaatgggggaggggttagaaatcgccggcactttggacaggctcttccaatcctgctttattttccttacctccctcccatttcaggctagggagggggcagacctgtgcatgtctgggatagcataaagaggttaaaaacaaacctgataaccggaatggtgaatcaggaaagcaacgaatcaacagtcaacccatcaagtgctccattctcactggctctggtctctctgcagattggaaagattgttgggagtggcacaccactagggaaaagaagaaggggcgaactgcttgtcttgaggaggttagtgcaagggttctagtcaggtccctagggacatctgaggttgtggtgactgagaccccagcagagtctgtggattccattgacattatctaggctttgggcggggtgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaat

SEQ ID NO: 6069 - DNA, 1820 bp, artificial
  synthetic oligonucleotide
aaccagctgtctgagctgcccgggcagcgggggagcagcgagcgggcttccgcgagccggagaaggcacaggcctgtcccgggtcccggcaggtcagtgtgaaggtgggcgctgccggcggaaccacggaaggggtggaggtggctggcagtaggagtagggaggggcggagaaaggatccgggagactggtgaggagggggaagcggagcggtcggaggcaagggcgggggagcctggcccgccttctcgacgaccccctgcactgagccgtccatccattttagtactggaaatggagtacgggggggcaaccccgcagtgcaacagtgaaacgtagacatattctggaaataaccgcctctcacaatctgctcccatggaaacatctgacctccgcaaaaacggggtggcgctgggacaggttgcctccaggggaaggggacacagagacaaacgcagtttggaaagcatcctggtttggtgcccgaggcctggaaagaaatggcggctggggtgcgggggatgtaggggaggaaaacgttgggtaagcagggcctggactcaggaaagggaaccgagtccctgtgagaccgctgactgcgcagcccctacccctgtctcctgtctgtccgcaggtctgcgcgtctgttcccagcgctctgcgaggcctaaaaaggaggagcaacctgtccagaatccctgcaggtctgtgaaggtggttgtgggggagctcaatggacagggccctataagggttgagagtgtggagggcccggccagggccgaactggggcccctgcccatcccccactcacatgaacacacaccttaccaggctgaaccagtgcagagaaggtggcagggactgccagggaatggctggctcacgtgtgtgggaggagtggcaggctacgtggtgggcagaaggccctcttgggggccctgccagcttaggggaaccctcaccaggggtgagatgcaagtactatccagacctgcattccaccccatgccctcagtctcccatgtctcttatttgtctcctcttccctccattcccatcccccaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtca

SEQ ID NO: 6070 - DNA, 2923 bp, artificial
  synthetic oligonucleotide
aaggaaacatatgtaaaagcgcccgatggtttgttagctgaatatgactcaattcttctgtttgtgaaacagcagagaacaaccctggaaatctttccttgggaagtccgtccgtgaaaaaaaaaacaaaaaaaaattaaatgccaaaacacctttaaagcgctgtattgaaccacagtatttctgtttatcgtaaaaaggagaggtgaactctcagggagggaactccaaaccacatcggccaagcgcgccctagggaaattcttttttgctctttgccgggcgaaggctaagtacaacgaagccagaaaggtccccttaaccctactctgacctgtccaggtgccccccgccccccattccagcctggccagaaaaggcctgccccttcgtacactacgggtcggtatgaggagggctccgatgaggctagcgaaggaaaggggtcgctggctaccgaaagctcaaaagtccgccccctggttgtaaaagtgcgctccacgtggcagggcggttactagggcgaaaagagtgaggcgctcgccacgcgcgcacaatgtaaatggcgctaaaaaactcgataatcaagacaaataatattttaatgcaatattaaaacgtatcaaaattaatgcaaaaacaacccatggtgagcaaattgccaaaattttaaataaaggcgggatcccaccctgcctcactcgctttaccctagtcccgccccagtcttttacatcctccgcgccccgcccaccacgtcccccaaaaaccaagggcggaggcagcgcccgtgagccccctacgtggcttttagctccggtgaaagggtcccgggatgaactgggcgcctccggggcaagccacttaccgcgccacaacgtcgggatattgagattcatcgaaaaagttctctagctcctgcagctgaaactgcgtgaacgcggtgcggcggcggcgtttcctctctgggggctgtggtccctcagcggtttgtggcccctccgccggctgtggcccctccacggtcgtctggggcggctcctcctgctcttgcttcagctcgagcaggggcggctcctcctgctgttgctccggcttggtcaggggcggctcctcctgctgttgctccggctcgtggccgccgccaccctcacggtcttggtcgtccgaggggacggacccttccgtgccaacgttgttttccgcttctgttccgtactcaggtttggaccgtgtattctcctcgtcctctcctccccttgccatcagcgaggtcacggtaagtttctcatctgggaagggaggaaagcaaaagagacaccagggcgttggagcccacggcgcgtgggctggaggaggcaggggacccgctatggaagagcaactgcgacagccgcgcagcgtctcctccgcttgcctctcccagggaaaaattcctcttttggagttcgcgaaagctcccgtccctgtccaagcactaaccattcacttcctcgatgtcctcgccgactgccaggctgcggtagccaatatcactgtgggtgtacccgcgaagagactccatgcttcaagcgctgtcgataaagctgtgcacttctgcagactctgtgcgtggttccgcggcgatcccggggttggaactggctctgggaccaatggctcgggcgagcgcttttctggcgccgggacctctttctggcgccgtctggcacttgcgcgccctatatagcggtacggtgccttccgcaggttcaaagcgtatgcacacgcgtcggttaaacgccccctattagcattcacagtacatctagttgtgagtgcgacccccgggggacgcattcgtgtccagggcgtacgaaaaatagggcgagcgtgcgcaagcatggtgcaggtagtgaacatgctttgcggggaacagtggccccaaattgctgcttaactaactactcccaacttgagcagagacccagattggaaaaagcggctgggttgtgaaagccgatttgggggcgaggagacgagggggcgagggggcgagggggcgagggggcggggtgagacctcgcaccagcccgtggagaggtattttggcagtgttcctccgcccaaccgtctttaccccgcagcacttgggtggagcgatgccctttgcttcccccacggaaaagaccgagagatggcgttgaggaaagcgcggaaagttcagcagcccaaacatgcgaaagtgaacttgttagtctaccatgcaattgggttctgagcacgactctcccctgctagaaattagtgacaaatggataggactatctagttctgtacagttcgcgccaaagtcaggatagtgataaggtgcaatgattggctagaaggctgcttgctctggatttttgaattcagaacccaccgtgcattccgggagcgggaatttggggctgaatttgaagagcagtccgctgctcaggtgcacgctgcaagaaacccaacgtgctttttgagaaagctccaaggacttaagctttttagtaatgaacttatgtcagagtgcaagtatagaaatctgctaagtgcatagtgcatccaagaatgcttacactacgggggccccgtcttttgatgcgcggcacttgaaacgtctgctgtactaggttcctgcgcttcttattgcagcgcgctttgcagaagcccgttctgcaggctcctaaagcgcgcgtattccccgggtttgtgctgtggacctgggagagttcccgccttccccactaccccttcttcctcctccccctccctttttctagaactatcttcctgaattcttgctccatagtgatgtatcacattaaaagtcctgggctatgattgaaggctgtatggttctccctccaataagtgtttgcaggttctccaggacgtgttaatatccgta

SEQ ID NO: 6071 - DNA, 3221 bp, artificial
  synthetic oligonucleotide
ataaacaacgaaaaccaggagggtagcttggtattggttcccgcccgaaggtcctttcctttcacacccgacctctctagatccccgacttaaccccgattgaagaagaaattttccaggatgggggtggggttttgctggatttgtcgaaagagatggtccacaggggaagagtgcataaacttggcgagaggcgagagagggagaataaccttaatcatgcacaggctccggccttaacagttgagtgggtggtggaccgaggccaagcggccaaataagtggagtagaaaggcgcgagtctgcgctgcgtgccacgtaccaaacgctcaattctccctcctgggccctgtatccatctctcgttcgctctctgtggctaatgcagagcgatggaacagcctcgggagaatagctggagaaagctcagagaaagacaaattaaaaggagctcagcgcagcagcaaatgctggagaacagcgctcagctgacccgttaaatgagtaattcggtaaaggtgtgttaatcagtgcggcgccccgagagcccagcgaaacactctgggaagatacctggcgtggcaacgggactcttcaacgctgcgatctagaaacgctgctagtcctgggtcgtagtccctctcccctgtctcgcttaaagagaggggttcctgggttgcaatacgttggagagcaggtgatcagatgcatggttggcgagcccctggcgcatggcagaatgattgaggccagggtcctagctgcaagcccatccctgcgtcccagtacattacctgcctgccccatgactggcggggctggagaaccctgagacttaaggatcttataggtggcaggggtggaaaagaagagttctctccggtcctggaaagctctaattgtcagaaaaactaggtggtttgcgtctttaaaagcaagttccagtctgcggggaaccaagcaggtgaactcctgactgaactagatacctgttcagcggctagaactggagactgggagagctggaaaacttttagtggctttccatacctgcactcagttgagcgctcgccccaatcctgtacgccggcctactctggtaaggacgctagacggcgctgccgggacacgctttccttctccggagaaaggtaagagagcgctttttttttttttttaaaccaggggatgggggacttggggttggcagcctttctcaatctgcctcccctccccgcgctcccaaatctaaaggggtgtggaagaggaggaggagcagaagcagctcttttcgtgacgcgccagagcgcttctctctaattcccacctcctccccggtgcaatcagtcagccaggaggctccaaactgttagcgacaaaaacgcagctctcggtcactcccactaccctcccacccgcactccaggcatattttggaggcggcagcagcggtggcaggatgtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactct

SEQ ID NO: 6072 - DNA, 833 bp, artificial
  synthetic oligonucleotide
aactgaaatagagagaaagaatgaatttcaagttctagatgcaacttaataatcaaatggatatgcttaactaccctcaacaacttcaccaggtctgtgatactacaagtaatcagcagagcacttcacaaagtgaagtgctttcttcacaaaaatagaaaagaaaggacagattctccttccctcagggctgcatcactattgcattgtagagtttgctatactaaggaagaagctgttaggtgtttaacgtagttggcactgagctattgtaatgtattctgttttccaaggcaacaaaactgtgattcttcctttggcaaaaggcacaggcaagctgatcactaatttcacttacttgccctagtgtagggaatttctgtgaagccactgaaaaggtcagggaaggaataacagggcaaggttaccagtgcactcaatcccaagtgtcagtgtggtcgcagagccctaggctgaaggcaaagaagaatacagtacacctagtggtccctgagggtaagaagagtctgtaggctatttaaagctggggttaaagcctttcagattgcctaagtaccattttctgtgttaatggtagatgataataggaagctacaactgaaagttagtgtacatccaatatgcaactgagggcactatatcattatttttaactttgtgctttgcatattttctatgtttctagataaaaagaaatgtgtcaagatttcgacaataaatttccataacatggtcacctttatcctctttctttagtctgccaatatattcactcagggcccaattctgttttccagaatttgttaattgaa

SEQ ID NO: 6073 - DNA, 716 bp, artificial
  synthetic oligonucleotide
tagtatctattccttatggctagtaccatatggtgagacagaaggcacagggcccttttttaccattatttaaatggaaaaatcaggctaaatagacaactacccatgtagtatgattagaagaccctcaatttgtttctgatagttagggttaaatatagtatttgtcttatatcctgtcaagaaaagcccttgttctgaactccatgctttagagaccccttttggctttcttcttgctatgcccttcctacagtaccaggagcccagttcgtgggtccagaagaatgtatacacactcagagttcttgcccattgtggtgcatccttaagatacctatgacccctgaattctttaccccagtggccccaagcctgcttccatcacctacatgctcctctgcactgggtctgtcattttgaggactaacagcactgttggtgttacatatgcccagctagccatggagtggctatacatgggtaacagttaaagaatgggttggggtgtccatatgcacgtacagatgagtcctctcatggtgagggatgaaatccagggtagaaagtggaaagaacaggattatctgggaccatggcctatagaggaggtagtagttcttctcacactcatggtgcagaaggtagagcatttcagggattctaaattaaaacctgaccattctagtcattataaatgtgtatttgttatggaa

SEQ ID NO: 6074 - DNA, 3578 bp, artificial
  synthetic oligonucleotide
ctggttcctggctccctctccagtccctggagatgggaggccaattcttccctgtttctcttcatctctttccttcagaaggattagaaataaagtctgagtcacttttctggctagccttttttttttttttttgcactagctcagtgtgtctgtggccccacatgtgactgactccatgtgtgtccctttgtgtgtgctgtgttcctcagagcatcttctcaggttgggctctgcctgtgcatttgcagggaatgttgtgtgtttctctccctgcatgtcttcactttcacttgtcatccgcttttaataattccatcagcttggtttaccagcttaggctactcccatccagatgcagggaatttccatccttttttcaaggtgggaagtgccaggaagaaagcaaaagtgtgctcagtggaccgatggccaaatctgctagtcagctactccactgctgagcccagctgtgggaagccacggagccctgtgcccggagctctcctctgtatcctggaaattccgtgcagcctaggagaacagcccttgtcccacaattgcccctcagtagccctccggcctcttctgaagctttaaccaagtgcttgaaaagaaccgaaagtgaggaaatattccaactagaatggatccctttgtgccaacagcctcctttagagttcaggaacacagaggaaatcgaggagggctgacttttcaccttagaactcacaaggcccaaatgtgccaatgtttaactgtctctccgaggtgcttctgacacccggaaattcaccatgtatttggcatcaccaggagctcctcaactccactgcttcctcctgcttctctcttccctggccttaacttcaccacccagacccactgtccagcttcccagtctctctgggtccccactgaggctgccctttttggggaaggaagagtggccttttttcttggccctcaaaactcctctgaaggggtctggagcccgctgggagaccaagagcttctcttgaatctcggctgctgcatgtttagtattcacagcatgtctctaaaaaacgtcctgagatcattcatcaggcactgtgctgtgtgcctagctgctctccttccgggtgtgtgtgtgtggccaggaccctccctccatctgctggtgaacacacatgcacacacaccttaacctttttcccttttcaccaaaccaatcgcattttctaagcagacctttgccagctggcagatcgctcccttactgaggtgggctcctggcgttgggcctgggctcgaagccgctcacactccagtgctggggagaggcgctgagagcaggagcccgagccgaaactcaaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagcgtgcccaactctggtagtcataccctccacgctcgagctgttgggtttcctgcacacacacaccacagccccatacacacacactgaaaccactgcaggggcaaatgtttgacaccttcccccagaagcaggtggcacctccacccttgcagctgcaactaaagagccccagatgacagcaaacgccgaattctgctagacctgcccctccccttggcatcttggtccaggtgcaaaaccctggagtccaccgggtggtcttagcatcctgcagctcttacggagggcggggcagtctctggactcctgccttcggaggaactgctataagcgcaaggctcccttgggggcgcccttctcga

SEQ ID NO: 6075 - DNA, 4987 bp, artificial
  synthetic oligonucleotide
tattttgtaggtgctcagaatttcttatcactttgtctgggcacatcgcctgcctacagcctagaatctcagagctaaaaggaaccttggagagactagagaggtcaggcgacttgctcaggctcatacaaacaggtgaagccataacttgtactacaacccaggtctcccacagtggcgatgtctttctcttacataacctgtgttgttgagcaagaataaatcctcgcttatacactcacacacacatgttggtgccctatcctgatggcgctaaggacactaaatccatggctgggtttcctgatgttgtctgccctgcctctaaattgcctcagttgttcccagagactggttcttgccagagtgtctcaaactgaaggacagcagctgccttgggtcttcccattgtgttttttccctcccttgtcctctccttgcctccccagcaggatttctagaaagcttgaccggtacaccaatacacgcctgcaacgacatggattcatccgccctcctgccacacatagttcttgaggcactcaagatgtcctagggtgctctctggggttgcgcttagcttacatttgaaatttaacgctgtgatccatggaggaggcgaatccctcccatccagaggctcaagaaattctcacaagtctctgatttttaaaaattttcccctccccatctccctctcctaccaccagcagtttaatttgtcttgacattttgcttgccctcactgtcagtcaggggcactcagtaattttaaagcccttgtagtttcaatctgattttgcacatttgagatgggcttttgagaagggtagaacttggaactcaagaagaccccatggcagaatctccaaaggggctatggaaatgtatgcatttgaggagcgggtactttcagctacctccaaaccatctggggtctgcccaccttctaggccccagcgtccccatcagaaagcctttgcaggcagctttcagaatagggcttgcacctgccagtcctcccctcagctccgcggtactccaggcaacctcaaggtccagtcactgtagcctgagtcagacctccccagtacccctcctgaacttcctagttgccccttttgccagagatgagggtgcagcagaggctggtgggagcaaggaccgagttgccgccgtgtgccgagccacccacctgtggaagaagagcaggatggagagcatggtctggtcgatgttgcggttgcagatgccctcgttgatcaggtagcaggggtcccgcagcaccggctctagcgaatcctgccgcattatgctgttgagcttgtcggtattgaggttctcaaagaccagcttttcctgcagctgccgaaagttgctcactgtagggctgcccgggttgttgttctccccgctgctgcctcgctggagcccactccgatgggccaggtccaggcagcagttgcagcagtcgaggccgacaggtgagcggcaatcgagcttggactgggccatcttctcaggctcggaggtcgcctggcctgcgaggtcaggggcggctggcaggtgcgcgcccaccgagctggcctgaggggactccagggtgcctggaaaagacaagctgtgaggaaaagagttggaaattagcgcctaaagccagccaccttcggctcggcccccttctggctgtactgctccgggtgcgaatagaaacagctggacaaacagctccgagcggatccttcgggctcacttcctcctcttcctccttctcctccccctcctcttgaggccgggggccgcccccctgaggtgccacacgcggccccagcgcagtcccaagtttcccaagtgtgagcggggattggggcggacctgtggaggcaggaagggcgggcagcagggcagagggagagccagggcgcgcccttgctccctccctcctttgctccctccctccccggtttgcaggctctcaggctctcgggctcccctgggctgtgacggctgagcggtggcaggagctgagagcgagtgagctagttagcggtctgcacgcccgggagtcagcactgggatatgacagcatgtaaattaccctagaggggacggcggagaacggtcctccgccacttctccggctggcgggcgggggccccgagcggctggatcctgtccctccacccctcgccccaccccgcccgcacccttgtgccctggcatccacgctgccgctcgcaccctcgcccgcgctcctgggagccggcccggctctcactctctcggcgagccggacgcttcggttcaggctctttcagcgctcatggcgcatcctccgccagaaatacgcacgcagcccacccgggctgccgtgccccctcagtggcccggtctcgcggggctcgagctcggcgtgagggcaaatgtctctagtctcacctcgaatgggtccccctacagaagagacgacgccctcgagagccccaagtgttgtagccttaaactgccgccctccaaagcccccctttttctggggggggggcgtgcaaggagagcggttgcctctgcagagagtcagagagtgccaggcacacattaggagtacccaataaatgccgtaagcaaaactcagagaagcacgctcaaactctcctcagtttctgtctctttctgcttacttaacgatatcgtcacctcctttccccagctcgctgtgtcctctcttccctgaacccctcagaggcagtctctgtcccggtttccctctgccccttcgccgtctctcctcagtcctccccttccttctctctgctcttctgcttccactcattccactatttcccttattttttctcttttctttacccatttcctctactttctcccccatttccattcttttacctttctttccttatttcttttctccttttctctatttcctcatttcccctttctcccctttcctcttttctctcatttttctctcccctacccccgccatttcccttattttcccctcatttcttacttcagcaccccctctttttcctcacttcacttaccttctcctatttctccaaatttgttgtccttctccttttctgaaccttacctgccaccttagttgatctccgtctgtcgttaccctttcaatagatgtagcgattgcatgttcacaggcctgaggggcgtgccccagctctgtaagatggagggatgttctgggtgggcaagtggtgggtttccagggtttctcaggactcagagacttggaatactttaaatgtgtaggattaaataacgattagtgtctgaaaaaactaaacttttcatgacgttcagttttcacgtaaaactgacttacatttcagtcagtactccccacccccgcatcggctccttcattcacaagtctggcctttgaaatagagcagcatatactgccatctagtgtccaagacgttgaacgttctctgcctgcgtcacagaagctcggagaggcaccagaggtacctcctggtggaatccacagtgcgttggttccaagagtagcagggaagaagtgtaggaggcggagctgctacactaagagagttctgtggccaagctaataggcaggaacacgctcctacactaagagagctccagctaataggcaggaacaccaattagggccagagccgcccttttttctagtggagcttcacttggcctgagtccctgcggattggacttccatagatttgaaacttcctccgggtaccacaagcatcaggcctgtgattaagagcaaagagcggccaactattgtaactcttattcccaaggccctgtgggtcctatatgtgccctgcaacttggggaaaatggaggtggggttgtggtctctatgctgtagcagccggaaagccaaaaacaagccgtacttctcgctcttgacaggatcccaaggtcagaggtgaaagaggtgctgggggtcactgaccatacctgcaaaactgagagtatggtcctttcgttctaacagactgctgaggagtctctatttctcctctcaaaagcaaaccctttagatgtattaatttccctttttcttcttcttcgctttttttttttttaaatgttcttgggtaaaagccagaggaggtagtagaatatgaaatttcatctgcattgtgtagacttatagtctactaaattgttttgtaattacagtgtttatgttttttcctcttgtttataattatttcatgttaaacgttatagcaaaatatattagacccataaatgtttatttaagttgtgttttgtgaactgctgggacttttgtttctatatttgcctgagtccttttatctttgtgcataaccttgggatgaggccctggtagaagtatttccttcttggcatttggcaccattaaactcaagattctgtccccttgacatttcccttgttgtagtccttgctctcaagcagtattgttaataattcagtacagctttccatactatatccaggttgatcaagagtaaatataattgagatataaaaaaactacatagttcagagatagagttcaggagctggtatgtatttgcatacaagtccagcttgtattgacatattgcacacctcctcaggagaaggctgactgggcagggccaccttggctcccttctgtgaagccttgctttgctgacatatattgcgttggatggagagactccaagcagcaaaacgttttgcataaactaagaaagcggaggggggcccccacttccagacagagctggtagctttctgggtggagcagaaagagggtataaggggcatctctttcttggatgaactcattcaacagtcactgtgtgcttgtcctgtgtcaggtatagtgtaagtggggattcagaggtaaacaaaacaggacaaactcccaaagacttcatggtctagctgcagaaacagagctgcagacagacaa

SEQ ID NO: 6076 - DNA, 2921 bp, artificial
  synthetic oligonucleotide
accggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtg

SEQ ID NO: 6077 - DNA, 6681 bp, artificial
  synthetic oligonucleotide
tgaggcacagcaaatgtgacttgcctgtcattactagtgacagagaaaaggaacactcaaggtttctggaatttatcctgtgtaaaaacaaaaagaaaatcaacacacaaacacattccagagccaaatactgtcttcttttaatcacctcctgttttggattatttatgttttgttccccccagacattcacgttaacaattgagatttaactttcttggtaaatcacagcaaactagcacaacaacgactgctctttaaaaagtaactttcagaggagaaaattatcctccctaaacataaatagttgattattactgcttaatagtctgtgctcttattaaattcctacacttaaatatgggcatttgcagaaaagcagcttttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacataattagaaaaggctgactgtctgggttcagcaattatgccccacgaatctggtagtccttgagtagagggagctggtgtattgctctctcttttagtgaagtccatgttgacgtagtcactagagctgtcagcttctctctgctcatgtgtgggcttttgtggttttggcttgattttatatccttttgtaataaaagaaagtcggttaggtctcttagctttattctttgggggctcatgatctgaaggctttgaaggtgatcccccatctccaggctttgagaatgatccctcacctgaaggctttgaagctgcatctttggggtcccagttataggagacttctttgtctaggcccctccccaggaactttccaggtaacattggcacatactcactgttgtcattctgtcccaaaggtgagctccgaaaagggtttggtagagagaagtaggagctccaacttttggaggaagagccaccctgaggatttctggggttttttggaattgcaccggctccaggagccataaacatgtagtcactctcactgtcattgtcctttgagtcatcctctttattagtatcaggtgcttttggaggactcggagcaggtggtgggctcactctgggaaacatcatcatgtaccctcttgaatcttcaaaaggggatcgagagtggcgcttttttgaagcagagacattttgaggagccattggcatataatcactggagcttacaagaggggtggccacccctggcctcattggcacgtatgggtcatcctcatcttcatcaaaagctctggctctgtggggacctcgagctgcaccttctgggatctctgcatctttcacttctttggcttctttgcattctttcgtggctcctctgtcaacacaaaaataaagtctgaatcttcccccagacttcccttttccaccagttcctccagctggtgggggtggaggaggaggtggtggaggtggtggcatttgctgttgcttgctttgagttaatttgccaaaataggatcttttcttcagagattttccacgttcaccatcaccatcggatcctttcccacttcctgagcctttgccccccccagagttcttgccaccacctgagccatggccatctccaggtccctggccaccacctgagccatgcccacctccaggtctctggccaccacctgaaccgtgcccacctgcggtgccctggccatctctagagcactggtttcctcctgagccctggccatttgagccctgaccacctcgggatccctgtccctcgcctgaacactggtttcctcccgagctatggctactggagccttggccatttgagccctggccacctcctgagccccggccatttcctgagccccaattgttcataggcatgtagtcacctccgcttccttcctgatcttctttgccctggggattgccttcctccccaaagttgccagagccagaaccagacacttcagaagacaggcgagctccattgttcggggcttctgcagggtgccggggacgtgctgggctgggtgctaagcggcgaaaaaagctggccggcactgaaaccgctctccttgacctgcgccctctgggcaggtgcagtcttcctcgcctggagtgggccacaggctcgctgggtgttacgaagcgcctggtgaaaagcatctcgtcttccccgtcgccgatggccctgaggtggcaaaactgctcaaagcgggaccttctgagccagcctcccggctcgagcggcaccaagcccaggtgcctcctagcggacagcagggttaacaggtgggcgccgatgctgatgctgtagctgcggcagcgggctctgtattcgtctgcacacaaggctctcatcttctccaaaaacagctcatgcatgttttgggcaaccacacagtcatcgacctgcatccagagctctcccggaccgatgacagtggacctgcctacttccaagaagaaatactgctccgagtgtccacagcgacggatgctcaggagctggacgaccacgctggccacttcggtgttcagcctcacaaacacgacctcctcgtcggttagacacagccggaacacgccgctcagctcttttctgtgccccagccccctgggtttgactattacctgccacacatctttatagaagggtggctccgccgccgctgccgccgccagcgcggccggctctccgtccggctgcgcgccgagcgtgccgcagcggcggcgcttgctctcgaggatgaggcggctgagcagcaagtaccagctttcctgctccgactcgttctcggccaccatcgcgaagtattcgtcttgggtgaaaagagcaatgaggtgtcggtaccttgcatctgctcgctggctcacggaaaagcactggtatagggtgatcacgcgccgcggtggaatgagcggggggatcgcggcgccagaggcggccgccgctgctgcagccgccgcggcgcggacactgtgccggaacttcctggcattttcgtagtattccagccgagctggggcgtcagcagtctcgagtttgagcacgaagtagcgcctgtgcccatgcttctgtttccgcaggtagccgcgtttgcagacttcctccccgacgggcaggtcctcctcttcggactcggagtctgaccgggagccagtggccgtggagagccacatggctcccggacaagacgacccggtcccaatgagtgcggtcggggttcccgaggaaagaagcggggtggtcaccactgctgctagagctgccgctgccgccgctgctgcacctcttagtcttcttgtcgcttggtcgcgagtgaaggagcaactcgccatggtgatgcacgatggttttaaggtgagcgaggaggagggggaattcaggaaagggagggttgggggaagaggctgtctaccctcgtctgcccgccccagccccctcctgccttggcccgcgcccccgcccactccactctgagcgcacgacagcgggcaaaacaacacgtgaccacagcctcacgcggcggccgctgcggatcctgctaccggcgcaatggaggggcgcgagcggccaccagtagaggtgagcaagggaggagacggcgggctcgggaggcggagccacctccggctgtgccaaatcctcccggtcaatctccaggcctgtgggccaagggaggaccgagaggaggaggcgggctctctggccaagctgattctaacagggagtccaggaaggcatgagggggcgggagaaggcctggaggggcggaggagaaagcggccggctatcagggtcgggagagggcgccacagtcggggccccattggtgggaggtggtgggagggggcgtagcgcaagcagtgcctgcctgcggcgccagggtgcagagcgggcacagtcgcgggacagtttgtttgtttatttgggaagcgggagccaggtgaaactgttgcaaggctctgattggttgggataggagccaatgggagggtccggcaagaaggcagccccgaaatcattagtttggcgggagggaggggtgagaggggagaggggagagggggcgtggctggggtcccaaagtggcttcgctgtcggcttgtggcgctctcaggcggtaaacaaccttacgcaaatagctgttaatggtggtggtaaactcgtgcaaatcccagagccgtggtgacccgggatggagtcgggtgccctggtactccctgtcaatcacataaattctctgttcctgtcacagtctggttcattctttccagccgcacaaggcggcggatcgagcttcttgggagaaagtgtcggcaccccctgaaaacgggttgacgaccagggcgctcagaactgcttcccaccgctctgcaggcactcccgagcccgctgcacccctgacagaagcccgcgactctgaggcacacgaataacagcgatgcattcaaaatgaacatgatctttattaatcagaatgcacttctagcccacgaaacacaggttccctaaatacagtgtttctgcctatttgattaacgatgactatgaaagcacaaatttgggggcctgcaatgtatacagccatattggaaaaaattggactcgattcttactgaaataaccagtgttgggctgtgaaggtatttttctgtgggaaatgctttggaaggtgcctttaaaagaatctcaaaatattgctttcctttccttgagcgagaccgaaaaactttagaaaaagaaaagctcatacctagaacaaaggaccacgctgaatgcatattctagagcacatttcacatccctcgcgtcaacaagaagaagaagaggagctttgatgcatttcagtctacaagttgacatcacaaaagtaagaactactgcctccctcatttctggaaaaactgccggagtgtaagtgcaacctcctcaagtctctctctctctctccctctccttctccctttccctctccctctccctctctcccccaccaccccagttattacttgactaggattttagactcttaatggtggagatgggtcgtgaattatcaaaggagtgaccaggtttgcaaagaggaatggagggagaggaggagagaaatacagcatttctctctgaaagaatggaatgtcagttcacccttgctctagggttgatatggcaaagggtactatttataaaatccaacagtaaactaggcaatatgtatatcataaaaataaaccatatttctgccctcttaagaatttgctctgttagaaacagaacacacgtatttgaataaatggctcctttttgatgctataatttaagagaaaaagaaattggtttgggttgtcccccagatattacaaatattcaataacattccctctgctgccaatggtttataagtgcaatatattcacaggtgctggaagcagccgtggtttcggaagggagctagaggcagaacgagtgtggatgctgagagatccctgact

SEQ ID NO: 6078 - DNA, 1189 bp, artificial
  synthetic oligonucleotide
gtaatcctcagcagaagatggcatagctaccaaaaatcaggcgttaccactgggatgaaaactggggaggcaagaaaatcatacggttggagtcatagatcatttccctccccgttgagcactcctcccccttccgtcccccattaagttcattctatcccacagactggtcctagtgtcctgctagctccctgctgaaagagagagggagggaaaagatgtctgaggtctcttcatttcctttgtctctgtccctaaggcaactggaagctggagctgctgcagtcggcctggcaagcccgttggctctgcagagtgagcagtccctggcagcccctggagcagctgccagttagacggcccagagttctgatagaatgcattgcttcagttcagtgccaagtgttggacgtgttggattcagttcccagagggctggagcgtgctgtcagggctgtctgaagacaagagagcagaggcagtttagtgcagttggatgtgcggggtaggggtggaggcgcaggggtgaagagggagaaactggcccgaatgggtaaggtggtgcttctccttccagggccttccagacaaggtctcctggcctctcaccattatctgggcctcagatgaggcgaaccctggaagggagttgggggtggaaggtgggaggcgcgcccagggatgagcgagatgaggagggcgcgaaccagcaatctggggctgtggttttagacccgctcagcgccctgggcgagggcaggcagcccctcggaggcaagctggcggcggccctcggcctgggagcccgcggcagcctcggcgtcggcggtcagggcgcctcccggggcccattcgtgctcggcgcaagcctgggacggctcgtccttggcctcgacgagcttacgggagcgggtgtaggccaggatgaggcctccggccaagcaggcgtagaagatcatgatgagcaggatgtagagataggcgtcgtcgcccttggcgctggtcacctcgcggcccacgaaagggtcaggcacgacccccatgcccatgctgggacgagggccagcgcccaagccgctggcattaccccggtggtgcagctcgagcaacaggcggctcagaagggttcgcagccgctggctctcgctgcagttcatggctttcggggagtgacacggcggctccagga

SEQ ID NO: 6079 - DNA, 1563 bp, artificial
  synthetic oligonucleotide
ccagaggataggatagggagcctttcgcccatctaccctgctacattaactttaccatgtattcatcagcaaaatgagaaaacaggctcaggaatacaggcagtgattaaggggactgcagagtcccttgggtagctcagggtggagtacctaagtgacctctcaaagcgccagagcataaagaaatgcaggccgagtggggagggacgagctgtgagttcgaattcagagacccccaacttgctttggtcagaagccttgggccccacctccatccaggttgctaactgctggagcacagaacaggttggggtggcaggggaatttggggcaccctggggaaacttccagggacggctccggccaagagaaggcaacccacctgtgcaaaggctggaaaaggaggtgagggaagcgggcgccgggcactgctcactaacctgggcactggccttctccgtctgccacgcgtgcacgcgctccgagctccccggggcgctctcgtccgaggtctggggctggcaggttgtggcgagagctagagtgcgcgcgaggggggagggggaactcaaaagtgggtgggaggaaaaacatcaccgccctcacaccacgagggagcagcggcttgctcggctcccgggggcagagccaaggcgcgggcgcggcggcccggggccacctgcccgccctcccgctcgctccccacttggcccgagaagccggccgctcggcgctggcgggaagtccgcaagcacgcagccgctgcaagcacgcacactttctccaccccggcacaatggctttatttctgctcccccggcccgaaagtttaaaaatcgggagaaagtgtgagactcagccggctactttcccatcacacagcgcccccactgcagcccccactcctttggctaggcgagcgttggggtcttaaagggaccgcacagctcctccggtccctcctccccctctgcactggatgcacctaggagctccccaccactcgcgcacgccctgaagataccgactaccctctgactcccctgcctggaagcccacacccgctctcctccggcaccaaggcctttccgaggtgtgcacctggtctggtactgagctggtgccctggacacagaatgaaccctcctcgcaaatcacgccctagcatgctgcttatcatttcacggcgtttcccatatccacactgtggctaacagagtgacaaagctttggtttggtgtccttaaaggcggggtggagatgggtgtgtgtagggtcagggattagaaatccactttctcttacaaactgggctcccaagcctcatggaaagggcctgttctaactgttaagtgtcttgaagaaaacttggtgccacacactatacccaccattttttttttaaatgagtccctaagcttctaagttgggccaagagctcaacctggaaatcacagtagcactgctgatgccttggtgggcctgcctactccaaatttgtgtttattcaacaagtgatagttgcaaagaattgtcagaaacttctagggtccaggaaagtgc

SEQ ID NO: 6080 - DNA, 3977 bp, artificial
  synthetic oligonucleotide
ttcttgttaaatgccatgaagataaatatatggcaatagaaaagtgggtctgggtgtgccatgtcaatgttgtaatcatttcacatttgaagccaagggttaacatgcacaatctctaaaaagagcattatcaattagtctatgtctctcctactcttataataaactcgggtaaagttcagaggttctatctttcaggctggtttccccgcttcaggcttttcctgagggagtaataaccttgctaaacacttaaccatcaccaggtacatgactgcgatccaaagagcccaggttgtaatagggaaaaagcccttctagtctcattctaagagaccatggagaaagatcagcatctgtgaattcagctcagtacctgcatatgtgggacatgatcatgaccatttgtccgagtcgatgtgtgtctagggagggagggaggtgtccactttgaagcagagatctgactgatgcccctccatttgcatttcttggttcctttaaggaagacaggcaaacaaatctggccatttcttaagtttgaaggatacaagacaaagaaggtaaatggggaccctggttcctgaaccttcatgatccggctcctggctctctatttctgaaggtggcttttgacgaagggcaggtatccttggtccgagggccacactaatcgattttaaggaggcctgggagcaggttccccacggatcttaaaatctacccaagaatggagcaaatcattgtccagggataggacaaagctgtggttcaggaaaatattcccagtgaaaggatgtttttggtcatcgcaggcagcaccttgtcctatcaaccctggagcttctccccattgcatttcctcttccaaaacaatctgttgctggcctccctctgctccctaccaccctgagcccacagccagccagtcaatgcttctccgcctacagcagcccagcatcttcattcaacccgcacttcgctgccccttgcccctcagcagcactcaggcagtgaaatggaccgcaccggccgcctgtagacttaccctgagccaagtggttttttcggataaaatctgtgtcgtctggatgtccaccggccaggatgcgtggtgcggcgccttgccggactcctcttttgcggcgcgaaacagcagccgactgggacagcccggggcctctaggctgatgggtgggtgggcggatgagcacagggaaaggggcggggtgtaaagacgagcgcaagtactggctcctaccttggcttcccctttggatgctcagttattgccaaacttgcctgtaacagatcggccctcctcacctttcaccttcgccagtgccctgaaactctttgctctaccaatgtccctaccctgttctcccagctctctaacccaacctgagccccttcaagcgcacccactcccttcacgcagccagtcacacacaataagagctagggaagaaactgacacggggaaactgacaggggtagctgacactgtagtgtgaaggagagggagaaggagggaggaaggaagggatggagagagaggggagagagagagaaaaaaagagagagagccgcattcacactcttacacgcacactcaagctccagctgttaggtagcggctggcgggagcgctggctacccctccaaaacccttttctacactagaggtttctgtccccttctgctgccgtttctggaatatgctatacagagaaggggagagaaaagcaaagaggggtggggaggggaaaatcaaggaggcacgctccctttatcctccccacccctgtctccaaaaatgtccaaccctgagctcttccttttcccttctttctgcgcccggcttccctctgctcctgttctttattcctccctttggggtggctgcgagctgcggacaacccgtcgtggttgtgatgtggggtgtgtgtgtgtgtgtgtgtgtgtgagagagagagagagagagagagagagagagagagaaagagagagagagagagagagagagattgagacaaccgtggtaggcaaaagcacccctcacctcccccagcccccgggccgaagccactctcaatctcctggcggcggggcggggcgggggaggcggggaggcgagagggaaagagggaggacggggcaggcggcaggggcagcagctcctgccttctttgcagctccgcggccaggggtggaaggaagccgcagccgcagccccaagtcaacccccgctgccccgtcccaccgtctcatctctcccccctcggtacggaattttctgtctcgtttgtttgcttccccagacctccccctcccctgggtggtggcagagacgggaggggaggtgggaggctaagcgcgggtgcgggtagaggggacaggagtccctcggagcatatggctagcagagtctctctttgccccttggcctgaatatcccctgctttgggcagtgacctttgcccacccccgtcagcctgggctctgggccggtggtggcgaggctgctccggcgaccataggtcattcaggaggaaggggagttgaacctgggggagtaagggcggcgggcggctggtaggacagggagacagcggagcgctgagtcgccagggactgacctggggtcctatggggcaggcttggatccctgatagatctagattaatctagttggagctacctaattctcccatccgtgcccctctcacccatagggtcgatctcccaagatccagcctagattgatacagggagggaaagtgatattgtaggatgggggcggggggctaggttgcttagtggtatctgttgtggagggagaggggcggtgtcaccggacacttgggccactctttgatctttacgccttcctttcacatgaagcacctctccacttctttcaccttatagcctggcgctcagaatgtccaccctcttgagcccaactggaaggggctaaatagccccacccccaccacaagcctgagacttctacctgcaacctgcaggcgcataggtccactagctggcagcatttcatggcctggccgcacagccccaaatattggctttgtcttttatctcccttcctagcgctctcaggaaaggggcatgtgagtctctgcctttctggacgccgggctggtacctgaaaacctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtggaagccctaagcactctcctcctagcctaccttggaaaagtcgctcggggcaccaagcaagacaaattttccccttgtcgttagtcctcctagtcccgaggcagtccaatattctggagagtatttagcttttgtatgggagcaaggtattggagaaaagaaaattattaccctgggggatgaagagtttgtgtctggggggaagggagttggggaggaagaagtgagggtggagcttccacctcttaacaacttaaatacttcaggaagtgtttctaaagattggccaagagggtcgctgaaaaaaaaaaatcacttgattctttgcctttcattcaaaggcagttttactgtgaaccagcaaactaatatacagtctcccaaacaagggaggtctatgttgtgattaagccgtcttccctttggcatgagggtgagtagaatatgtgaccgtggataaaactttgggggcatttccctttttttagccaaactgcagtccagctgagacttccactccaagcccagatgcaaccagaagcagtgctcagggagagcaaaagccttattcttgtgagctgtttccttcaaaggccctata

SEQ ID NO: 6081 - DNA, 4096 bp, artificial
  synthetic oligonucleotide
ctctgccgagccgcagcctagagaacctgaagaggcagtacgcgccgcaaatgccaagaaagcagagccttcggtcccggcggaacccggtaccccgagcctcgccgcggaccgctccggctcagtcttacaggctctgggccgctcggcgagcgccgctcaaaggctaacgtgcctgcttgtttctacccgacctccgaagcccagacgtgcttcagcaagccgcgtggctagcaaactttctctctgctgctgcgggaaccttcccaacgaccacgtgggtttcacccctggtcgctctcggcacttttgcctttcacaaggagaaggagagaacagcctttagagcgaaatatataataataaaaactattattaccatcatcctcatcctcataattgctattatcatggtcaatttctccaagccggttcccccgggagccggggagcgagaacaggttttggcggatgctaacttccactcgctgctcggcagatccattttggcttagcaaaaatatcacagggatttatatttacattttttgaagtaatataaatgtctcagcctctgacaaaataaatacgagtcccgccagaaaaggcaagactaagcattccacattcatagagtaaggggacacttggggagtttttaaagatgagtgcttaattatttaaagagaagacatacgttttctcttccatatttataaattactgttcgctaccaaagcatttctaaagatgcgagcgttgtgcagtcggtggacttggcagcgctgtcgcagccacctgtgcggcatcatacagcagcattcaacagatgcttcaagaaaactgcgatgggtttttgcttttcgaaacagaacttgggtgccgacagtatgttcactgccaaattaaatttcaaagcctgaattcagtggcgatggagggaatcagaggattcccaaaatgccccttttggaatagactggacagctcctttcacaaatatggaaacagaggcacagagagaaatgactgttcctagggcatccagaataaggaaggggcctgacccttatcattgcttccacttccttctccatctctaacttttggggctactgaggcaaacttcggccttcagaatagccggcagctcccaccccttttgcgttctgccgggttaggtcctccaagcctctctctgtacggcctctctgtagcctcttctatacactcgctgcgctgccgtccggtcctaagtagccaaaccggaggctcgatcttttgcttcggtccagctacctccgacaggcggggagccaatctccacttttcccaccccggtcctcggtacagggccgagaaacctcggccgcgacccgagaccaccacccccgctcgccccttcgttccctcttaggagagatctgcttctgtccccattctccgtgggatcatctccattactcagcttggttttggtgcctctgagccaagggggccccgttcacccttctctgcgctgccgccaggacaccgcaggcacctgcccggttgcgcctgggagcctgtgaaaaagagctctgcctgaccggttagagctctgcctgaccggttgcagctcggcatcccagcagttgccaaaagagagcctttgtggttcacctcttgctgccttgaccttgcattgacagcacccctccctcccccacaacgactgggcaaccgactggctgtgggcccaaggccctgtgccagagagatatgttcacccccttggaaacccgtaagagctgccctcaagttgtctttctaatgaggcctgtggggtcaagaaaggaactaaactgtgccttcccggggctcgaaggccaagagcttttctttctcctttggggttagggaaaggatggggagacaaggatggggaagtgggccttataacaggattgtggcctttgcgcactcaccaaatgtttgaccctgtgagtgcctcagttgctactgttggaagaatgggcaagagtcggaacagagacccttgaagggagtttcaaagcttgatgaaatttgcaagacttgagaatgctgtttgttgaaatgaaatgtacaggggtgtgtgtgtgtgtgtgtgtgtgtgtgtgtgtttggggaggggtatgctatgaatctttgagggtacattcttgagaaagccttccctctctctctatccggtgccatggctgatcctggttccccctactctctaggccttgtgaatcagattaatcatcacccccacccccatctccaccatggggtctcgcgccccctgccagcaggctccagatgcactaagagaccggtccaaacaggcccgggggccacgtaatgctgagtgctgattggctgctcttggctcctcccctcatcccgcttttggcccaagagcgtggtgcagattcacccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcgg

SEQ ID NO: 6082 - DNA, 2199 bp, artificial
  synthetic oligonucleotide
gcacatggtaggaccagctgagcagtgagaggagggggaagcctgtccattcgctacaggacttcagacttgctctgtagtgtggctggattaaacatagaaccatcaaatctgagctggaggggtacttcaagatcatccaaggcagaccttgccatttaaaaagatacgggggaactgatggcctaagagagaaagagactcagtcaaggtcacaaagccaatctgcagcagagctggaaggggaactcaggtctcccaactcccagctcagtgttccttcgaatacggcagaaaagaaataagggagcctttagggcagccttgggagtctgcacgcccttgactctctcagcctgatacatgtaacccaatcagctcaccatggtatctacacagaaaaagtggacccagcccatgtcccaccaacccaagagatagtgccaaggtgtcccaaatagacacacagaccccagtgcaggaactggaaccgatccagcagaggggcaatctagacttcccttcccggtagggctctttaaatgggtgttgtttttcttgaagggtggagagggggtggactttgaggaactagccaagggcttggcctccatctttgctcccccatctttgctccccccggccagaatgtgctgcagttcccttcagagggatgtctcagcctccagcagccattctggtccccacctgcctctttggtaagggatggagctgaggcggccagaggagaaaagatcaggcaaaaagaaaaaggaaaaaaaaaaaaaggcgggggtggggggctttctctcccctggggctctgagtagacaccctcgccgaccataaaaattccaaccagcatacccaaaataaataaataaatgaaaacctatcttctggcaaggatgcagctaggggttgaagaagtggaggcgggggaggcggcgatgactgctctagtccctcgctggccgcggtaccgggaaagaagagacgcctgcactcatctggccaacccagcctggggtggccagggaaggggtgtcggctggatgagggggacctggcttctcctggcgggttgggacaggagaggaagacacggaaccagacactggcttcttactctatcagctggacaagttggagagggatctagagggaagagccgggggtacaaacacacattccttactttctctggagggtcgtggccgggctggtgctggtactggtgctgtggcctccgccggcgccgggactggagctcctggatgcgccacggctcagctggccccgctcccgcggtggccgcggccccacgcccaccgccgccgaatagcccgcttccttctcgcggcccgggtgcgccggcccggcctcccgcccgccacgctcgcgacccagggctgggttctcgtggtgcaggtggcactgggccacgtcacgctcgcgggctgtgtaaccggtagtgtcctggagcgggtaggaggcgtcccgctccttgtcccgatacacagcctcccgattctggtaggcgccttcccggttcgggtagcccacgtcccgggccgcctggtggaactggctctcccgcagctcgcggtggtggaactgggtctcgcgcaggttctggtactggctctcgcggcccgggctatcccgcgcgccgtgggggtcccggtgcagctccccgcggtgcagctggctctcctctcgcaggtcgcggttctcctgggtgagctggtccagctggccctccagctcctcgatgcgccgccgctgggtttccagcagctgctgctggctctcgatgatgttgttcagctccagcaggtactccacggcccgatttgggctctcggatcccgggccgcccgggggccccgaccccgcctccatcctggcggcccaggggcaggggaacgggcaggagagccctgtccccgctctctcacggcgccaccctcccccgggcccagccgggggagggggccggcgggacgcgagggcgcgcaccgggcttgagggcccgggggccctagggggcccgggagacagcgctggggccggcggcacggggagcaggagctgaggctgccgccgccaccaccaccaccacagccactgctcgggaggacgcggcccacggcgctccgcccgctgcggagtcactgcgcagcgcggccgcgcggg

SEQ ID NO: 6083 - DNA, 4948 bp, artificial
  synthetic oligonucleotide
caacacccttcctgcactcttacgtgtgggctctctttctctctcgcccctctctctcgcccctctctctctcccctctctttcgcctctctcttccccctctctctcctctctctttcctctctcctcactctcactctctctgctgctccaattcaatttagacaacactaacgggattgcctgcagtaaaaggtggcccaaggtccacacttagttggttctgtctccaaattgaaacatacaggttagaagctcctccaaatatacataaggacagttaggaatagagttgggaggactagaaacaaatgccttggtcccaaaggaaaggccttttctgtgtgggaggacaacactctcgccctggccagctgagcaatgcagtttctcccgctctaagattcagcccaggcactgagggagggcactctgttcttcagcccttgtgagggctgacattaaaaggccggaaattctagggacgagggcgaaccgaggttggaagggagccaatcggagggtcaaagacttcagaatgaaaacagcttcgccaaaatgttaaaggcacctaagcagacctgtcggctggttttccttctcttacttttatccctgcgctggcatcggggcacatgaaacagctctgttcattccctgtgcagcgaccgattttaggcctcctgagaagtgcccacccactagctgccgctggctcagtcgcaaagagctgggttcgcagtatttcccaccgccacccctcctccccgcccttccatctttccgtctgcccgggctgagagccacgcagggcatccaccctgtcatttagcacctcggctacgcaatggtgggtggtttcccaaagcgcgtgccctcgcagccactcgcgctcgcctcgccgcttgcaggggcacaagtcaatgaggcttttccctccgcgatcatggtgaatcagcaaagcgctgcagagcagcggcacctccacgagcagaaattaagatgctgggggaacggcacgagtggagtgtggcaggggaatttctagccccttccaatgtgtccctcccagggacggcgatactgggggaggggagtcagctggaagctgctggacttaggcgtcgcggggagcctctggaaacagagcagtgtagggaataacgaagatgagcacagaaagtggacgagaaatgggtggaaggatctagggagcacaagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtccctattcgtcttccttcagctttgattaatatgcatgtctatgctccgtagtgcgggccaccgcctcccgttcgacccctggcactgggagactgagctgtagcgaccaaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggta

SEQ ID NO: 6084 - DNA, 2828 bp, artificial
  synthetic oligonucleotide
ctcggtggtggggccgcggatacctcctcagccgcctcagctgtcggagttcaactggtgggcggcccgtcccgccgtggccgccaccgccgggtcccctcagaggcctcacaaagccatgctccagccgcccgcacctgattgaccgaccccgggctctggctctgcctcgcgccgccaccgcctccgccgccgcgcacgcgcacttcgcgcgcctctgttcccggacggcccccagagcgggaacgccaggctgcgagctgctggcacctgtctgcctgccagacagaccctgggctccggcctcgtgccggcacgcgcacgcgcacgcgcctcgcgcgcctgccgtcggccctgggggcgggaccgcgcggcagcgagcgggcggggggctcgtggcgcgcgcgccccgcacccgagggctgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacc

SEQ ID NO: 6085 - DNA, 1953 bp, artificial
  synthetic oligonucleotide
gagttgcaattgttaatgtttgtatgtaaaagtcaggctcaaagcaaatttaatttctttccacaagttcagtactttgcgaacattttattaaccttttagctatattatttaatgcaaaaaattttctggggaaaaatatgacgagctcttgcatactgtttttcacactacccatctaaaggattattaaacatcataaatttggctttttaataaaatatttatagtattagtctggttaacaattttaaataaagttcttgtgattctgccagtcttaaaaacatgatttcctttctttctttccttttctttcaacatatatcaatgtcttttccattgaagagcagcatttagttcaggttttacaagtatgatccaagtcgcaaaatactaagcaccaatcataagcactattacaactctgcgtgcgttaaggagaacaagcaaaattgttatacagcagcggaggtgactgggggaaaaagtgaaaagcgatttgaactgatcccccgccctctccattataccggagaatgcaagtgtcccgcatctcaagattaaactgagcctcggttttactgacgtaaccagtaaccctatctacttctcacactgcggaggccggcagggcagcggctgccgccaagcacaccactcatcagagcctgccccgttccacccccgcgtttcagtcatgctttccagaaatggggtcactcactcagtaactattacacacacgcagcctatcatcctgtaatcccctaaagtccgctgcggggagagaaggcagcaaaaagtcaagaaggaagaatcacagacgcgccaccatcaggaattgattttccactccggagaggagcggtgataccttggaacgggtcttgtctggattattttcgcagaccccgagttgttctgggataggggcggttcaggaaagctcggtgtagtgatgcgcccggggaaattctgttttgccctgtttgggtatattgtttgggttttgggcactaggatgggtgactcagggacggtcaccagatcccgggcgaggaaaaccagaaagccttttacggcggccgctgatctccttgaatatcaccctctcacctccatggacaggaaactcaagttaaactcacagggacgggggtctagctctgcgacctcagaaacggagggggtaggggaccttaggcttccgctttcttctttgcagcagcagaaaccgctgcggcagacgagggggaggcaaaaccctgcaccccctacccgaaacccccacaggtcgccgccgcccgtgccccgcgcgccggtctccccgcagcagcccctccctcggctggactcgagagtccctgctccccggtgaacccgatccctacccctccctcatctcccaaagtcgccaaggtccgggaaagcccccgacccggctgggccaaacttcccaactccccgccggcccccgctccgcctcccgcttcccccacgcaaagttgattaaaattggcttcttgcaaagccccagcgcccactccaaaccccacgcgccaccacactggcagccccccgagcgagggaaggaggtgagggtgaggatggaaggaacagacagaccggccaatagacccaccccaacaacccaaaccaaaaccctgagcccgggggaaagacgcgagcgggatcagaacgggccgagtggccagctccggggagcgaagcgagccggcgggggcgcgaggaggagatgcgccggccccggccgccctgctgcactcacctcagcgctgtcggacgggctctccacagccatcttctgccacgggtccgccagctgcgccagcggcatcttcccccccggcccgccgccttcaccgcctcctccctccccgcccgccccacggccggccccgctccgtcgccgcccgagccccacggcag

SEQ ID NO: 6086 - DNA, 1545 bp, artificial
  synthetic oligonucleotide
agatgcagcttgagtgtttcaagcaaaaaggataaaaacaaaagcacacatttcaaaggtagttataacgttatcctgtgacagttaatgaattctgcctttaaaatagcataatgaaaaatacaaactggaaatgatttaagctatctcctcctcctaagaatgatgcaactgaaggcccagtcagaaaatactacctcgccccctcaaccccagtgaaaaagcgtgttttaagaagatttctcttgatttctttccttttcttggcccatcgtatataaaatactcccatcttcactatgtgataattcatcgaattatagttttgtgtggttttttaaatgcatattagactgcaataaaaaatgttttaaaaatagcctgccttattaactaaaaataaaaaagttgttgtcaggaaaaacagcatgaaatcggtttccatgctgcttacacccccgcactacctgcaaccactttacagaacgttagcatcagacctgcttatctaaaatcctgccaaatgtcctcacagtctcctccgctgcctcgctggcttctgggcagccagggaccagccctccatggctcccagcatcggcagcctcgagggctgagagccttgtttgccccgctgcctcgattgagggccgcggcccggccacctgagcagcgttcccaagacagggagcgcatccgggcgggaggagcacccggtccggggcagacgcctggccgcccgggcgaatctgcctctgccaatgggtgacacgccgattttgccccctggaaacgccaagaggcgcgaagctgggccaccttcgccgcgggctgcagcggcgctcgcgcgcgtttcccagaacgcagagagagcgcgcgcggaggccggggcaaccccagaaccccgctcggtttatcctaacgacccccatgccggctgctcctcgaggacggggactggacccgcagcaccccctcaggcacctccatcccaaacacacctgccgcccaccctaagccaccccccatgtgtacccactcacccaggtcgccccaagaaagaaccccgccactcgcacagagaggggtgcggcccttggatgcacgtccggacgatcctgggccagggaaagggcgtttatctcagctctgcgccgtgccccttccccccacgctcgaggacctttgccctgggccgccgggcccgcccccccacaggaacccgaagccctcgggcgcccgccacactctggggataataccttgaggccggtagttgggctgagaggtccgcaccgcgcccggttctgcgatcttccctgggagagaggttccccgcgcagtcccctcaggccgggatcccgtcccggagccgccgccgccgcgctccatcgggatgcgccggccgcacaggcgcactgccaagcccgccgcgccgcaccgaacccgcgcgcgtccgcatgcgcacgcgtcctcacgcagcacgcgcgcagggcgtgcacgtgcgataagcgcaccggttaccacgcacagcgcacgcaaggc

SEQ ID NO: 6087 - DNA, 2589 bp, artificial
  synthetic oligonucleotide
taattaagctcctaataaactgttaactgttgatattaataaagtaataaattttgtcacaccatgcatgcctgggtatgctcttagacttatctcttcagatagccaaagaggagttgagaaagattggagataactgcaacatctagctagtcttcccttaataaacctctactctccatcacccaccatctcaaaccctgatcaaaaaatgggttctctttccacgtatggtgactattaggatcagctacataatttgtgggacccagtgcaaaatgaaaaggagaggccccttgttcaaaaattaagaatttcagcattaaaccaagtgcaggatgcatgtccatgaagccagccctgctatcagatcatgtatttggctagaaagttggtaagaaaagtaaaatatttcgctattaaatgagtagtgaaggaaatcaaatcattttaccccaaaatatatttctttgacatattttgaaatagttgacatatttctaaatattgacgtatttagaaagccagccagtagagctaatgcaaagctgtccttggtgcggaagatttgcatttgtagagaatctgcacggatgtagccaggctttatcgaggtcctcccttgtccagatctaagagaaattaactgaggatctgacccctttaaaggtctgaaagaaacatttactgtttattctctctgagggctgccacctgtgaggtttcattgacatctccagaccatttttgctggccaagcctcctcttctccccctctcacaacctcttttaccaccataacctgtttggggccatgcgttgagacccctttctttctgtaacctcaagataatctacatgcttctgtaccccattggggggctgggggtaatcactctattgttctctccccgtggacacattaatacatttgcatgccttttctccaatcaatctgtctttgtcagttaatttttcaagcgaaccttcagggggcgaagggaaagtttcccttggcctttatagtagcaagtgtttttgcgtgcgtttgggggtagaggtggcaaagaggtattaaagctatacatactgtaaagtcttaggacctcgtctcccaatctcccacttttcctaaggttttcagcctgctggacaaaaagtacttccgtagggcctgccggataaagtgtggtccatggaacagcatcagcagccactgggagcttcttagaaatgcagacgctcggcccccaccccagacctgcgggatcagaatctcattttaacgggatccctgggggattatcgtgcacagtacagactgtcactgtcgaagcagccacggaaaacctgtcccctgcttcgtctggctctcgggaggtcagctctcttcttccccctcactttttatcgggtttcggagcctcgaaactcgagtccctgccgaaatgcgctcactccgagaccacgagccccctccttccccggcgtgctcaccccctggctccgggccgccgctccgtccctcggtgcccggggccacctgttcggggccgcgccgagtggtgccgccccaagccgtccggggcccgggcgcgttcgcgctccgccagcaccgccgcagcccgaccaggcgcgcggagccgggctcccgggagttggcgtctagcacaccacccgcgcgagtcaggctcgtggctcagtttcccgcgggttggggaaagtacggctccgtccgaaggttttggagacgcgcgtctccccttggagcctcctttcccacggcgcgcgggctcccccagtcggggaactagccccggggctgggagctacgcctccgcctttcaggatgttcccgggccccggctaggaacagcagccgggcggaaggcgcgttcgtcccgccggcccgctggcccgccgccctccggggctagacgctgcgcccgagcctccagcgcccgtggccggctgtgcgagtctgggtctcaggaccccaaggggccagacccgtcctggcgccgagcgcttacctgccgctcgcgtcctcggggctggctgctggcgccgtccggcccgccttttcccctctccggggctgcggccctcctccccccgcccgcggcctcggcgccgcccccgccgctcccggcccgctccgccgccagctctccagctgcccagcgcggcgtggcgcgtcgggcgctcggcggcggcgaggctgggcgcggaggtggggagcgggcggggcgcggagggaggagggggagcgggcagcgcggccggccgaagccgggctgggagctcggggcaggggcaggggccggggagaagcgggggcggcgagctcggccgcccaccccaccgcagccgggggccccgcagcgctcctgggctccaggcactgcgggaccctcagatgcccggcgtccagcccagcgagctcctccttggggaccccaacggaccccaacctccagactcagcggctcacctttagggctcgccccggtacccatatgcccgtttcagtgtcgcacgctgtaatgggtgggagccccgagggcgcacttctaccaagatattcct

SEQ ID NO: 6088 - DNA, 848 bp, artificial
  synthetic oligonucleotide
tgaagatttatggctgtcttttttttaatggtacagtagtatagttttagctcttatgttaggttgttgatccattttgaattgttgtttgtacagttaaaaattgttttaatgaaattttatttttatatatttaaggcgtacaagtacagttttgttacatgggtttatttgcgtagtggatgaagtctgaggtttttgtgtaaccatacccaaataatgtacattgtacccattaagtaatttctcataacgtttgtactgtttttgtatatgttgtgagatagaggtctaacttcattcttttgcttgtggatattcagttgtcccagcacctggatttgttgaagagatcattctttccccatttactggtgctagcacccttgttgaaaatcagttggccatagacatgtgggtttgtttgtggactctcacttttattcctctgggctatgtgcctgtctttatgtcagcacttcactggttcgattactataaatttgtggtaaatattgaaattcggaagtgtgagtcttccaactttgttattctttttcaatactattttgtctatcaagggctccttgcaattctgtatgaatttgaaattttttttttcatttctgggaaaaaaagctgttgaaattttgatagagattgcagtgactctgtagattgctttgggtagtactgtcatcctaactataaattcttccaatccatgggacctttccatatatttaagtgtttaacttcttttagcaatgttttgtagttttcagtgtgctagtcttttacctcattggttagatttattcttagatgttttattcattcggatgcct

SEQ ID NO: 6089 - DNA, 956 bp, artificial
  synthetic oligonucleotide
catcgaggtgctgggaggctggtgtgctctgagaaggcacggaaggcctgtgctggctccccaacccctcataccttgccctgtgcatctcttccatttggctgttcctgagttgtatcctttataagaagctggtagtaaatgtaagtaatgcatttccttgagttctgtgagtcacgctagcaaattatcaaacttgaggagagtgagttgtgggaacccccaaatttgtagccaagttggatagaagtatgaatagcctggggacctgggacttgtgacaggaatccgaagtgagggcagttttgtgagactgagtccttaaacctgtggattgaattgaaggatactcagttggtgtcagagaatcagaattggtgttggaaaagataccacgcatttgctgtctggggaaaaaaaaaaagccctcaggtaggcacatgaatcttcagcttacaaatggaaacgtaccaaagcttcaagagactgctgagctcatcattaaggtagtatgcgggaaagctataactcaaaagtgctcttaaccatatctttttaaaaaattgtatcctctttgagggaaagaatctatcttttcttttttaaattgttattatttattagtcagcttctcagatctctttggaatttaattgaatgcttttatcaattaatggtcttgatgaaattgcttgtatttttgactattatttgtatggccaaagtaattttacgtacccttctgaagttagcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtga

SEQ ID NO: 6090 - DNA, 3466 bp, artificial
  synthetic oligonucleotide
gtatgcactgtgggtgactgggttgcccactggtgggcttccaccttccccccaatccccaccaactgtgtaccagattttgccaaggtggaggggctgaaagatccagcaggaagagatccagagatttgtatgtttggttaggggcctggagttcctggtgtcatactccagttttagtccttcgtggttccatgctgacgtgtcccactttaatctttacaacgtctatgtgagatgggaaagattattcccatcttgtaggtaaggaaactgaggttcagacaggttaagagaaataaataagagacctggagcaggggaatagggacatgttgcccctttaaatcataaccaccaaagtctgaaatcagatacacaactggaaatttatctgagcctcagattccttatctgtaaaataattcttccatcacagggtggctgagaaggtttaccacatgtgaagtgcctagcagacagaggccaacaatacatgttagttcccttcccaatttatttccctccactaccatcctctccaaaattctaagcttaggggagaagccagagaacagacgtttcctattttcttatcataaatttggagcacgctgtgcagggctttctgcacatccagagtatctccattctggatcaatggatttgggaggccagtcctatcctcagcttctgggtcattacagctagagcactcccagcaacagctcctcacacaccttccagtctttgatttttctttcttgtagttcagatggtcctgtttcagggactctgtattctggatacaagattttgaaatgtgtcttacagttcttccccagctgcccaccaaaccgtgttctcaccccagcgatcggcatcgcttggaaaactgtcttttcatttgttcctcagatgaacaggttttcctgggcaaaacatcaccactggaggtcttggctttttttcatcataaaggaaccccctcgggtggctgaatggtcccctgggctggtgccaaagtagtcactacccccaagttccagtctgacttggttcatagtgcctgggctgccctggggatgcctctagtgggcatctgtcaggacgagaagcgagtgcccatttgaaggagactgtgtgtatgtgggggtgtgggggcaggtggcttctctgggcttgtaagaggcagagaaactgggatgccaccatcttacaattctctgccttccagcccacccctggcttctcatgttcccgtttgagaagaaaactagcctccatactgtccccttccgtattgtccccctcccaccttgccacccctctactgtaacaaaggcatgtccacaccacattttcaaagttgtcacaagtctctcggtccaccaacaaccaattctgatgactccaaaggagcaagagagacatccagaaaacggtgggaaagattccctgggaaaagcacagaaaaccttgcctgatgcttgcaaggctaagaattgttttctccctgctggctgcttttctctctgttctaaagagaagcttccaagaatcagttaaataaagggatcacaccagaggatgcgagataatgctaaaccaacaaaaacaaagacccaaatgaaacagacagagccatgagaatacgcggttatcaaaactttgtttggccatatctatttatcatcgctgcacacccgggctctgcggaatatcattctgttgatgtcacttatcctcagcaaaatatttacacatccttaaaaacgccagatgaggggggccggcccgcgcactgccgcaagccgcccctcaaaccccatcgctgggttctgaacagcccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccatccgtcgtgccccaaacctactccaaggacttctgatagggaaacacaaagcagcagctgtttggcaacatttctacccctcgccagcaactgtggtgggatgccatttccccacccaggcggagcttatcctgaacaatagtcgggctttaaatggcaaacaagcaaacacacagagcacaaccccaaccccgaaaaagccaccgcggagagaagcaataactccctccgcagcaaaaggcgccactgaaacgcacgcaaaaatgcagcgagaacgttgctcggtgcctaacatggcagaaagcccgagctggtgcggccaccccggggctgggcattggggggcaccggggctcccggggcgccgacgcacactcacccggctccgggggggatgcggggctggccgcgcgtcacaaagaggagcccggcgcaatctggcaaaacccaactttccaccaggctcgccagggccgccagatacgtcaacagaatccatctttcgaagggcctggaaggcgccgggttttccgggccggggcagaacggcagatccggagactgcccggtgcggtgcctgggcgcggagtccgccgtgcaccgccctctgcgcccgatgccagtgcgggcggcggcccgaaacccacttcggggcccccgccccgccggccggcgccgcctccccggcagtccccggccccgccggccagtgcgcggcgccgggaacgggagcggggccccggcgcgccacacgggcggcggcctcggcccgcgtccccgcccccgcccggccctcccagccggccccggcctccgggcgccgtcctgcccccgggagcaggcccctccccgggcgccgggccccgccaggcgcgcccagcccggcgcgccccctgcgtcccggtggcagctccgcgcggggagggcgggggtgaccccggcccgcacgggggcgccgcggccactacctcgcaatcgcggccgccgcctccaggaagccgcggggtggtcgagtgtgctggaactctccggtctggcctcgccgccggccgcctgaagggggtgcgccgcggtgggagccgccgtcgccgctgtcaccgagtcgctgtcgccgccgccgctgctggttgtgcgtgagcgtgtgtgcgcctgtgtcctggcgagtgtgtgtctgcgtgcggcgcccggcctttactatatacaccaaggggtggg

SEQ ID NO: 6091 - DNA, 1150 bp, artificial
  synthetic oligonucleotide
tggttttcaaagctttgatgtgcatagtcgaaagagtatccctattctgtgctttccttgacatttttcttgtttataaaatgcaataggaaattcatcggcacaggctcaatccattcccatccattgattgctagccaatcaatgaccattgtaatctgaaaaaaagtaacactggtttctatgaccctttccaagcacagcactgtttagctaagcttaataaagagaaaaacagcaaggaccatctggaaaacactcttccggagtctcgaaagatagtggcagcctctgcccaacctgctataaataagtgtctcagaaacaaaacaaaacaaaaaaaacacccgattttcaaatctgtttctacttaatacagctgcaatagggtttatttagcttttccctatagaaggaagactgtttgcatttttatgacaagttcctaaatgtttttcacagccatttccattgccattattttgaggaacaacataccactcagatctgtctgtttgcttctgcacacacagcggtggccccagtggcctctgcaccacgaaactggcctccaacgcccagatttatgatcctatttcctctcccagtgttgcaaccatcacctgaatcctggcctgcaacggactggcaacttagaatgtccaagtgtcacgtgctacaaatcaattatttatccgcctgagcccagcacactgtggatccctaccagcttgttgcctctctcttcatggcgacaaggaagacttcaactactcttcaagagatgctggaactcaccaatgaagtgtcgctggcttgccaaatccctcaatgctcacctttccatttttcctcactggctagtatgcaagggaatcctacacatgacactctttggaaaaggtcagcctaccttggatggctgcaaaatgaagtggcctatgttgacttctgcactgaacaactgcccctatccttcaccagcatcccctgctcccatatcactctcagaggctggcaggggagggctaactggggaacactttccctgtataatgagtgatccacttctctgccctctccctgccccccaaacacccattccatttccatgtatgggcagggcatggtttgcccgcatgacaccttc

SEQ ID NO: 6092 - DNA, 1932 bp, artificial
  synthetic oligonucleotide
caagatttcttatgaccttggcaagtggagtgtttcacaattgtgaattctggagaagttacaggcctggtggatatagtattgcccacacatgcaaatctgcccagcgcctaaacatccctagttgaaaataggcaacccagtcagaaaagagtcaagttttccctaaataggtttcaaagacatattaccaaaaacaacatcccacaagtcatctttggataatttcattcactgggtttcttcttgttatgtatggtattaggatatatcccataagtgttgtctttgaagtggccctaaatggctctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcga

SEQ ID NO: 6093 - DNA, 1116 bp, artificial
  synthetic oligonucleotide
cttgcagctaggttccagttggaaagtagattttgttaagtagatgtagctacttaatccactggcagatttttcaggttcactggcttctagggcataaatctgtgacatatcttctccctggccacatttaaggctggggaaaaaaacaccagtcagattagatgactaatcttgctaaaatggagtatagtttgaaatgtctacttttcagattccttactaccttttgtagttgacagatttttttccagtctgtatctgggttgtattacaatcccattggccagtcttattaggcttcttgctaaagcaaacaatccctaagtagccaacaaacaaaaacaggacaaaagtttctactcttcctttgtaaaaggtgacatcttcagatgccatatattatgggcttcataaatgtatacttagttcatggatcattaacaatcatgaaatgagtggagagataatgttactgatgttttgacatctggggtatttctgtggtgagatattttctgttgtaacttgggtgctcctgtgaacttgtctgtcacacctttcccgcccttcacttgtgctggagttttgctttgagatggaaaaacacaaatacctaaaaaaacatacctcaccccactgtaatgaagatcaaagtgaaaaaatgaagaatggcaagacatcccaggtgtgtttttaaattcccagaaaattttgcctctggggattctccgtgcttcttgccagaaaaggttttcccttttagaacgtaaggcactgttgcttatttttcagttacagatggggatttttagtaaagacctggccccctctcaccattgtttacccgaggtgtctgatcactttctttattggcatattgcccaagacatagacaaaactgctaaagggttttggatgcattagctgagcaaaaggtgtgtgttcctctgtctctagagcacaaatttgattagccctttttattaggagtcaagaatgacattcagtcttaacctagctcatctctcacactgtggctttggtgtttcaccttctttctctgaaagatgggggcaagcatgataaaggacagcatttcttgggtgtttactc

SEQ ID NO: 6094 - DNA, 2247 bp, artificial
  synthetic oligonucleotide
gttgtctccttgcgttcatagagcccggggatctccaaggagcagcccagttttccctgtaagaacccaaaggtcttgtacagagctggaattcggcgaaaaacttgctccaacacgccaaatctgccgcatcctcaataccccaccctcttccctctgcgcttactgcccacacccctactcccaacttgaggactccccgcccccaccacgctgacagtctcaattccaaccccttggatgtgaggaagtgtctttgcgcctgaacgcgcccagcacggcgaggccaccagtgactcccagcggccgcacagggcgctgcgcccccctcgccccggcctcccccgccctgcgtccgccccgtcacccccgcgcggcctcctgcgcccgggctggaggcagattcctctctccgggttttcagagcgcctttccgaaacctcctccccgcccagccagggagagagatcccgggcgcaatcgctccccggagcggccgaggggcgcgcggggagaggcctgcgccggggtactttcaaactgaggcgcgcgcacacactcacacccacccacccactcacccacacacacacagacacacgcacgcccatttatataggcggcggcgacggcagtggccggggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcgtgagtacccgcgccgtccgcccgccaggctatgggtttctgcgccgcaccctcgcgccctccccagcagcggcaatcccagccccgcggcgccgctccggttgcagcttgcaccttactactctcgccttcccacccttcccatcccctgggacccaccccaatcctcctggggctgagtggctgggctggaccccgattcagtgatgcagacgtggacggtggaaagttaaaagggcgacctctgaagtcgcaggcagcgtgggctgagaaggagcagaaagggagcgtttatggggagcacaggaggcagagagggtctgtccttcaccaccggggctcgcctttcacgtccttcacggggcgtagggaggagggttgcaactcctgtggtttccagaagcccagccctgagccctgtagcccacaccatgcatgttcagggttgggggttccaggagtagtgagtgttcttttgagactgctgcagcaccgcggctgtttcgtcactcgctgtgacctcaggtgctgccccgagctccgaacttgtgccttgccctcgtgtgcgacgtagcgtggcgctgctcgcctcctagactgaacttcgtagtgcttctgccgaaaacccttgtggcccggaggggccgcggggagggtcagggagagatgagggtgggagtgtcaggggccccggggagatgg

SEQ ID NO: 6095 - DNA, 1462 bp, artificial
  synthetic oligonucleotide
gagccggggctgcggcgagctgaggggcgggctaggcgacgcgcgggaagcggctcagcggtcgccagcggcaccggaggcagcgcgggtaaccgctgagtccaaggcagccgattggaggtttcttcgctgaggggaggtgcgaaccggaagccgggccacgtgacccggaagcggcgtttgccgggcccgagcgcccgcgcgcccgcgcgctcttgcaggtgcctccgggacgcgcgcgggcggctgtcctgcttgtttaatgataggaggacgggattctgcagcgtccttagcctagcgggtggtgcggggcagggaagttccggacagcgaagagccacgttcgagctctaatgattctctgtgtccccagagaggaagtgtgaagtgtgacggctgacgaggagggtgggaggagacgagggagtgctgcaactctggaaaaacaagtcagctcttctgtggagctcgtcacgcattcacgggccttttgctatcattctgcctcaaaattgtccggaatccgccctctccttcccattgcactgctccagccctagcccagacaccttccgccccgagcttcgcgggagtctgttccctgggctcgcctcgcccatcctcggtgctgcggactggatgagttaccgtccgttcggctgaaaagcccggacagcacctcaccttcgagatcccgcttccttcacactgggtcgccccaccagccgcctgggttccagtttagcactgccgacgacttgctgtgcctggcatgtccttgctcccaaatgtcacatctatgaagcctcaccctaaaaccctgtaagagcgattccctctttcacccacatgcccgttagcctttatttagcacaccttaaattgtattcattttgcatctcaatctagttcacagcctggtatataacaactaataaatgtgagttgactgataaagactataaaatgataaatttgttaagagctgtaatgctgagcgtaatgcctgggcataatggatgttcataattttctgaatgatagaatggatgaatcatctagtcatttacagataaggaaaggggagtcccacgggattaggtgaccttccttgaagagccacgggtttcccatatcgaaatgctattcattacccgagtcacctaggttcttacaaaggaagcgagaaaattgcttttgttgggccatgccccttttgcagaggttcctaagtatagtcgccagaatttttttaatggcctaaagtaaaaaaagaaatgctaaaattttcacgaagctaaatgtaatcaatgtaaaggaatcctttattagggattatattctttttgtgtacattatagtatctatgaaactaagacagtagttttgggggcttttaaaaaatgcttttgtatgacaaaacaaaaagaaatgtgtaatacttccccttttcaagcac

SEQ ID NO: 6096 - DNA, 2466 bp, artificial
  synthetic oligonucleotide
ctcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagcccc

SEQ ID NO: 6097 - DNA, 3093 bp, artificial
  synthetic oligonucleotide
taactgtaacatctttggtggcaattatcaccaaagtgatcacaggctgagtagcagtcatcctctgagcctcattttgtgtatgagcctcatttaaaacggaggttgaatggtttgactgctcacatgggggacattaagagaagtaggaacctgagttacaggccactcgattctgccctttctagaaggatcttatgctagttcttgcctttttagaaagaaattttcctgttggatttggtgggccttatctcctttcatattttgatcacctagtaaattttttaaaaatgtaaaccagaaaattatttgagcttcctttgaaatgcaaaaaagtgccccctttactcctcaccaaaattttaatccgtacaaaattatcgcccccccacacacaattaatagcaaagataatgtgaaagagggggatgaatgattaggggaagcggaggagcgggcaagcaattcccaagccctcaccattaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaactattatggcctggggaggttggggggagcggggggctttgaggtcttagccacacccgttgtatagataaagaaactgaggcccgggacactggaccaagggcacttagtacttagcgttgcctcaatccacagtctcagttccttttgttcagatacgagtcgttacttaattcagtggtctcaaccctggctgcagaggagaaatcagctggggagcttctggaaaccggatttcatcatggcctctgcgggtgggacccaggcatccgttctttaaaagctccccaggtgattccaatgtgcatccaaggttgcgaaacattgacataagtaacttgtcggtggctaatgacttagaaagacacaggtagcaccctccaatctagagtggtgccagatttgctggtgtccgttatcacccctcttgattcctggaagtccacccctggaaggctcttggagactttgcaggctagctccagtcaaccatttctcccgctgctcaggcctcgcgcttgagcctttaagtgaattaaatggtttaacagtgtccagggcttaaattccttctgtctccttagagaattttcctgtctccaaaggtattagaagagtcatgggacccttgcagtttttgtaggactaacgctctctgtgacatttctgagcctgatgttcccccctgatattttttgttgtgttcttttattgttctgaaaatacatcatgttatttgaacagagggttacataaacagtgacaatagatagtacactttagggacatttaagccaaaagagaggctttaggactgagaaaggatggaggaggcaaacatttcatctattgaaatttattggattaggaaagattttatcaaggcagagctctagaaagcctaataatattttacatgaaaggacagagatttgtgctaggcggatcagtggctcattttcacaatcccacgggaatagtcatttctaaccaatcttcatgcagtcataaaacaacagggagctcataggtataacttgttgtcctcctgttaagaggaagtaatccatttgcgccattcctgagtgcaagtgtatgtaggaatccaacaataacagaggc

SEQ ID NO: 6098 - DNA, 2274 bp, artificial
  synthetic oligonucleotide
tcagtgatgaaactttctcttttaaaatcacttaagggtgctttacgtcccacccaaggcaagaggaacgccagcgaggaagacaaagaggcccggggtggggcgcatgcccgccactggactgaaagctgagtcacaggaatcgtacccctgcagcgggccaggccctccagggagggacaccgcgcccttgtgtggagatgtccacagtagacaaaggcagtttcgaaataaaagaatgcctgtcaccccaggtgccaccccgacccttagttattatgcactggtccccaagagcaatttctgcgctgctgttgcaaaaattcatcgtaatgaaataaacgtaaaaggggaaaatgtgttatgaagtgttggagggtgctttgctcatttttttcgccatcgttgtggttagggtgcatgcactagtggaccccgggtgggggtggggctcccctccccaaaagcccggcaggcctccggatgccgttccgagacgcggcgcgaaggagttaagcgggccggcgggtgacatcacctcatttacataggagcgcccataaagctgcgcccgccgcaccccgcccgacaactcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaag

SEQ ID NO: 6099 - DNA, 964 bp, artificial
  synthetic oligonucleotide
ccctgcagacctaaaggaagctctgaggctttggaaaatgatcacagaagtcacccaattttgttctcattttgtcagctcacagtcattagagaagatgaaatttctctgaaaaaacaatgagtcaatgcagtgtaattgttgagtttaatggccttatcttacaaaataatgcaaactggttatttcttgaactatgtcagactgtgcaatcctgacattgcacttttctgaatctagcatttaaggtacatttcaaagaatacttctgtttggttaagagatggcttttacaaatagccagaacaatgaaatttcagttggaatattaaggaaacctctgtaggactgcataagcaataaaattgtcaaggggaataatgggtttgccaactctggaaaggttccaggctcaacttgacatcacctctctgtgataatttagaaaccacaggagcaggcttgctttaatgcagaagagcaggtggatgagccactgggctttgctgggaatgccagtcctgtctttccattccctaagatttgattggttagctttttctgctcacagggaaaaagttagatgcaacttgctagatgcagtttgaacccagtgattttcaaatattttgagaaaatgacacgtttttgcattattttttgtgtattttggtctttggatatatatttgaatatatatttcagagtatattagggcttctgtaacaaactgggaggcttaaaacaacagaaagatattctctcacagttctggaggtcagaggtcccaaaccaaggtgttctcatgattatgctccttctgaaggctctagggaagcatctttccttgtctctagtagctccaggcatttcttggcttatggcagcatcactccaatctctgcctgtgtcttcacatggtctcctgtgtgtttcttctttttggcctactataccttatcct

SEQ ID NO: 6100 - DNA, 961 bp, artificial
  synthetic oligonucleotide
ttgaccacgggtgaacaaatgactcacttggggagattctatagactatagatgcctcaccccgcacccacagaatcagaatcctggggagggtgttatagcatgggtacaaagataacacctcccaagtgaatatcattaagaattactggagcaaaatgagacctagaaacttctcttccactattagacttaatgtcagggctaactcttccaagggtccctctacgacccaaatcactcattttcccccactcctatctttctctttccattgccttactcccacaattgctggaatgggaaacacctcaaagggaaaaaactgttcatggagtcatttttgaaatgtcagtgcaaatgtaagcaattttggcctcacataagtaacaaaggaaaaaatggagtgctaatagtggtgatggtttaaggaatccaatttattcccaggggctccattcatcaaatatcattgtaactttattgcatattcaccggaaatcattacattttggtagtttgtgaattccactacttggggtcataaaattccctctattataagaaatcactgctgtcaagtccagtctgattaaagtgaaggacagatgatctgcagtcttgtagatgatgtttttggctgccaattacttacatatgaaagacaattaagtgattataaaaggaaatccataggtacagttacacatcataaataattttaaagatgggtaatctgctttcatgtcttttattgtttgcatgcagttccttgaattgcctccactccaaggcatttcaactctattttttgcacaataactttaaaaaaatctcactggctatgcacaacaccatgaccataaaactcatgtgtcagatgcctccctgctaataagctagaatactcacctgtcgtgaagtgcagcatacttatcaaacaaagaaacagtgaaggtta

SEQ ID NO: 6101 - DNA, 1460 bp, artificial
  synthetic oligonucleotide
gtttgtcatgccagccctaggaaaattttgtatttcttattgccacagcttggttctccttctttcaaacagtttaataaaacccaaggaagtcattgagcaaaaagcaatcccaaagaattttaaaagaagacaagagaatggctaatgaatgcttatcagtgtttcatttccaaaggaaaagtgatggattagaaatcctgtctcctgctaagcatggtgtcatcattatgtcagcagccaagctgcagttaggtcccacgtgtgcacggctccgtcttctttcaggatggacttcactttccccttgggggacttctgcccttctgtgcatttgtttcaacaaaaggggctcaaaccagaaagagacactcaaattcagagggctgagatgctttggtttgccttttttggtgtttaatttgctctgcattaaaggggctgagcacacacctgagacacaaatgagctcgagtgccagaacaagccagtaagaaatgtctttaaaaggagatggaagctgctgaaactcttcaacaggcttcatggaaaccaaagcctggtaagcctttctctagggaaaacttccggggatccaattgaaaaagcagagctgcttaagctaaaagccacatgccctttatttgcctcctgtatgatttattgggaattccttgggtatttttcacagttcactgctttgtagcatgacacagattagagacataccaaagaactctcagccccctttaaagatataggaaggaaaataagacattcacaagatcgtaataagcaggttgtggatcagggagctaaaagtaaggggttccccccttttaatagaaacggcttcacgaaccagttttatagaattggcaaaagcaaactgatggaagttgttggaggtttatggagcagtaagaaaaatgcagtaatgagaatcatagatctaactcttagtagatgcttggctactaactagctcagtcatctaaccttgtgcaaaggaaacccctactcaccatttaagcctacttggtttaaatgtctcttgctctgccttaggctcctattccagttaagttagttctcatggtataactctcctactctcagaccttccctttattatagcacttaccaaagtggtaagcatatgggattcattagtgcaattatgcatgttcaatccctaacatccctaagaccctaagtttcatgaagcaagagtcatcactgattggtttcccttgtaatcctagtgctagaatgactcatctcacgtaagaataaaggctcgatcgataaccataattcacctcttaacctcagtctcctcatctggaacttggctcttcaggtctctgacagctgtcgccttctgtgtctcagagaccttggacttatcctcaggcatcagtgggaagttctattaatttgacttgtcacagaagaac

SEQ ID NO: 6102 - DNA, 3711 bp, artificial
  synthetic oligonucleotide
aatccagcccctcctaaagaccaagagaaattcaacatttcaatttttgatgctctttctaatcttgagttccctggtttggaggtaacatcttgccctctgcctcgactttcctttctactgcctatctttctcaagaaaatgggcaaaagacctagcaaaatttgttagttttttgtaatctgcacccccaacacctaacagcctcagttactttgacacagtaactaacattaataatatgtgatgctaataattctgataaatgatgcttatttttctaaggcggtttactaaagccaaagtctaacagttatctcacattaacacagctgagtatgatctcagatgctattttcaaacggttttccttggttgtgtatttagcctaaatctccagcaattacatggtatttcatttcatttctgtaatgctaactgtactttaaaatattaaattacaactgatggaatctcccttcccttatggaaacagatccaaggcaaacctatagagtttgtggaccgaaggggataggggctgttcatttttaaaacaattactattctctgaaagtgtgttattttcaaagcgcccatcagtgacagtttcccaataggtcaattcactatttttcttaactggacagcaaatattttaagggtatctgatagctccctctgagtcccctatgtattgttgattcttcactaaactactaattgttctaaatggaatttaggcatcagcatatttccatgatctttcacacccctacacagagattttcttcttctcctaggttaaactaatactcagtaccatagatttctgaaattgccccttcagggaaagaaaaggtgaaaactagagaattcttgtcccccctgccacccaaacacacacacacactcactcatacagtcaatgacaccctccaaaataatgtttctgaattctctacagaacaagatggcagacatatttcaaaatatatttcatccaatcgttacaaacagcttagcaatagatatttgagttggaaaaaatatcaacattgggtgaagggataaggtgaccctttgaaattgcctgcagcactaacagaaaaccagaacaccatctctttctccagctcccacgactgctccaaagtagagccaacaagtcctacaagacgcacaagcgggtggccactagggacatcccatttccaggcaccatttagcaagtagaagaggaaaacccacaccacggaaaccccttagtgggtgccttgctctgtaaatgtaatggaattaaaggcggtctcctgaaactgcctgggggcctcctccttgggccgtgggacgcgcagcgctggtccctacctcggatttccacacgacgtaggggtgcccgcgactgtcgggtggggactggaacttcctctgctggagccacctcctaggagaagcgaagatgccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaagggtcgcgccagctccactcacgtttctggaaaggaagggaagtgtcagattgcaccccacccactggtgtcagatgggcagccggggacgattgctctgaagttggagttaaatctcctgccttttctccccgcgcccccccaccccgccctgtcccggctgtttttgtttttaaaaaggaaggatagataggaaactgtctaaaagcagtggctgccgatgaatgagctggagatggagacctactaagaaagtggagggggaggagcctttgccgtggaaggggtcctgagcacgtgcggaaacgtgctctaggaggaggggtgagtgaggccgggtagggggcaggcgccgggcgcagcttcagcccagaggctgcagagattggcgctcacaaagcgatctgtctccgcgtcccgctctgggacgcctcgggtctcagcgcggtggccacagtcctgggaagctggagaacgctggggaaatcaatcttcccggcaaggagatgagtctgaaagcagcttctcccgctgtcggacccctggaatctataaagcgcaaagcctcgccctcttggagggctttttgatgtaacagttaag

SEQ ID NO: 6103 - DNA, 1332 bp, artificial
  synthetic oligonucleotide
atctcatttggtgtttcaagacaagtaactatagaaaaaccagagaaagagctgttacaggttcctggaacgtttgcctgggaaggtatcttaacaatttcctaattcaggtcttcatttttccagtggaggaaagcgaagtgtacgaggtgtgcaatttgcccaatggccctgcaattaatccaggagccccgaggtgacaccaggaaccaactggagcagctccgggatgcctgagtccaccacccctgtccacctctactcctttcttcaaaaaaacaattttttttttttttatgttggggactggattttggaagacacgaattccagacagttaactgtctttgcctgattataaatattaatgattcttgtcaactctctgcctgcttctctccaatttttaaagttggcagtcagaacgtccagtctcaacagtgcaaatcaattcaaggaaaactcagtaaattagcagatgacagaacaactgcagtgtctcatctcaaaacgacacatctcacacgtggaaaatcaatgtctgaagactggaataaggtaaaccttctccctgcccccttcctggagggggcatttgaaatcttcagaagtagtagtcattcctcagaaacaactttccttttttccttctttcctttcttttctctctctcaaagaatatactcatctagtatctggatttggtcggtcgttaaccttaaaatcttgactccttcttcaaagaaggcaaatcccatgagctttctctctgttgtgtttcctgcagtacctgcagcacctagcgcagtccctggcacacagtaggtccccagtaaatctttgtatcaacagggagaacagaagccaccataagggagggggaaggtacgacagaagagcccctggtattctcttgtattagcgtgcaacattaatgataatgtgcaacattctgtcccgccacaaagtaggagggaaatgcactccctttctaaggagtgaaacggctgcaccccaacgctcccggcagcatttcttcagcaaatccactcgccgcacactgagatcatgaagcggccctgcctcctgtccagtcttattctcgtcctttcaacatatctgactgaaggctgaatgagcgacctaggcctaaccccaggaaccccatttgtcagcctttgtcagcgaggtggtggcggagtccagccccgtcccagatgcagtgaccacagcgttggggcaaagaaacactgaattcagggttggggctcccctgtaccttctaaaagatttcgggaagcgccactgagttagtgagcaggtggcacttcg

SEQ ID NO: 6104 - DNA, 763 bp, artificial
  synthetic oligonucleotide
cacttctggtgagatttcattacactcatgaagcctgtgctttctcagtcccctaaatagtggcctgaaccttactgttccccagaaagcagctccatgtggccagacgctcacggcagctgctctgtgcagtccaaatggtctgggatagggagcccagtgataatcgtcagacacttgttccacacggtgaaggtggggcaaacaggctgcgcaaatgcgacgtcgaaggtgtagaggtggatggagttcaaagcatcataaaaggcgatagagccgttatcatagtccagcaggatgcccacgcgccggaggtggggggcaggctcaatggggatttccttgctattgtgtctcaccacccagttattgttgcagcggcagagcgcccaggaagcagagttcttcccaatccattcatgcttcggggctgatttgtaagcaagaccaatggcatacctgcggaaacaaaacagcaacaacaaaaacaatgagccatgttgcacatgcacgttaaatccgttctgtggtcctcaggggttataaaaacatgatcatttgttgtccctgttcattttctttaagtgaaagcttggcaagaaccccaacatctgtgttcctcatctccttccctcccaaacatggaaagtgggtggaaagtagtgggtggaaagaagcgtcgtatttacccacatttctgttttcagctcaaacactacggagaatttgaactttgagttttgctgctttttttcactcttat

SEQ ID NO: 6105 - DNA, 2601 bp, artificial
  synthetic oligonucleotide
atttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccgcacaccgcttcaggtctgggcagcctgagtccctaagcctggaaggctaaagtaccctcgggcgccccgcccactccagtccggcagcccctcgcagggtgccaaactttcccccatcccactccatggctggcttggctctgaggtctaacccgtgggcgctcagcgtctccctatgctggaacacgcccctcagtgtgcgcacacctcttcgtaagcagccacgggtccgatgggcgggaagcagaggggcttgcgaacgcggactgggcagagcgcttgatgacctcctagcgacgcgcgggaggggaggggagagacaaaaaggggagggggagtggagcggcgtggaggttggggggcgggctggagccttgccgtgtttaaccctttagtgacacgaatgaaaaaaaaaagccagaggcgaagttgagggtctttgcaatcccccaaccacttagctgctggtcagaatagcttccatcctgtgtctgctctctcacctcagcagcaggtgagcttagcctcggaccaacctcttgccccccatctccaagcctcgatgggcaagtaatgctttttatctaagccgggaaaagaaattaagcggcatggtgtgtgtgtggtgggggggggggggtgcggggggggcgggtgttcagcctcctttggattgaagtacaatttgaccctcttcggttttttgcatttctgagctttgccgttgggtacagagtttgaggtgattcgggaaaggagtgtgatgagggaggctggcgccccggctttccgcagcctgcagcctccccgagagcaagtcgagagtgccccggcagcagctgggcttcgcgctcgggagctgaggctatctgggcgtctgtctggctcgcctatgctataggagcctgccttgtgcttttagctggatttcccagccatcagcaggagtttgtttttccgccccccccaaacttgttaacgcgcgcgcgcgcgcgcgtgtgtgtgtgtgtctgtgtgtgtgtgtgtgtgtgtcttgggctggggaaattcactgcaacacccacaccct

SEQ ID NO: 6106 - DNA, 1719 bp, artificial
  synthetic oligonucleotide
cgcagcaggattaagaaatctcccagaccaggatgggcacagaaatggttaagggggtggagggttttgtttttcacctctgaggactctgttatgggtcattaagaacacaagaccgaacgagcattccatttgctgggcctgcctctagcgcacagctctgcttcccgacaagataagttctgtgcaggaaggaaatcctgggcccagggaggcagatgggaaatcaccccagataaggcggctgctccgagtgctggagtcacacagggcctttctgctgcaagaatggcactgccgagagtctgcgtttcttgccagctgaggaggaggaggctcttcggaggcgtctcctaacacattgctgttctaggcagctctgcaaggggaaccccccaacgggggtgcagcaccgtgcctccaagtgaaggagaggccctcgggttcccggagtctggagaggtggcctccagcggtgccccggccgcctccggctaggcccgcacacagtttacccccacccaggcctcctggcacccccgccccgcatccaccacccaggtggtacctgtgcccgcgcaggtgaggaaaaaggcctgtggaaaacatcattactgataaataacagttcctttcaggtttaatgacacgttgcatccatcctaaatctctcaaaaaaaaaaaaaaagaagaagaaaagaaaaaaaagaaagaaaaagaaaaaagccctctcgagggactgcgcctcgcgcctgtaaataggaacgacaggccggggcgcgcgccgaggcgggcgcacggcttggagcgggcgtataaattaaccgggggccgcagagtgaatacattgcacgcggtatttattatgcggccggacctccgaggggttctccggctcccggacgtggcaaatcttgtccggagcgccgctggccgcgctgccaagggctaggacgagaggacccgtggcggggggcggggggcttctcctccagtcctcgggagccccggggcagcccgcttacagcggcggcagcggggagggtttaggcgaggagagacgcggccccgggcgccgctcgggctaggggccgggcggggagggcggggcggtgggagcgggcggcgcgcccggccccttagcattccgccggcgcgcccgccatcgccgcgtgcgcccccgcgccccgctgtaattaccccgattaccaaatgaatctcgcgcttttgtgctcgccgggcggtgggtgcggggaggcagttctaatagttgtcattagggccgggggaggcggggcgccgggggctgagggtgggagcgcgggggtgggggaggcccgccattccctcgctggctcgcttgttcgctggcggtcccaggcggcgcgcaggccgctgctggctgctgagtaatgattttttttctaattggaggcgaacagcggccctaatggatggagccgctctcggcgcgttcgctgcgcccgcccttcgatcaatacggctcgctgagaccgccgggccgcgctccccggccctttgtggtcagagatgcctcgggggccccaatccccgccaccaccaccggccccccatgctgcctcagcctcgcccggggagttcccagccccgccactccgagacaccacccctcctccggcctacccccaccccggacactccaaccccaggctccttcccgcacccccgcgcccgagt

SEQ ID NO: 6107 - DNA, 4680 bp, artificial
  synthetic oligonucleotide
gagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttg

SEQ ID NO: 6108 - DNA, 1341 bp, artificial
  synthetic oligonucleotide
ttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggc

SEQ ID NO: 6109 - DNA, 2855 bp, artificial
  synthetic oligonucleotide
agcagggggcaacaataggtcttcaggcccctggggcggcaacctggcactgcccaagagcccgcaggctctgaaggccaactgagccagcggcaagcctagtccctgcctccctgcttggagcagtgcgactataccgttttctgtctgctcatttgtgagcttggttcccgtcctaaatgtgggggttcaaggcagacaaagagtgtgcagttggccaccccgctcgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgc

SEQ ID NO: 6110 - DNA, 2256 bp, artificial
  synthetic oligonucleotide
cagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaac

SEQ ID NO: 6111 - DNA, 473 bp, artificial
  synthetic oligonucleotide
agcagagtattataaacaattggtgttaaatttctaaacaagtactgccagtttgggaggggacaaagtttatggcaaggattatgggtatgggaggtaaaggcaggagatatgtgtgcttagtcaaaagtaaggcattgaacaaaactaaaacatgaacaaaacctggaacgaatcacactaatttgctaaatgtgtgtgtgtgtgttgggggggcaacctggtgtagcagaaaaagcatagattttacagttggacagacttggattccaattcaactttgctcttagggaccctgaatgagttacttaacttctttgagccacagtttcctcatgtgtaaaatgggtatgatcattgattaaaatcttattataaaatgaacttaagaaaaataaacactcaccaaagaaaatgatccttttattatcattgaggcaaacaaagcctccaaaacacatagaaatatcttt

SEQ ID NO: 6112 - DNA, 1559 bp, artificial
  synthetic oligonucleotide
gccttacacgtgcagaacttgtggtagagagaagccctagtttggccgttctgcaagggatagcccaggaggtagggggaaccttaagttgaagtcacctgaagcatgtttggggtcagggaactcggaaagcaagagtgtggccacagatctgcccagaggcgcgacccccagctgaggagaccagatggcgggaaaaagcgggggtccaccgactccgcggctatctgtaatcctacccttggccaggccggggagccaagaaagacttccaacactccccaagtttcagctcaagtcgtctccgaggctgcgtgtgccccagcctcgcacgcctccctgcaacgtggccgcatctggggcgccctcataccctcagggtttcccaaactcttccattctcttcccaggcccagccatgtcccaggtctccgggtccccgggttctcctctccgcgtgccgggagagtctccagcttctcagactccagcaaccccagccaaacctcttcgctgcctggagccttggctcccgcgacaccgcccggctgcggggcgggggcagggccaacggcggaaccgcccccaaccgcctcccaggccaggcgagcaggcgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggtagactgagtcccagggagctgcgccgctaacagcccacctcctagccccgggctacgcgccgccagcccagtaaccccacttttgtgtgtcctcccaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcaggtgaggaagcgcaggccgcccccgccgcccacgtgactgcttgggagcccggtgcgccctcggtgctgggcaccggcgacaagggacggccccagggctcccctgagggcagggccggtcactatggccaggtgacctgggagtagggctggaggtgtttcctggtgtgtaggctaggtagtgctcttcgctgggaaggcgaggcgggactggagcgcgcaactaggtggagattgagggcggttgggggtataaaaataggccagagccacagacacctgcgcctgctgagcttggcacggttggggatgggggggcggaacttaacctgggagagatggaagtgccttggaatttgtggggtataacgcgagtagtgagtgccctacaccccccaccccaaacacacactcaagttggggcggggcaacaccaggggtggcggcggcggcggcttgaattgggctcttcctgtgtgcgtagggctaagagagaggtgacctctttctccctttcggtactgctgct

SEQ ID NO: 6113 - DNA, 2980 bp, artificial
  synthetic oligonucleotide
tcggaagcgcgggacgcgcgcctcactggatgcctgagttgagaagagaccctggaggccacaaacgtctcacggttacggaatacaactggccgtttcttctcagtgcacccctgacaaattaacctgtttgaaaccgactcttcttgtccgcattgtcagtgtagcaatttggtctaattggattctaaggcgggcgttaggagcccaaccgctggacagtcaatcacgcagggccattaatattcatctgttgacagcggcagccctcggctgatgttaaaatacgtcgttacggcacgatctgattgtgcagaacaaaaggcaggcgttcagaaactttcctccacctgaaatcatctcccctttaggatccagcctgtcaagaaggcagatgaatttgggagggggaggagttaaatatctttggactcctgctccctgggccagcagcaccggttttaaagcgatttcgctaacctatataagggatgctgttttgaaggaaaaggttcagtctcctcattttggggaccctcttactcaaaagtttgcctcagtgtgtcttcacccgccactgcagactcagaaatctgtcctcaactttgcttgcacttgggcccgtgagcttaggaaacccaggctgggtaaaggcggcggggggtgggggtacgttggggaagggatggctggagctgtggtccagctaaggctgaaattctgacacgtatgtgcgagcaaggatggcaaattcatgaggcaccagctcggctgtggggcgccagttcgcagagacccgggaaaatagctcccaccttctcgcccttccaaaaaacgggcgctcacgagaaggcgatccccacggttcctcccgctcacaccttccctgacagcagcgtgagactgggggatgtgggctccgtccacacacaccctctctccctccctcagtagacccagccaggccccaggcacaccgaccactcccaagtgcccagctgcagggcgcacgactacagcccggcggggctagcgcgctcagggtacagccaccacgcgcgccttgctccccgctgggcgctaggcacgctcaagggacccctcctcacctggcacgggagtttctggcacccacttgagtccgggctgcagtctctggaagaaggagcggacttggtgacaggtggcgtccggcggcggcggcgggggctgcgcctgtcccgggaagtccaagctgagcagcatcgccaccaccaagcacgcggtgcgcacggtcccggccatcctgcttcgcagggagctaggagagcgcgggagagtggcagccggagcgagagcagtcccaggactcggcaagcctggcagtggccctgaggagcaagagacgtgctgctacccagccgctgcaaaagtttcctcgcagctacctgggcgctgggcgagggcgggaaccgcttggcggcgcggggcagggcggggctgactggggtggggcggggcgaggagggacggggcggggcgaggcgagccgcgcggccagggggcggtggcggttgtgcggccggtagccggcggggtgcgggggcgcggcgtggagcgcggcgggggccactggggcaccgcggcgcggggaccgggcgaaggcagtgcgagaggagggtgcggagcccgcgcggtggctcccggcagccgagcccagctgcccgctcgcagccgctctacacagggcgctctggcataactactgcagaggggctgcaggctcgagcgcgctgattggcttcccagcagccgtccgctctgactggctctgggagaagttccccagcctcactcctccttcccgccgctcattggcctacagcctggagggcttttccctttaggatttttgtctccttttcatccttcctgggggcaggtgggggtccctgacttaggtccccctccgcttcgccacaggccttctttcagcttgtgccagctctttcctggccaccagagccacacaaggtgttccttcacacaaaatccacctcctcattctactctctgaggagcttcccgggaaccgttttcctaacgcagctctgaccgggttctcaaagccaacctgcaaatagtcgcgttcagggacagccagggaccgctgggcttttcacagcctgcctcacctttgaatattgtatcttaaaagtctgaaagcctctgtggcttgctagatttgattcagtagagccacacaaagtcagagaaagcacctgattctggggcgttaaaagaaaatctactgcacgacagtcccaggtggcccttcaagaggcaaagcctaactggttacaacgaaataaccaggggcttaaagccagcctaactcattagaaaatcattacacagcaaatttactgagccaaagctagcctatttcatagatggagtagaaggctatttgaaaggtatcctacacccaaatcccacctctcctgcttagatttcaccattagaaatccagttctttaggccaggcacggtggctcacgcctgtaatcccagcactttgggaagccgaggcgggtggatcatgaggtcaggagttcaagaccagcctggccaagatggtgaaaccccgtctctaccaaaaatacaaaaaattagctgggcgcggtggcaggcgcctgtaatcccagctactcgggaggctgaggcaggagaatcacttgaactcagagggcagaggttgcagtgagctgagatcgcactactgcactccagcttgggcgacagagtgagactccgtctcaaaaaaaaaaaaaaaaagaaaaaagaaaaaaagaaatccagttctttgagaatgaaatatctctccaaggaaaaatgcatttagtcattacctatatgctgctaagtagggatctttagcgtggattattttcatgatcctccacaccctagtccagtagagaactcaataagtatttgt

SEQ ID NO: 6114 - DNA, 2209 bp, artificial
  synthetic oligonucleotide
ccttcctcacccaagtctgattgatgctaactaatgtcgagttagttcctttaaagaagttatcttgctaccaagtgtgagccagtccataccggaggtggaggacggggggcgggggcccgggggcggggggcggggagagggggacgaggacggaaggtgaggaaatggagctgggagtggcacctcacaccaaacaaaaacgacgatcgttacattgtatttaatttctaattaatcctcaagagaaatatagccgttttccttaccaatggatccctgttcttactgtgggtatctcgcgcgcgcgaacggtccccaccttcccggagcctcgcagctctaaggagagcaaggagtccccagataactatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaac

SEQ ID NO: 6115 - DNA, 1376 bp, artificial
  synthetic oligonucleotide
agacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggccttagagggtatggagctcgcggcatcccgcttagtttgaagttgcagccttcgcaccccaagacttcccccttccccagggatcagctgcaaccccaatccaggcggcccgctccccctgccgcagcgccccctacggtctggaggtgggccctgaaaggttccgacgggcgcggggagcccaggggtgggggccggggaggccgagggaagctggtgtgctccggtccccgtctgagaagcggtcac

SEQ ID NO: 6116 - DNA, 1810 bp, artificial
  synthetic oligonucleotide
atcgtcccaactggggaaatgaatggttggcctggcctgggggcaccggttccttcctgcctgtgggcgtctctagctgagcctctggttcagggctctgagctctgccaaggcccatgtcatttagtggcccctccggggtggggacggcctctctcggaagggtggggaagtccctcgaaactatgggcagggagagagaagagagaagagacccactgcttgttcaaaaccaagccctaacctaagccaggtctaggcaagacagagacacctcttacataggagtcaccggccctaactcctccccgccatagctctggagaggaggtgcatcttaaagatgatcctcggctcctggtggttgaggtgcagcgtcaggttgcacctggtcttgcctttcccggcgggcgggccaagagggcggctattgagcctcgcggatccaggccctagaggccaggaagaggagatcgcgcggccttgataagccggatcaccagcagtgaccctcgttgacgtcggggtaaccccgctaagtgaccgccacgtgagaaagtctgggccgctcacaatgcgccggcgcctcgttagggccgggcgggcgctcggggagccaggccagcagtgtccgcggcctcatcattcattcccctggacgtgctggtaaaaatgcatcaaaataggctgcggagcgcggtataaaagcacagcgggatgagctgctttccaaaaaggatctcggtgattggaccgagctcggcgtgattgacaagagcttagtttggtaaagggaagacacgcaagctttcacagcaggagcccttttctaaaatatatcacactagcctttgaaaagcgccgcacactataaggaaatagcgtttcacggcttgctttatggtgcgatgacatttctttaaaacacagcgaagatcaaaaaaaggagagagagaaataaaatgtgttgcaaacacaatgttttaattagtttattctgcgcgttgcttttaactgtcgtatacattgcgggttttcctttaattaaacagtccctctcgagcggtggcaggcgaggaaggcgaggcgctgcgccctttcgtttccttttggaaaaacgagaaggttggctggccccagagcccagctcgcaggctcctgtgccctcgcggccaggataggcagactgaggcgttggggcttcggaaagcggcgggacccgagcgccccacggaggcggagaaggaggggacgaggaggaaaggaaggggaggaggttctcccccggggaaccgaatgggaccaaggcagtgcgagtagctcgggcatggcgccaacctccaatcccctccccacgagctccagccagcagccggtgtccccccgcccccctaacccgcaccacctttccaagccctctctggtcgccagggtggtggggagcgataggcaccaggatgagccctgcggttctggccgtctcctcggctttcgggctccgatttccagctacttagccctctttggatcccaaagtagcggattctctgattcctgacccacaggaagaagagactacgcaagcatccgctcgccgaaagcgcgggcgccgcaggcgctgtcaaaagtggcgcctcaagaaagacgagagttgagctaatgggggaatgtgttgtggacctaagcctgttcttacacacacacaccccacactctcactcgtacttactacacgattacttcatggaaacctctgcagatttcggttctaccaacaaccaccctctctgctccacacaccccaaagacc

SEQ ID NO: 6117 - DNA, 6859 bp, artificial
  synthetic oligonucleotide
aaaagtgctgtggagttgggctctgggttgtaggaagaacccggtcctaccctactgcccctcaggacgttctgtttccctactgcttcttcaagatggattctaaaaatcgggctcaaaagctttgctggtttagaagtgatcagtttttctgattttatttactgctttagatttgggcataaaaataaatctttttcctatttaccgtttgaactcagtgtgagggaaaggatcccattatatttcctatccatacaaacatgtggatatttagacccgaccacatacaacttggggacacataaaagagatttattggttaatttacgttgcctactacacatgtaaaccctagtaagccaaagctgctgagggagcctcagctatagaaccacgacccctgggttcgagttgtcctccctgactagagctgtgactcctgtctccacctgaaaaacgaaaacacgagagttgtctccatcccctcacctctgcctgtgtgtaggaaaaacttttctcctcttagctttccctcttctgccaccactctgttctcagactcagctccccaaagcgccctgttccccgaagttgttcccagagtctcctcttgaaaatcaagtttggggaggagagaagctctaagtcataagaaaaacttcgcgatttttcccccccaacagcagtgatttgctttgttgggggtggggactttgttttcatgtgcagtaactagctttatctggagggattttgctttctaccctcttttaagggtcaggggtccccctccccaaataaggaaactcccactcaaaccaactgaaaccgacttagaaatggcctgcctctgacctgctgttcacaaagcccccagcctcgtccttttgcgcgcatctgggacccctgcgtcccacagaacaacgacaccccctcagaaccgcactctcaggatgggcccggctgtcccgtgaagggctccattgcccgggattttggcctggctgaatcgcctcaggtctgcccccttaacaagcatccacccccccggcccccacctccccacttctcggttgatgatctaattgaattatgcctttttgttccagggactacagagcacgtgctggaggcaattaattatcggaatgtggccgtatcaaaacggacactgggcaccgggtaggtcagcggcggcaacttccccctgccttgagctcaagaccccttcccaaataggggcatgatgagctccctcggctgccccccttctgagcccttcacccagttgcaatcgcgcaaggccctcgattctcggggtacctggcgggactccccggaaactctcgcatcagcgctggcccggccagagctcgacagccgccccttcccggtcccctagtctcgagaaccgctgtccgcgggaccagctcagtgaggaaatccaaactttttcaaaccaactacttagccaagggcggttggggttggtgggaggtgaagagaggtagagggaagagaggaaataaaggagaaagtgaaaagaaaggtggggcgggggggggggggggaagaaaggcaatcctccttttttgtaaacctgactccaggggattcatttgcatgatttaagcatatttgttctctgaacacaccagcgcccccctacccccccaaagaaaccctctgctgagaggcactgaaaccattcttggagagcctatgttcggcagacgcaataatttaagtcagcagtgaactcaccttccaacctggggagagagctctggatgtggagagagaattggggcgagtttgatgggagggggtgaatacggtaagatgtgctaccggtagggtgttctcccagcaaactggctaagaaagaaggtgaagtgttggctgggccaggcagactggggagcaggaagtgaaaggctgcagttataaagcgctgcttaaggcggtctctcctggcgcctctgaacttgatcagatgttctatttcctacagagagatggcggccaggctgtgaggctgcctcaaggcgcagactttggggcttggcccagctagggatgtgacaatcacagccatctttctctctgccttttctttccactctcttctgcattctttgcaaatgccttgcaggacacaaaaatgagtgaatttatagccttgtctgaacctggtcattatgtcagaaagaccttgcaacagacagaaggcgagaggactttcacacacacccctggaagtaaatccttaaggggtaagcagtccctgaggtcactacatgctttaccttctccgggtaggagtagaagagagtaaagccttggctgttcagaggaaagaaaattccatgtcacagtccccattcagcatcagcaacccccaacacgacttttgcatttgaaaatgttgagaattcaaagctgattagcctagtgatttggaaaccaccctgatactgtgtgtgtctagtgtgtttattatgtgtttagtgtgttgtgtgcatgttttgcgtacactggctaaaagtgttctttgcatgttttgtatttgtgggtatgctcgctgttatgtgtatttgctctgttgtgtttagttgtgtttctgtgtttgctgtgttgtgcgtagtttatgttactgtgttgtatgtgcttactttgttgtgttgtgtgcgtatttcatatgtcgtgtttgtttcctgtggtgcgcttgtgtttactgtgttgtgtgcttgtttcctactgtgtgcttgggtttactgcgttgtatatgtttgctgtgtcgtgcccggtgtgtaattcgggaagtgggcagcggcgagtacggccgctgctcacaaactaaagggtcaacgcttggcgcagacggaagtaacggagatcagctctaattgtaatcgtttcttctcctttgggtctcggacagctgccgacaggttgggggcacaaacggcgaactatcccggcctgggtcccggcctcgaggccatcagaactcgcagtgattggaggtggacgcagcggctggaccgggagcgcgaaactgctgcgctctccccaggatctgcgccctgcagctacagaggggacatgttctcaaggtggtgaggcagcgggggcccaagcaggactggacgttgagcgccgcgtctcctccatcggcgcagcagtgggaccgatcctcgcggggcaaagagcccgcgaggggtgggggaaagcccgcgagagtcccggcggcgtcccgccgtttgccggctggagcctggccccagttccccgcagccactcaagcccggtggagcccactcgcggccgcccggcagccgccgcctcacctgccaggcacccggcggctgcccaatcagcgggggtcgctcggccgcggctgccatgttctccgctccgcgctgccaatcagcctcgcggcggccaatgggcagtccggccggaggtcaggtgaccgcgggccagctggctccccattggcgcgcgcctcgcggcctcccgctcggtttatgtgcgaggagtgagtgattgactttatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgct

SEQ ID NO: 6118 - DNA, 2014 bp, artificial
  synthetic oligonucleotide
tccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccctaaaacagaggagcaaagtcgaagggcctcttaacatgtaagtttgtggaagaatcgccagcagcgtgcccatcgcctgaaaagagaggttatcttggcacctagactgctttcctctcacaggtttctgtccctcgagtcccaagcctccagtggatccttggccggggccggggcggaggcggcgaggccaggcgtttcggaagtcggggctccagctcagctgtcctcgggcccctcgtcggggctcccagggtccctgtccacacaccaagttcttgcaagtctctgtcgaggctcgggcggggggggaagggacctcatttcctagggtcaattctctcgcggtctctgcccgctgaccctttgacctccacctacagggcccttggcggccgtaagccggcggtcgcccgggctccgaggacgcttcgcgccccatcgcctcccagcctcattaggccggcggggctgtaaagcaggaatcagcctctgcctaatccggacctggggtcaatacgagcccaaacaatggtgagctccgaaggccactgcgtagcgctggccgcaaactttgtgttcaattcaattttctaaagcggtgggggttgggggcagggaggcattcgtccacccgaaagccgcttgcggctcccggggctcatcagcgaacgtcctctctcgctcggcccctccagccttttcgcagcgcctgggatagagggggcggcgaggcctggggactggttgtcggcccgcgcgggtgcccaggggctggcgcaaaaggggccgcccccgtgccgggaacagactttgaagtgggtttttagcgcgcacgtgtgagagccgggccagggccggagcggggacccgctgggaggaaagaggaggctccggccggggccccaacccctcccccgcttccccgtggctccggccttttcaagccgcggccgggggcccgtaggcctcccacacccacccccactcccgcgccctgcccgcgccgcgcgcaggcgcacacttcgcagccgtcgagtcggattttgcagcgagggggttggggatagagttgaaagccgctttgcagtgccgcggcctcggtcgagctgggagggaggggaggggaggtatgtgggaaggggggctggttttggggcggctctcgagtcgtgaacatggcggccggatgcgaacccccgcggagcgcagcaaagcgcagcaaaggctgcagaactgttgcgtagtttaaactcccttgttattcctcagttctgggcgcctcgcgggggaatgtaggtcgtggcggttgagcgcaaaattgttaaaaaaacggaagcgaagaagttcttcctgggcattctcctgggaagttggcgtgtgctttttgggtttggggttcccatgggacttggacaaa

SEQ ID NO: 6119 - DNA, 1237 bp, artificial
  synthetic oligonucleotide
cctgatctcacctcctgcgagctgagaccagagctgcacgcctgcagcgcggcagctggccagaggaacggagaacggatgacccagcgagttcgtggctgggagcgccactgcagcaggaaagtgtgtgtgtgcgcggcgggcgggcgggcgggcgaggtgggggggttgtatagactggaaaataaagtgcgcgcggggaggggtgtggactggaaaataaagaaaagccggccgggctggggaggcagcggctgagaagaagggcaagccagcccgaggccgccggggaggagatgagaggaggggacttacctgccacgaagactgcttgcaggaggcagaggtagttcttcccgtacttctcggcaatcctcacgcgctgcagggccatggccatgtccacctgcagagggatcgcctgggctatcggcatgaaagtgcagccatctgggttctggggcaggcctgggatcctgccgcaggacactgaggtccacggcgccgaagcggcagcttggggcatgtgcctggccgcccgccttggcgaacccaggtagggccgggcccctgccgctgccatcctcacgctggagagccgggcagggccgctactccagccagcagctgcccagctctgacccgcgcgccgccgctgggcactcaggcactgccggaggggtacagcccctggccccgctcagcccagctgcgccgcggccgccagtcctccggagcccccctagtagggacagaggcgcagaggcccgagagctccgcgcgcgcggagtccaggaacttgttaagagtttggggctctggcggagcgctctggcccccgccgctgcgagggcaactctccctgggtgcgcacacccacgcccccgcttagccaccggtggatgaaaggaggcgggggctgtggaggagggacgcaaggagctaaaagagagaatttctgcagagattcccattttcgagggacgaaaggccaacctaggctagcacttgtggtgggaggagacagcccagcctcgcactctcatggcaactcatgcaagtcttggcggtttcttagcattctggccagtatccacctgggcaaagactcggcgcaagggagttacactgtgtgagcacatgcaggtggccctgtcagggctgctgtctttgcccgaagagaatactagccctgaatagtctgagaggtcctgtgctgaagccgaaatatgtcctc

SEQ ID NO: 6120 - DNA, 4881 bp, artificial
  synthetic oligonucleotide
tgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcagacttcactaccgagcccatggggcccaggctcatggcggctgcggccgcagctgcggccgcggcggtggcgggctgctgcccgtaggcggcggccgcggctgctgtggctgagggcgccatgcccccgtagcccgaggcggcggcggccgcggcagcgacgttcatgtagctctgagcgccgggcggcatcattgggctgtactgcaggccggccatgtcgtagcggtgcatcggcggcagcgcgggcggcggcggcgggctgctcatgctcgggggctgcgcgtagcccagctgctcctgcaccagcgagtacgcgccgttggcccagccgttcacgtgcgtgtacgtgtccaggcgctggcccacgcccaccggactgctggcggcagcggctgcggccgcggcagcggcggcggcggccgcggcaccgggaggcaggaggccgctgggcagggagtacttatctttcttgagcagcgtcttggtcttgcggcgcggtcggtacttgtagtccggatactccttcatgtgcacggcgcgaagtcgcttggcctcgtcgatgaatggtcgcttctcggcgtcggtcagcagtttccagtcggcgcccaagcgcttgctgatctcagaattgtgcatcttggggttctccagggccattttgcgccgctgcccgcgggaccataccatgaaggcgttcatgggccgtttcacacggtcctggtctgtacccccgccacctccgctcgcaccaccgctgctgccgccgcccgagttcgcgccgccggctgcgttcgcactactcttgcctgcgcctcccggggctgcggggccgccggtgcccgccgcttgtgtgggtgtccctacggggttcttgagttcagtctccagaaggctgtacattgccggggcgggaagaaggtgcgccagcgtggcgggaggagaaggcgctcccggggctggagcggccacggtgaaaaggccctgggactccgtcggagcggagcttgggggcctgtgggccagcgagtccggcgggaagggtaggcttatcaaaatgctccgcgccaaatcagcaggaacccgcgggcttctcgcacctgatgagttctctcgaacaggtcgcattcacagtctgcctgggctctagctgggccccttatatacctgctcggattccccggggttggggcttggtccgcccctcgcaacccggaggacccgtgattgacaggttcgcagtgatgcgccctggccaatcattaccgagcccccgttcggcctggctggaaaaaaaaaagttcggggagccctttcgttcaccccacgcccctctttggcctagtgacgtggtaagagttacttaggaggcgggagtccacgaggcccactcagaggccaccaattagggtttcaaaaagtttgaaagaacgaaacctgaggaggtgacggggggaggggggagggggcacgcaagcagattggggggagggggcagaggggcgccttcggaatttagaaaacaactttgcaaccctgtcaaggcagaccggcgccccatcccccggccagcccgcaaagcttcccgttgtctgcacggaggttttctggccgcttctgctgccagcgctaggaacgcagggcaccaccagctacccaggccggcttagggactccaggctcattggaagtgctcctggctgcgtctccaagaagctctccctggaattggccgctggttgtccagatctttctctaggagggccagtgcgtccaggacgcagcgtgggtcaggggcccgggcatgggagacaggcttcaggactgcggggtgcattcggctgtgaggctcttgggggtttgcaggagggcgggcaagcagtcagtcgcccgtctcctgagcctgtcggaggcgctcgcacaaggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccct

SEQ ID NO: 6121 - DNA, 5712 bp, artificial
  synthetic oligonucleotide
agcttagaacgtttgataaaaggtaaccttccatcattgccgatgtaaatcagggaactgaagatgcaggcagtaccctcatgtgctcagaaggattacccattcctgagcagaaactgctcacttgccctctcattcctctgggaatattccaggtttcctctatttggattggatatcttaatagctttaaaatctcaaataaagggtttatgtccactccagttatttagggcttcctaacaagccttttagaaagagacttaattaaaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatccca

SEQ ID NO: 6122 - DNA, 1862 bp, artificial
  synthetic oligonucleotide
gacggtgaggatctccggtaagcgccgcttcctctgggaagacgcatttggacgcccgtactctcaacaggtaatggagtttgcaggagaccaccaatgccttggagtccactgaggcaagacccaaggaccccacgctacacatcagccacccggctctgtgccccattttactgttggggagacgcacctagagggcagggtctggagaggtagtggcagcctcagtcgcaagctcagggtgctctctctgcactcacaggtgccatggtcccccagtttccatccccacccacccccactcggccagtgccctttgggggcaatgccaggccaggaagggcgggcaccctcgcgcgtcctggggacagaagggcgcgcaccgggcgcgtagctcctgagccccgaggcccctgcgccgcgcaccgccccccgcgcccgctccctcctccctccctcctcctcacccagctccctcccctcccccctccctccctccgcgctcagagctgcggttggagccgagcgcgccgcgtcgcccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggca

SEQ ID NO: 6123 - DNA, 960 bp, artificial
  synthetic oligonucleotide
acggtaaaattataggcaacacaaacaagatttgagctatgttagtcttttaattcaggcagaatttaatgtgtaattaagattaattatatcataatggaattgtagacacatgattattgcatcatattccttgcagacatgcatcttgctttcacatcattctggtttctcagattgagaagcatgctgagaggcagagccaatggaatccggctgcatttgcaggatgtgtttgctacagggtcgttttgggagttaatttttgccaatgttcatttcagaataattgaaatatgcccaactgtgatggccttttaaaaatatcctgcttttttgtctgttttgagagaaagccaaccttaaaatatctccattagaaaaaaaatctccattagaagctgaaaggatttgtgtgtgttgttaagtttaggaaatcacctgagtgtttagattgtgtgtgaaggtaaaaagaatttatttctcactcataaattcaaaatacgggagggaatcccatctggaaatgttctagaataggccacttcctgagtcagaggggaagatggggtaaatctttatagatagttttgactctcctatttaaaagagaaaaggaaatctaaagaaggaaattccattatatactatagcatattatttaggtatatgacaaatacggcaactttgagtcaatacttaaatctgtgtaattagacccagagggtttttttagcttcatattcttggctgttatttcaactgtaaaagggaatgattctcaaaagtgaataatatacagatctttaattacttatacactttttattatggaaattttcaacatacatattcagaaccttttaaaagagaaaacatttattggagcccagtgttgacctaaattatttttattatgtgctaatatatgatcagttataactccttctgcttacagct

SEQ ID NO: 6124 - DNA, 1550 bp, artificial
  synthetic oligonucleotide
agtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagcta

SEQ ID NO: 6125 - DNA, 1518 bp, artificial
  synthetic oligonucleotide
agaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatggga

SEQ ID NO: 6126 - DNA, 4141 bp, artificial
  synthetic oligonucleotide
tcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggaca

SEQ ID NO: 6127 - DNA, 5950 bp, artificial
  synthetic oligonucleotide
gtgccagaagcggccaccagccggcgagccggttccgtgagctctccaacgtttcgggcgggcggggtctccgggcgtctggacccggggttggagaggaggggattgaagttgggggtgaaggggggtgcaggataggaggcgagcccgggacgtgcgggctccagcgccgaagctgccgggcgggctgcccacacccaggtgggcacagcgcctggcaggccgctgacctctgcccaaccctgcaccctcccctcggccgcgcacacttgcgccctgggccgcgaggggacccggcccccctcctccagggcgcgcgcggagcccgacggccccagcccagagaggcacccgcgccccccgcggcgaccgactggccggcggcggcggcggcgtggcggggctgccggccccagctccgcaatcgcggtagtcacgccgcggcacccccgcacccctcccgcctgcccctctccccaaaggtccggcgcgctaattacagcaaattgaaactaattaagcttctcttccctttcccatcaccctgggagcgtcggcgagacccagcccccgcgggcgggcttccaccaagcggtcacccggaggggcgcgggcagggcccgggggagggagaagctgcggtccccgccgcgaggagggaggcgtgcgccgaggtggttaaggattgcaaatctgtttgggtctcctcacgaaatctgagttgtttagatttttttaaatgtatacatttaccaatgcctggataagtgatgtaatgacatttgtcgagttaagatctgccatttggatacccctcgctgcctttccatcactactgctcccgcatgtttctctctctctccctccctctctctctctctcacacacacacgcacacacaacacaatacacacacacactccctcctccctgcgaacatgccgtggagcccgccccctcggaagggagcgcctgggcttctcgctctcgccattacctgtcatctcggactgcgcacttcacttcctggctacgtggcactttccaacagctcccttcgccttccgagccaagactcccgcttgcttcaaatttctgactccaccgtcaacaacgcccaccatccacccacccatcctggaacccaccccacctccgtggcccgggacccccagctcccgctgtgacacgacccgggagagcccaggtgcgcgtggaaagtaccgcggcggcgtccttaaccttcgtaggaaatccggttccctttgaggatcggattcaaaccaggggcctctgccaggaaaacgcgtgtgcagataatcccaggagatgcctggacgctggagcccacccttgactcccggggggtgggggtgggggcttctactgtcccctcagcgcctgtatggagcattcacacttcgttttgttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttttttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaaaaaaaaagaaagaaagaaagaaagaaaagaaaggctaagtggggtgtcaggaggaagaggttgggctttttaaattttttacttcaatatcaggcgtctgggggagaaaacctccccgatattttcaggaaagtaagaacaagagagagtggatgttggagttggagcgaggttggcagtagcaggggcaggggcaggggcgggtggacagccagccgaggaggtgccacgtcccggagcgccgagggctgccatgcccgcatccagactgctgtgaaggcggctgcgctctctcagtgccgtctcgggagtgtgctggtcctctgtttccatttggtcttgagtggtgctgagtgaggtgacctttcggggcgcgcgcggggcgcgggtgtggagggcagcctttagcacacctccttgcccgtgctggtgcccggcaggatgttgagctgcgtgagctgcgccgcgtgctccttggccttgagcctcagcgcggctatgctagaggcgcgtctgtctgcggccgccgtggccgggtcggccagggcgcccgatgccactgcgccctccacggcgggtgtgggctgtctcaggagcgcggccgcggtcgacgcgctggtcaggggggccattgtggaaaagagcctgcagggagagcaaacagcgcggtcatggcctcgggagctgtgcgcggcgcctcgggcagcgtctcccgccgcttgtcgccggggcagctgaggggcgcggtacccacgggacccggatgggccgcggcggggaagtgggcagagggcgcgggcggaagctggaccccgcagagagggctttcctggggcagggaaccgactggggggaaaagaccgagtccagatattccccgaggggccgggccgggccggggtccacaggccggcgtggagacctcaagccccacggcccagtggcgtggattcggtggtttcgcttaaacggacggtttattccaaggccaggggctgcaatgacactatctcccaggagagaatgcggaaggagaaaaggagaggagagcaaaagaagggaaggtggagggtgggaggggggaggaaaaaaaagacggagaaggtgggattccagctgcccggacgcacgccgcaggctctgagatctccctccggctccttggcccgggactttctgcgccctgaagaaacaggcctagctcgccggcctcccgggccacccgcgccgccgcggccgcccttccgcgcgggactcagctacccgcgtctggccagcgcctgcgggtgagagtgaagggcgaccgcctgttgatttcggctccacgggcgggtgtcacctgccagcagccccacatcctggcgcggcgaccccagctgtcttccccgcgcccctgtagcctctggcctcagggagcccccgacccacgaccctggcgcgcggcgcaaggcgatgcccaagcctgggacccacgccagcgccaccgcctccaagcggcgaccgaattactccacgtgacgcttccaccccatgcacacagcaccgggacattagctgtggccggagccgcccggggccaccggacaccacccccacgcccaccgccttggagcgcccgcgagctttcccgaccgcctccctgaggggtctggctccaggcccgcggggccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgct

SEQ ID NO: 6128 - DNA, 1689 bp, artificial
  synthetic oligonucleotide
agggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacag

SEQ ID NO: 6129 - DNA, 2352 bp, artificial
  synthetic oligonucleotide
cattgtcttcttgaacagtcgaataagatatttggttttttggtccttatttccaagctcctgggtgctagaaggttgtattcacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctgg

SEQ ID NO: 6130 - DNA, 2536 bp, artificial
  synthetic oligonucleotide
tgttcctatccagccttccctctcctttttgccgcttggtacccgaatgtacaaaacgaagaaaaaacaacaggagcagcagcaacaacagcaaaaccaaaagagaaacattagaaaaatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccgttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactaca

SEQ ID NO: 6131 - DNA, 1569 bp, artificial
  synthetic oligonucleotide
gaggggctcgccaggatctgaaagcttaactttaatatctgtcaggagcttcagaataggctcatcatatttcttaatcaaaggagtgagtgtatcaacgttttttaaaacagttagccaaaaatcaggaattcccttaggatcctcctcttctttattctcttctccagtagcctcaatgtcgtcctcctcctcctcctcctcctcctcttccacagcataatcataataatagtcctcataaccatcgtcctcatccacatattcatgtaccataccctcctcattaccatacatctcttcatgacacatttcctcatcatcacagtcctcagagtctgatttatattcacattcctcttctgtaggttcatagattgcattgatgatctgacgtcttttttccagtaagggttggtacatttcagcaaactttctttcaatgtcatgaaattccctcaggaatttggattctaaattggccgctctagtttgaagctttttaagggctaacacacggtacttaactttcacaggtagactttcaacaaagtctgtatctaaaacataaccgataagtccttttggacggtctgcctctgagtcctcatcagtatcgccaccttttttcccatcttccccggacccagcagcagtatcttcaccgttttccccttcttccccaagcccagcggcagcttcttcaccgcacttcccatcgtctccaagcccagcagcggcatcttcaccgcgctccagatgttccccgagcccttccaccattatctgattaccagcctcttcttgactggattctgacagctccttgcggttctctgactcggccatttttcaaaggaccgtacacgcctaaggtggctaccacagagatcgggagaccaaacctccacaggaaaagactcaccgaaatatcagaagcggcggtggtcggacctagcagtggcgtccggactgagggaacgacgatccaggctgctcggggataaaagatggtgctgaggctttgagaaccggactgaagcagtggcgacctgggctgggtgcagagggcggcgacggctgcgttgaccgatcctgcaggagagagccggagactgcagagagctgcagtgggcagacctcctccgcaagcagctactgctgcaagaaaaaaacggtgccgcagtatgattacgcagctatcacttgcctaaaatttctaggtgcaaatagattgctgcgtcacctccttccctcccacaactatgctctaatctcatttgctgcaatgtagtgactgacaaacccagagccagtaaattattagatctatcaagttttcaactctgctcaccttcccaggctctctaacatggctgattcatccacctcctcctcgtcctctagcccatctcccgcagagttttctggaatcccattgcgttcattagttcattcatccaacttttaacagatattatacttttatgctttccagagagctcagagaaaacgtaactaaaatgtcgaacaatgagagaagacaaggcacccacccatcctaaatca

SEQ ID NO: 6132 - DNA, 1300 bp, artificial
  synthetic oligonucleotide
ctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctccagcactaataaatggctaaagccctcataactatcaaagcaggcgtctctcaggcgtgggggctgaatgcaggtctgcggcagcgcgagagaagtcaaagcgatcgcgatcacagcctaaccagcaagccagtgggcgactgctgggagccagggcgagggaagtggccgttccactttaatcttaaccggggctgggggaggaatgtttgttttcaactgttgttcttttattacattct

SEQ ID NO: 6133 - DNA, 2193 bp, artificial
  synthetic oligonucleotide
ccgggattaaagtgctttagacatttttaaaaacagccctgccagccctacaacacaaatcatgtcttttcagataacagtctagaaaatgcaacattagaaaaaggccacatatctaaatgtagtgctgtgcacagcattcaacaatatgctgggagccaagatccagaagcaaaatatgagacccacttattccaaaatgcaaccagaagcttgataaaaatcaagagtgctgttgtcgaaatggggatgccaatttttttttaacttcgaaaaagacagaaaaccttgcgcgggtgattcggtccctcacgaatcagacagacagaagcagtcatgctgaaatcgctgaattcctcagcggaacggcgccaactcagcagcgcggtttccacactttcccggagcgggactccgctccccgcgccggctcacggccttcccgccctacagggtgtacaagacgcgagccgacgtgtgctgcggggcgcggcagagagaagcgccagaagccacacagaaaagcgtcaattcgaccgccaccgagagcgcgaaggggccacaagccaatttccgcaaaggagatgagctgggcgaggctcggtctggcctccaacttaaacctgtccgcagcctcggccgagtggcgcgtgtcctgggggcgctctgtggtcgccacggccgcccggcttcgcacctttgcggctttggtccgagcgcccggcctcggccgccgcgtgggttttcccgctctcgccgaagcgtgccatgcccatgccccattccctggccaggctctaccctgcaccagtccgaaaggaggcggcactctgccgagctgcgtgcgtgtaagcgcggcggctccggtccgctcgcttcccctccccccgcaacccccttcctacggcgcaagcacagaggcctttcctagattgcagtgcctgtcagggcgagccgggatctctcgccctagcggcctcgctccctcatacacagacacacacattcgcatacagacgtcctccgttccgttttcccttccttctcgtctagctcgacttaccccagttcattccaccccctgcggccgccaccccgagccagccggggagccggcgagaaggccaggaagctgtatggcagcgctcctactcacctcacaggccgactcccgaggcgcacgtcgctggcgggctcaggcagcaggcgctgtagctagcgcggtcgcagtcaaggctgggctgtcgccgtcgccgcagctgttcgagctgccttagccgccaccgccgctgctactgctgccgccgccgccgccgcctctgcctcagctccatacgctgggcccgccaggtggacgcgcctctctcctcgctcgctccctcaggctccgccgccgccgcgctagatggagtcagagctgtcgggctctggccctgaaactcagagcctccgcggctgcccggctgctccaagggtccgtgcttcgcttacactgtcgctcgccccggctggagctacctagcgagcgggctgcgcgctcggcgcctggagcccgctctgtgcggtggctgcggccgtccgcgagagggagagaggagggcggctgctactgtcgctatagctgttaaagctattgctaaatgctgctactgccgctaatgctactgctgtggcggcggtggtggcggcggcggctgctgctgctgctgctgatgctactggttttccttcccaggttcttcccctgcctcgtcccccctcctcccccttcctcctcctcctcctactcctcctcctccttctcttcctcctccctcttctcctccctctgccgcttttctcagagcctctgcaggcactgcctggtcccctcttctcccggagctgtctctgcccattcagaaaggtgcccagagtggggccgcctctgctgccaccatcgctgttgcccctgccattgtttcctccaacacggctgttcttgctggacgccttcccccctctacccttcttccccaccacagctctccctttccctcccgctctccttaccctctctatggtcccttccttatgtgcccccccaactctgtccgtctgtccttccctcccctcgggcgcccgggagcgcgcactgcgcggccacctgtcataaagggcgcgcaccccccttccccattcccaccccgcccc

SEQ ID NO: 6134 - DNA, 1015 bp, artificial
  synthetic oligonucleotide
ctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgcagctgccaggtcgccacactcgccaagcggcgagggagcgcctttgcctaccaggccggagaaccctgttcttcagtcgccttggcaggggcagcccctccttctggcaatgatgtcagctgcagagaggcttggcccggccgatgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaacccagatttggggtcttccctcctccatttcctcctttcctccgcgccccagctctctccctttttcagcctgcaccttcactattcacagtgactt

SEQ ID NO: 6135 - DNA, 1125 bp, artificial
  synthetic oligonucleotide
ttttcttcttcctcaccctctaagggaggcatttcactaggggtgttatcctgcacctcctcatcactgctgaactcctcatcctctgaattccattcacattcttcttctgtaggctcgtattctgcattgatgatttgaaaccgcctatcatacagaggcttgttgagttcagcatattttctttcaagatcatgaattgcttttaagaacagggtatctaccttgtcacattcatcttgaatgtttctaagcgcttgcacacgatttctaactgcctgaggcagcctatccacgaaatttgttcccaacggggcccgccgcgcccttctggaaggctcaggtaccctcttctttctatacaagcggctgcggctgctagtgctgccgctgctgctgctgctgctgccgctgccgctgctgctgccactagtgctgctgctgctgctgctgtcactagtgctgctgctagagctactgctgtcagattcttccccagaatcactagtcgagctagccatctcctcttcggcaaccccatgggcgacaggttccgagaccattttaaaatctgcttctgccatcttgcaagcctacaaactctaccagggagaccgcgcgaccagagatgggcagaaaatgactcacggatgcttgagtggcggcggcggaggcccgggctgcggaggtggcagcggcgatggcagcagcggcgcagagcggagctggagctggggatgcagaggccggcgctgaggtggcagcggcagtggaggcttgggcgacagcggtggcggcaaggcctctcccggctgcagctagagtgccgagatgtaccgcagccgaatggcgcagtatgagaccccgagatctcttctcgttttagatcgcgagccccctccccttgcagtcagacctcccgttaatttcgttcccagtgtgcctttagttcgctcctcatttgctggtccaccttaattgacaaactgtacgcccaacgaacggccaaacgccactactcctggctccgcccaccttcccagacgccgctcgctggctgaggtgcgaccccttggaaggtgtccccctgccccccaaaaagtctatatttatagttttataatt

SEQ ID NO: 6136 - DNA, 935 bp, artificial
  synthetic oligonucleotide
acattaaggttcgctcttggtgttgtatattctatgggtttgaacaaatgtataataacatgcatcctccactacatacatacatacattacatacagagtagatctctatatctcctctgtgttccactttttcattcttcccctcctcctaactcctgacaaccactgatctttttactgtctatagttcttgccttttctagaatgtcacctaaattgaacttatacagtatgtagccttttcagattgactcatttcaatttaggaatatgtatttaagtttcctccatgtatttttatggcttgctagcttgcttcattttagcactgaataatattccattgtctgaatgtaccacagtttatccattcacctactgaagaacattgtggttgcttcccagttttggcaattatgaataaaaccactataaacatccttgtgcaggttttcgtgtggtcataagatttcaattcatttgggtaaataccaaggagtgtgattgctgaatcttatggtaagagcatgtttcgttttgtaacaaactgctaaattatgttacaaagtgactgtaccactttgcaatgaatgagagttcctgttgctctacaatctcactagcattggtgttgtcagtgtgctaataggtatgtagtggttgttttaattttcaattccctaatgacatatgttgttgaacgtctttttgtatgctaattgccagctttatatcttctttgatgagatgtctgttaaggacttttgcccattgttttcactgctttgttcattttcttattgagttttaaaggtcctttgtatgttttggataacagtcctttatcagatatatcttctgcaaatattttctcccagtttgtgtctggtcttcttattcttttgatatgtctgtcacagaggagaagttttt

SEQ ID NO: 6137 - DNA, 3112 bp, artificial
  synthetic oligonucleotide
agaaaattacaaatattcagtatttggagttgtggataaaatgcaataatatgaacgtggctcggctcagcactttgggaggccgaagaggttgctgaggtcaggagttggagacaagcctggccagcatggtgaaaccctgtctctactaaaaatacaaaaattagccgggcatggtggcacatgcctgtaatcccagctactcgggaggctgaggcaggaaaatcgtttgaacccgggaggtggaggctgcagcgagaagagatcgcgccaccgctctccagcctgggcgacagagtgagtctcaaaaaaaaaacatatatatatatatatatgaatgtacattatttctctcccccacctcccagtgcagttttctgtaatacggttgggactcgctttagggaggtttttcccattaacaacttcgctgttaaataagatagaaaaaggaaacatatgtaaaagcgcccgatggtttgttagctgaatatgactcaattcttctgtttgtgaaacagcagagaacaaccctggaaatctttccttgggaagtccgtccgtgaaaaaaaaaacaaaaaaaaattaaatgccaaaacacctttaaagcgctgtattgaaccacagtatttctgtttatcgtaaaaaggagaggtgaactctcagggagggaactccaaaccacatcggccaagcgcgccctagggaaattcttttttgctctttgccgggcgaaggctaagtacaacgaagccagaaaggtccccttaaccctactctgacctgtccaggtgccccccgccccccattccagcctggccagaaaaggcctgccccttcgtacactacgggtcggtatgaggagggctccgatgaggctagcgaaggaaaggggtcgctggctaccgaaagctcaaaagtccgccccctggttgtaaaagtgcgctccacgtggcagggcggttactagggcgaaaagagtgaggcgctcgccacgcgcgcacaatgtaaatggcgctaaaaaactcgataatcaagacaaataatattttaatgcaatattaaaacgtatcaaaattaatgcaaaaacaacccatggtgagcaaattgccaaaattttaaataaaggcgggatcccaccctgcctcactcgctttaccctagtcccgccccagtcttttacatcctccgcgccccgcccaccacgtcccccaaaaaccaagggcggaggcagcgcccgtgagccccctacgtggcttttagctccggtgaaagggtcccgggatgaactgggcgcctccggggcaagccacttaccgcgccacaacgtcgggatattgagattcatcgaaaaagttctctagctcctgcagctgaaactgcgtgaacgcggtgcggcggcggcgtttcctctctgggggctgtggtccctcagcggtttgtggcccctccgccggctgtggcccctccacggtcgtctggggcggctcctcctgctcttgcttcagctcgagcaggggcggctcctcctgctgttgctccggcttggtcaggggcggctcctcctgctgttgctccggctcgtggccgccgccaccctcacggtcttggtcgtccgaggggacggacccttccgtgccaacgttgttttccgcttctgttccgtactcaggtttggaccgtgtattctcctcgtcctctcctccccttgccatcagcgaggtcacggtaagtttctcatctgggaagggaggaaagcaaaagagacaccagggcgttggagcccacggcgcgtgggctggaggaggcaggggacccgctatggaagagcaactgcgacagccgcgcagcgtctcctccgcttgcctctcccagggaaaaattcctcttttggagttcgcgaaagctcccgtccctgtccaagcactaaccattcacttcctcgatgtcctcgccgactgccaggctgcggtagccaatatcactgtgggtgtacccgcgaagagactccatgcttcaagcgctgtcgataaagctgtgcacttctgcagactctgtgcgtggttccgcggcgatcccggggttggaactggctctgggaccaatggctcgggcgagcgcttttctggcgccgggacctctttctggcgccgtctggcacttgcgcgccctatatagcggtacggtgccttccgcaggttcaaagcgtatgcacacgcgtcggttaaacgccccctattagcattcacagtacatctagttgtgagtgcgacccccgggggacgcattcgtgtccagggcgtacgaaaaatagggcgagcgtgcgcaagcatggtgcaggtagtgaacatgctttgcggggaacagtggccccaaattgctgcttaactaactactcccaacttgagcagagacccagattggaaaaagcggctgggttgtgaaagccgatttgggggcgaggagacgagggggcgagggggcgagggggcgagggggcggggtgagacctcgcaccagcccgtggagaggtattttggcagtgttcctccgcccaaccgtctttaccccgcagcacttgggtggagcgatgccctttgcttcccccacggaaaagaccgagagatggcgttgaggaaagcgcggaaagttcagcagcccaaacatgcgaaagtgaacttgttagtctaccatgcaattgggttctgagcacgactctcccctgctagaaattagtgacaaatggataggactatctagttctgtacagttcgcgccaaagtcaggatagtgataaggtgcaatgattggctagaaggctgcttgctctggatttttgaattcagaacccaccgtgcattccgggagcgggaatttggggctgaatttgaagagcagtccgctgctcaggtgcacgctgcaagaaacccaacgtgctttttgagaaagctccaaggacttaagctttttagtaatgaacttatgtcagagtgcaagtatagaaatctgctaagtgcatagtgcatccaagaatgcttacactacgggggccccgtcttttgatgcgcggcacttgaaacgtctgctgtactaggttcctgcgcttcttatt

SEQ ID NO: 6138 - DNA, 1861 bp, artificial
  synthetic oligonucleotide
caaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagc

SEQ ID NO: 6139 - DNA, 880 bp, artificial
  synthetic oligonucleotide
tggggggggggcgtgcaaggagagcggttgcctctgcagagagtcagagagtgccaggcacacattaggagtacccaataaatgccgtaagcaaaactcagagaagcacgctcaaactctcctcagtttctgtctctttctgcttacttaacgatatcgtcacctcctttccccagctcgctgtgtcctctcttccctgaacccctcagaggcagtctctgtcccggtttccctctgccccttcgccgtctctcctcagtcctccccttccttctctctgctcttctgcttccactcattccactatttcccttattttttctcttttctttacccatttcctctactttctcccccatttccattcttttacctttctttccttatttcttttctccttttctctatttcctcatttcccctttctcccctttcctcttttctctcatttttctctcccctacccccgccatttcccttattttcccctcatttcttacttcagcaccccctctttttcctcacttcacttaccttctcctatttctccaaatttgttgtccttctccttttctgaaccttacctgccaccttagttgatctccgtctgtcgttaccctttcaatagatgtagcgattgcatgttcacaggcctgaggggcgtgccccagctctgtaagatggagggatgttctgggtgggcaagtggtgggtttccagggtttctcaggactcagagacttggaatactttaaatgtgtaggattaaataacgattagtgtctgaaaaaactaaacttttcatgacgttcagttttcacgtaaaactgacttacatttcagtcagtactccccacccccgcatcggctccttcattca

SEQ ID NO: 6140 - DNA, 6297 bp, artificial
  synthetic oligonucleotide
tttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacataattagaaaaggctgactgtctgggttcagcaattatgccccacgaatctggtagtccttgagtagagggagctggtgtattgctctctcttttagtgaagtccatgttgacgtagtcactagagctgtcagcttctctctgctcatgtgtgggcttttgtggttttggcttgattttatatccttttgtaataaaagaaagtcggttaggtctcttagctttattctttgggggctcatgatctgaaggctttgaaggtgatcccccatctccaggctttgagaatgatccctcacctgaaggctttgaagctgcatctttggggtcccagttataggagacttctttgtctaggcccctccccaggaactttccaggtaacattggcacatactcactgttgtcattctgtcccaaaggtgagctccgaaaagggtttggtagagagaagtaggagctccaacttttggaggaagagccaccctgaggatttctggggttttttggaattgcaccggctccaggagccataaacatgtagtcactctcactgtcattgtcctttgagtcatcctctttattagtatcaggtgcttttggaggactcggagcaggtggtgggctcactctgggaaacatcatcatgtaccctcttgaatcttcaaaaggggatcgagagtggcgcttttttgaagcagagacattttgaggagccattggcatataatcactggagcttacaagaggggtggccacccctggcctcattggcacgtatgggtcatcctcatcttcatcaaaagctctggctctgtggggacctcgagctgcaccttctgggatctctgcatctttcacttctttggcttctttgcattctttcgtggctcctctgtcaacacaaaaataaagtctgaatcttcccccagacttcccttttccaccagttcctccagctggtgggggtggaggaggaggtggtggaggtggtggcatttgctgttgcttgctttgagttaatttgccaaaataggatcttttcttcagagattttccacgttcaccatcaccatcggatcctttcccacttcctgagcctttgccccccccagagttcttgccaccacctgagccatggccatctccaggtccctggccaccacctgagccatgcccacctccaggtctctggccaccacctgaaccgtgcccacctgcggtgccctggccatctctagagcactggtttcctcctgagccctggccatttgagccctgaccacctcgggatccctgtccctcgcctgaacactggtttcctcccgagctatggctactggagccttggccatttgagccctggccacctcctgagccccggccatttcctgagccccaattgttcataggcatgtagtcacctccgcttccttcctgatcttctttgccctggggattgccttcctccccaaagttgccagagccagaaccagacacttcagaagacaggcgagctccattgttcggggcttctgcagggtgccggggacgtgctgggctgggtgctaagcggcgaaaaaagctggccggcactgaaaccgctctccttgacctgcgccctctgggcaggtgcagtcttcctcgcctggagtgggccacaggctcgctgggtgttacgaagcgcctggtgaaaagcatctcgtcttccccgtcgccgatggccctgaggtggcaaaactgctcaaagcgggaccttctgagccagcctcccggctcgagcggcaccaagcccaggtgcctcctagcggacagcagggttaacaggtgggcgccgatgctgatgctgtagctgcggcagcgggctctgtattcgtctgcacacaaggctctcatcttctccaaaaacagctcatgcatgttttgggcaaccacacagtcatcgacctgcatccagagctctcccggaccgatgacagtggacctgcctacttccaagaagaaatactgctccgagtgtccacagcgacggatgctcaggagctggacgaccacgctggccacttcggtgttcagcctcacaaacacgacctcctcgtcggttagacacagccggaacacgccgctcagctcttttctgtgccccagccccctgggtttgactattacctgccacacatctttatagaagggtggctccgccgccgctgccgccgccagcgcggccggctctccgtccggctgcgcgccgagcgtgccgcagcggcggcgcttgctctcgaggatgaggcggctgagcagcaagtaccagctttcctgctccgactcgttctcggccaccatcgcgaagtattcgtcttgggtgaaaagagcaatgaggtgtcggtaccttgcatctgctcgctggctcacggaaaagcactggtatagggtgatcacgcgccgcggtggaatgagcggggggatcgcggcgccagaggcggccgccgctgctgcagccgccgcggcgcggacactgtgccggaacttcctggcattttcgtagtattccagccgagctggggcgtcagcagtctcgagtttgagcacgaagtagcgcctgtgcccatgcttctgtttccgcaggtagccgcgtttgcagacttcctccccgacgggcaggtcctcctcttcggactcggagtctgaccgggagccagtggccgtggagagccacatggctcccggacaagacgacccggtcccaatgagtgcggtcggggttcccgaggaaagaagcggggtggtcaccactgctgctagagctgccgctgccgccgctgctgcacctcttagtcttcttgtcgcttggtcgcgagtgaaggagcaactcgccatggtgatgcacgatggttttaaggtgagcgaggaggagggggaattcaggaaagggagggttgggggaagaggctgtctaccctcgtctgcccgccccagccccctcctgccttggcccgcgcccccgcccactccactctgagcgcacgacagcgggcaaaacaacacgtgaccacagcctcacgcggcggccgctgcggatcctgctaccggcgcaatggaggggcgcgagcggccaccagtagaggtgagcaagggaggagacggcgggctcgggaggcggagccacctccggctgtgccaaatcctcccggtcaatctccaggcctgtgggccaagggaggaccgagaggaggaggcgggctctctggccaagctgattctaacagggagtccaggaaggcatgagggggcgggagaaggcctggaggggcggaggagaaagcggccggctatcagggtcgggagagggcgccacagtcggggccccattggtgggaggtggtgggagggggcgtagcgcaagcagtgcctgcctgcggcgccagggtgcagagcgggcacagtcgcgggacagtttgtttgtttatttgggaagcgggagccaggtgaaactgttgcaaggctctgattggttgggataggagccaatgggagggtccggcaagaaggcagccccgaaatcattagtttggcgggagggaggggtgagaggggagaggggagagggggcgtggctggggtcccaaagtggcttcgctgtcggcttgtggcgctctcaggcggtaaacaaccttacgcaaatagctgttaatggtggtggtaaactcgtgcaaatcccagagccgtggtgacccgggatggagtcgggtgccctggtactccctgtcaatcacataaattctctgttcctgtcacagtctggttcattctttccagccgcacaaggcggcggatcgagcttcttgggagaaagtgtcggcaccccctgaaaacgggttgacgaccagggcgctcagaactgcttcccaccgctctgcaggcactcccgagcccgctgcacccctgacagaagcccgcgactctgaggcacacgaataacagcgatgcattcaaaatgaacatgatctttattaatcagaatgcacttctagcccacgaaacacaggttccctaaatacagtgtttctgcctatttgattaacgatgactatgaaagcacaaatttgggggcctgcaatgtatacagccatattggaaaaaattggactcgattcttactgaaataaccagtgttgggctgtgaaggtatttttctgtgggaaatgctttggaaggtgcctttaaaagaatctcaaaatattgctttcctttccttgagcgagaccgaaaaactttagaaaaagaaaagctcatacctagaacaaaggaccacgctgaatgcatattctagagcacatttcacatccctcgcgtcaacaagaagaagaagaggagctttgatgcatttcagtctacaagttgacatcacaaaagtaagaactactgcctccctcatttctggaaaaactgccggagtgtaagtgcaacctcctcaagtctctctctctctctccctctccttctccctttccctctccctctccctctctcccccaccaccccagttattacttgactaggattttagactcttaatggtggagatgggtcgtgaattatcaaaggagtgaccaggtttgcaaagaggaatggagggagaggaggagagaaatacagcatttctctctgaaagaatggaatgtcagttcacccttgctctagggttgatatggcaaagggtactatttataaaatccaacagtaaactaggcaatatgtatatcataaaaataaaccatatttctgccctcttaagaatttgctctgttagaaacagaacacacgtatttgaataaatggctcctttttgatgctataatttaagagaaaaagaaattggtttgggttgtcccccagatattacaaatattcaataacattccctctgctgccaatggtttataagtgcaatatattcacaggtgctggaagcagccgtggtttcggaagggagctagaggcagaacgagtgtggatgctgagagatccctgact

SEQ ID NO: 6141 - DNA, 1660 bp, artificial
  synthetic oligonucleotide
gaatatgctatacagagaaggggagagaaaagcaaagaggggtggggaggggaaaatcaaggaggcacgctccctttatcctccccacccctgtctccaaaaatgtccaaccctgagctcttccttttcccttctttctgcgcccggcttccctctgctcctgttctttattcctccctttggggtggctgcgagctgcggacaacccgtcgtggttgtgatgtggggtgtgtgtgtgtgtgtgtgtgtgtgagagagagagagagagagagagagagagagagagaaagagagagagagagagagagagagattgagacaaccgtggtaggcaaaagcacccctcacctcccccagcccccgggccgaagccactctcaatctcctggcggcggggcggggcgggggaggcggggaggcgagagggaaagagggaggacggggcaggcggcaggggcagcagctcctgccttctttgcagctccgcggccaggggtggaaggaagccgcagccgcagccccaagtcaacccccgctgccccgtcccaccgtctcatctctcccccctcggtacggaattttctgtctcgtttgtttgcttccccagacctccccctcccctgggtggtggcagagacgggaggggaggtgggaggctaagcgcgggtgcgggtagaggggacaggagtccctcggagcatatggctagcagagtctctctttgccccttggcctgaatatcccctgctttgggcagtgacctttgcccacccccgtcagcctgggctctgggccggtggtggcgaggctgctccggcgaccataggtcattcaggaggaaggggagttgaacctgggggagtaagggcggcgggcggctggtaggacagggagacagcggagcgctgagtcgccagggactgacctggggtcctatggggcaggcttggatccctgatagatctagattaatctagttggagctacctaattctcccatccgtgcccctctcacccatagggtcgatctcccaagatccagcctagattgatacagggagggaaagtgatattgtaggatgggggcggggggctaggttgcttagtggtatctgttgtggagggagaggggcggtgtcaccggacacttgggccactctttgatctttacgccttcctttcacatgaagcacctctccacttctttcaccttatagcctggcgctcagaatgtccaccctcttgagcccaactggaaggggctaaatagccccacccccaccacaagcctgagacttctacctgcaacctgcaggcgcataggtccactagctggcagcatttcatggcctggccgcacagccccaaatattggctttgtcttttatctcccttcctagcgctctcaggaaaggggcatgtgagtctctgcctttctggacgccgggctggtacctgaaaacctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtgg

SEQ ID NO: 6142 - DNA, 1082 bp, artificial
  synthetic oligonucleotide
ctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcgg

SEQ ID NO: 6143 - DNA, 3423 bp, artificial
  synthetic oligonucleotide
aaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggtactagaggctggttagatttctagtctacttatcccaaggggagtctgccgggaaacctggggaactctttcctcttcttttcctctacaggtaatagtttatcc

SEQ ID NO: 6144 - DNA, 2105 bp, artificial
  synthetic oligonucleotide
cccgttctcgtccacggcagtccacacctccgtctctgcaggcgtacgcgggtctcgggaatcacctccggagcccactcagcagcggggagggcgagggcgaaagcgagagccaggaaagcccgggctctcgctgtaagccccgcgctcagtggtgtccccctcccctcggtggtggggccgcggatacctcctcagccgcctcagctgtcggagttcaactggtgggcggcccgtcccgccgtggccgccaccgccgggtcccctcagaggcctcacaaagccatgctccagccgcccgcacctgattgaccgaccccgggctctggctctgcctcgcgccgccaccgcctccgccgccgcgcacgcgcacttcgcgcgcctctgttcccggacggcccccagagcgggaacgccaggctgcgagctgctggcacctgtctgcctgccagacagaccctgggctccggcctcgtgccggcacgcgcacgcgcacgcgcctcgcgcgcctgccgtcggccctgggggcgggaccgcgcggcagcgagcgggcggggggctcgtggcgcgcgcgccccgcacccgagggctgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggc

SEQ ID NO: 6145 - DNA, 1861 bp, artificial
  synthetic oligonucleotide
gtgaaaaagcgtgttttaagaagatttctcttgatttctttccttttcttggcccatcgtatataaaatactcccatcttcactatgtgataattcatcgaattatagttttgtgtggttttttaaatgcatattagactgcaataaaaaatgttttaaaaatagcctgccttattaactaaaaataaaaaagttgttgtcaggaaaaacagcatgaaatcggtttccatgctgcttacacccccgcactacctgcaaccactttacagaacgttagcatcagacctgcttatctaaaatcctgccaaatgtcctcacagtctcctccgctgcctcgctggcttctgggcagccagggaccagccctccatggctcccagcatcggcagcctcgagggctgagagccttgtttgccccgctgcctcgattgagggccgcggcccggccacctgagcagcgttcccaagacagggagcgcatccgggcgggaggagcacccggtccggggcagacgcctggccgcccgggcgaatctgcctctgccaatgggtgacacgccgattttgccccctggaaacgccaagaggcgcgaagctgggccaccttcgccgcgggctgcagcggcgctcgcgcgcgtttcccagaacgcagagagagcgcgcgcggaggccggggcaaccccagaaccccgctcggtttatcctaacgacccccatgccggctgctcctcgaggacggggactggacccgcagcaccccctcaggcacctccatcccaaacacacctgccgcccaccctaagccaccccccatgtgtacccactcacccaggtcgccccaagaaagaaccccgccactcgcacagagaggggtgcggcccttggatgcacgtccggacgatcctgggccagggaaagggcgtttatctcagctctgcgccgtgccccttccccccacgctcgaggacctttgccctgggccgccgggcccgcccccccacaggaacccgaagccctcgggcgcccgccacactctggggataataccttgaggccggtagttgggctgagaggtccgcaccgcgcccggttctgcgatcttccctgggagagaggttccccgcgcagtcccctcaggccgggatcccgtcccggagccgccgccgccgcgctccatcgggatgcgccggccgcacaggcgcactgccaagcccgccgcgccgcaccgaacccgcgcgcgtccgcatgcgcacgcgtcctcacgcagcacgcgcgcagggcgtgcacgtgcgataagcgcaccggttaccacgcacagcgcacgcaaggcgtgcacgtgcgataggcgcaccgcttccacgcacagcgcacgcagggcgtgcacgtgcgataggcgcaccggttctcacgcggcgcgcgcttgtagcgtgtgcatgcaatgtgcacaacagtcctcacacagcgcgtacgggcgtgcacgcgtccttacacgctgctgtacacagtgcacacacagaaggcgtgcgtacgcacacagttcttcatacgatgcttacatgcaacatgcacacacaacgtgcacacccagcgtaaatgcatcttctcacagtagcagatacacactcaaagcgtgtgtagatgtagggtgcagtttctcagacaccgtgcacacacatcctcactcaatgtgtgaacacagagcacataacgcgcacacacgtgctcactcagcacgcacacgcttacactcactgggtgtctgcatgcaaactcagcaatgcagccttgggaacaatttctggctaggcccccaggtgggtgccagttgggccagtgacatctgtgcagacgccagaggacc

SEQ ID NO: 6146 - DNA, 1716 bp, artificial
  synthetic oligonucleotide
cccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccatccgtcgtgccccaaacctactccaaggacttctgatagggaaacacaaagcagcagctgtttggcaacatttctacccctcgccagcaactgtggtgggatgccatttccccacccaggcggagcttatcctgaacaatagtcgggctttaaatggcaaacaagcaaacacacagagcacaaccccaaccccgaaaaagccaccgcggagagaagcaataactccctccgcagcaaaaggcgccactgaaacgcacgcaaaaatgcagcgagaacgttgctcggtgcctaacatggcagaaagcccgagctggtgcggccaccccggggctgggcattggggggcaccggggctcccggggcgccgacgcacactcacccggctccgggggggatgcggggctggccgcgcgtcacaaagaggagcccggcgcaatctggcaaaacccaactttccaccaggctcgccagggccgccagatacgtcaacagaatccatctttcgaagggcctggaaggcgccgggttttccgggccggggcagaacggcagatccggagactgcccggtgcggtgcctgggcgcggagtccgccgtgcaccgccctctgcgcccgatgccagtgcgggcggcggcccgaaacccacttcggggcccccgccccgccggccggcgccgcctccccggcagtccccggccccgccggccagtgcgcggcgccgggaacgggagcggggccccggcgcgccacacgggcggcggcctcggcccgcgtccccgcccccgcccggccctcccagccggccccggcctccgggcgccgtcctgcccccgggagcaggcccctccccgggcgccgggccccgccaggcgcgcccagcccggcgcgccccctgcgtcccggtggcagctccgcgcggggagggcgggggtgaccccggcccgcacgggggcgccgcggccactacctcgcaatcgcggccgccgcctccaggaagccgcggggtggtcgagtgtgctggaactctccggtctggcctcgccgccggccgcctgaagggggtgcgccgcggtgggagccgccgtcgccgctgtcaccgagtcgctgtcgccgccgccgctgctggttgtgcgtgagcgtgtgtgcgcctgtgtcctggcgagtgtgtgtctgcgtgcggcgcccggcctttactatatacaccaaggggtgggaggaggcggggaaggggagggcttgggggaggcggcggaggagggggagcaggaggggggcgaaagggtacccgaggaggcggcggcggaggagggaca

SEQ ID NO: 6147 - DNA, 1740 bp, artificial
  synthetic oligonucleotide
ggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcag

SEQ ID NO: 6148 - DNA, 1424 bp, artificial
  synthetic oligonucleotide
tggggtcagtgggaccctgtttgtacagacgtctgcgtcttccggctctttaggacataagcagtactgctatggaagaaaggaaacctaatttcccatgccttgtccctttctggaaagggcatggcgtggtgtgggcaccacacctgccccagccttctagcaagaaaacaacacaaccttccccgctccccgaaaagagcttctctccagttgggtctagatgcccccttcccaaccagggcggatggccaaaggctccgctcccttgcagggtaggcttggaaaggcacggggcccgccttcctgggcaccggagcctgtgacgggcggagggcgtgcggcgcgctgggttagttacctggcgctgggcggggcaagcgggaggcgggggcggggccggggtgacatctcaggctgtgattgggccgcgccgcgcctgtctccatgtgccgcgcagctgaggcacaacattcaagcccgggggtggggccggcgcgcgccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctc

SEQ ID NO: 6149 - DNA, 1779 bp, artificial
  synthetic oligonucleotide
tccctacctcggatttccacacgacgtaggggtgcccgcgactgtcgggtggggactggaacttcctctgctggagccacctcctaggagaagcgaagatgccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaagggtcgcgccagctccactcacgtttctggaaagg

SEQ ID NO: 6150 - DNA, 1122 bp, artificial
  synthetic oligonucleotide
ttttataagctctcttagtataggccacccaagagagaaaacagttttgtgccttagatgaaaggacaacacaggaaattataacaatggtaacaatccttttcttcatcatcccccaggagtcctggttgcttcctctgcaaatcagtgatggcttatacaaagaacagtattaaagactccgcggctggacgcggtgggtcgcgcctgtaatcccagcactttgggagaccgaggtgagtggatcgcctgaggtcaggagttcaagaccagcctggccaacatggtgaaaccccgactctgctaaaaatacaaaaaattaccccggggcgtggtggcagacaactgtaatcccagctactcgagaggctgaggcaggagaatagcttgaacccaggaggcggaggttgcactgagccgagatcacgccactgcactccagcctgggcaacaagaacaaaactccatctcaataaataaataaataaataaagattctgctaacctgtggcgggtctgtttgggtccctgtgtattctttcctaggaaaagcatgaggattagggttgggccatagggtctcattcctccaagagtaatggaacaccagctgcagcagctccagtctgtagcaagggttcagaacttgtccatgacaaggtctcaaaacccatctttcaagaaaagccaggcttggcccgtggctctgcctgcccatacattattatcatctgccaaatacaatatagtagttgatcaggggacaacttccaggaaaacacagctgcaagtctctctgatatttcatggttcttcaccactagagagtcccagaggtgaaagctctgaggcaggcttccccactttccaggtaactgctatttctgggaacttttagtataccccacctagtgtacaggaacacaaagggaagctgctactttgagcaaagcatccctgtgtgtgggcctctgatgtagctgtcgctttctaatatgtctggtgtgattacgtgtattcattattctactttacaataaccagtataaaacagtatgctttcttttgcttcactctgaccttggacaagtcactcaccctctttgagtcagctttcttatt

SEQ ID NO: 6151 - DNA, 625 bp, artificial
  synthetic oligonucleotide
tcaacatgtatcactttgttaagagaaaaatagaaaaatactccgtatttgatcagaccatgtaattcagataataaaactgttgtaagttttaaaaagccacaatttctagtttactctttcctttgatagcattagtgcagaaaatattttgagaaacagatttgtactttgtttacctatacttaaatgtgttgttgtaatatttcttttcaaaacagtggcaccatatttctttagaaagtgcaacggcactcactgtttagcagcataaaaaatattatttgtgaaattacaatgtactccaaatagagaaaaatatttcagtgttttgaagggtaaaatacaaaaagcacacaagggggcagcaaaaaaaaaaaacagcagagacggtttcaaaaggaacttttctatggtattaaaagacaggagagcaaaataatgagtaggaggtttttggattacaggcaacgttaagttcttgatgtagatgctggtcacctgcacctagaatagggtgtcctgtgagacaaaacaattattctctatcgttaagagagattgttcaggaatcctaatagtttgacaattctgtaccagctgaacatcactagagctaactcag

SEQ ID NO: 6152 - DNA, 1538 bp, artificial
  synthetic oligonucleotide
cgccgacgagcacctggcccagaccaagagccccgggaacagccgtcgtaggaagcagccctgccgcaaccaggctgccccggctcagaagcctccagggcggcgtctgtttcctgagcctttgccgccatcttctccagggttccggcccagcagctatccctgttccggggcttctacgtcgagtcaggcaacccagccaggccctgcactcctaagccacgcatctgaggcaaggcctgctacccgaagccgcatcaccctggtagcttctgctctccgcagacgtgcatctggtccaggccctgtcatccgaggctgcaccgcccagccaggccctgcttttccacaccgcgccactcatctagaccctgctcgtctaagccctgaatctgcgccaggccctgcccgccgaggccgtgcatctgtgccaggccctgcccgccgaggctgcgattctgcgccaggccctgcccgccgaggccgcgattctgcgccagtctctgccccccgaggccgcgattctgcgccaggctctgcccgccgaggccgcgattctgcgccaggccctgcccttcgcgtccgcacagcaaggtcagacgccggtcatcgcagcaccagcacgacgccaggcactggcctccggagccgttccacccagcaaagatcagcccttctcagccgccgctctctgtctgggtcagctgatgagaatccttcctgtgggactggctcagaaaggcttgcctttcagagcagatcaggctctcctgatcctgaggtcccaagccgtgcttccccgcctgtttggcatgcagtccgtatgcgtgcctcctcaccctcaccccctgggaggttcttccttcccatccctcagcagtgggatgagagctcctcctcctcctatgcttccaactcctcctccccgagtaggtctcctggcctaagcccctcatccccttcccctgagtttttgggcctgagatctatctccactcctagccctgaaagccttaggtatgctttgatgcctgagttttatgctctgagccctgtccctccagaagagcaggcagaaatagagagcacagctcaccccgcaacaccgcctgagccgtgaccctctataagcatcctctaagacccacagaaggaatcaacatttacccactttgtgaatgggctgcctgccctgtagttagctgcgaggtctcccaaagttccagccgttaaccaacatcctgagtagtttagaagcctctcctccccatgactccaccacctagcacttaacctgctgttggcctttgattctgggccaccttcttcctcaagagtttgcctttgcccttgagctgagatttctgttttccaagttgcttttctgttatgaaatgttttaattagtaaaataaattgttttgtttaaacaaaatgtagaggtgtgtttttttattgcggttcgaaaaatcgttaatcctatatcatatttggagggttaaagaaagttgttaacatactagctgactctttggacg

SEQ ID NO: 6153 - DNA, 1620 bp, artificial
  synthetic oligonucleotide
catggttacagggcaggtatgtaacagcatgagcacggaaaccctggtatgtaatgccaacgcacacaaggacggcagcataggcaatctccatacctatgtgtggacaatgtaaaaatacctcttgggagaaggggctgcaaatacagtttaccaacatgttacaccagtaaagctgtcattttgagataaagggaagggtctcccggacccattttcaacaagtggccaatcttggtagtgcagactaagaagcagcccagtaagttcttagaaccggaaactcccctccccccaaacacccaaccgcgcagcccacgctgcggggccacgacttggccggatttatgttcatggctgaggatgccatgggccgagtaagaaggagaaccgccacccaaccacgcagccaagagcaacccagggatccctcctctgcttgctcccctcccccacccctgctgtaccttctgcgcagccatctcggtaacgggcgtcaggggcgctcggcggcctgctgtccaagctggggtcaggagcctggcggtagcaaagagcatcaccgaaaggaagctggtaggctagcgaggccagccccaaagacccacagatacacgcgctgctccgaactcgcgggcccgcggcgtccactaatgagatgaacctgggcgcgcagcggctggacctcagctgctagggcgccgccaaggccctgctggacaccttctggtacctgggcctcgtgtattacacctgtggctgccgccgaggcgcggttcaatttgaagtctgagcccctacaggcccgtgaatcctggattacaactgcagtttgtgcaagaagcagcagcacctgcacttccacttagcaacctccggcttcacgctcctccagggcgcagagagcatcaaagcattatcaccgacccaacacacaccggcgctgcgtagtttctgcagcaggtgtggggtgaagagttgccacacagctgtctgacaccgggtgtacggcgtcacccctcacttcctggacaaggcaacattttcctaaaggtaaagaccatgaacatgtagaggcccccttactctcatgctagtccgcattcagccggaagcaattcagcaaatttgccatttaagtgacgccctggatctgtctttcagagtagtggcttaccctgcagcctcatttctctgataagtatttttttaaagccattgattcagtttgttcatctttttcttgttggaagaagggggtggggtgacaatttccagcttctttacatgaaagagctgaaaccagaagtctcgcttgtgaccatttttgcaatatactacaatcactataagcctatgatttagaaatatcatggtaaatgcctgagaagcagaaaaaatagttgaaagaagttttctcagggagccagagcaggagtgggggcgagtatggatttagattcaaatgatttctggtttcattaaaggctagtgttattctttaagaacttttaagatcatgtatgtatattattttgagaaaattaaagaataagtgatgcattttatgtagaaataatctatataaattctacatagaaaaatacgtagaaataccaa

SEQ ID NO: 6154 - DNA, 968 bp, artificial
  synthetic oligonucleotide
gcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtatgtaccgcttgcgcccgcacagacttctgtttgtctgccttgcttaaaatgcatcccgcctggagcacctctcgtaccatgtgcggtctcatgggcaggagggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggcgaggggtgggcggggagtgtgtgtgtctgcctgtgcgccctgtgatgtttttggttcttttatatttcacacatattcgtgggtgcgtgcacatttttgataccagccttgtggtttgtttggtagtggaggcctttaaagtctgaccagcttggttgtgtggcatcttttagtatttttttcccttgagttgttttctccttcacagcgttcgc

SEQ ID NO: 6155 - DNA, 445 bp, artificial
  synthetic oligonucleotide
gagcagacacttgattttgctcactgctatatccctagcacctataatagggcatgacatagagtaggaatgaaataaatatgttttcaataaatcaatgaatgaatagtatttttcatttaaaaccagacctttttcttacatttcttctggtgactcaaggccttttctatcctattctgaatattgtagcttccgcagatgttgtctacagaatcatctagaacaaaagatctttacaagtatccaacaactgaagtaactatacccgtattggtcatgtttaaagccatcatcattgatttaagaaaccacatcttctctaagagcactcatctctcagtcacctccctactagcctttctaggtgtcactgagacaatgtcccatacttccacagatcttgatcttcatagacagatatttgcctgaacaagaacacatt

SEQ ID NO: 6156 - DNA, 670 bp, artificial
  synthetic oligonucleotide
cttccttccccttcatcactctcttttttgcctacttgtccttcagtccctaggttgaccatcatctcctttcaggagccttttcagcccactgaaggcataaaagtgtccccttctctatgttcctatagtagtattctatggatcagtccatgatcacccttatcccttatgtctgtaattgtgtgtttacttgtctgcgtctctcaccagactgtgaatgcgacaaaaccagggactgtgtcttggttacagttgtatccccagtatcttgtacaatgccagacacagagcaggtaccctgtaaatatatatgttgaatgaatgtgtgatccaaatttgtaacccaagtggtttaagacattgttttgcaaccatgaacatacaaaggggatcacttgtgctggagctatttttccccactgacacagagatatcctttgagggagcaaattatcatgccttatttatatttctcatagcctcacatagtatggaatacatagaagtatctcaaaaagtactttttgatttataaataatgctagagcattattttgactgcatgtgatttgatactgtttccatttaattcagataaagagttgaagagcccatttttatcttgctctgatggcccagcctttcttacaggcatttctcccttttg

SEQ ID NO: 6157 - DNA, 3478 bp, artificial
  synthetic oligonucleotide
gttttttccccccaagcttgcctcgaggaggcagtgtttgaaaacaacatcaccccagctaagatgacaacctgtttgccttgaatgttaagatacaagccagctggttgcaggtgccatttgtctgaggaagatgcaggagagaatgatcctatcactgaagatcagatgttcccagctgcaccagagagcaattgcatagcaacattgagggtgttgtaaaagggtttggctccaagcaatttaatttgagcacgtacctagatcctttacatccttcaaaattctccagagccactgattagttaatctgcatggccttcttaacggatggtcgtggttcttaaccccattctacagataagtgattcaacaaatgtctggctctactaagggcaaagtcaaacccctgggatcctggtctcctgccagtgttgccagatgtctgtgggtcagctagccagcacgtctgagtgggcactacgtagaggaaactaatctgattccccttaccttaatcttcctcatctgtctggcaatgacattttcctgtcaaacaggtaggagatgctttcgcatgggagcaggggatgcttttcactgggggaagggtcctggtcgccagtcagcctttcagaggccaaaggggagatgcattctctgggtattacgtccccacgtgtcagtttcacagccatgttcccaaaatttcgcttaagatggccacaggtcaggtgattcctgcttgtctctttcccaccagcttaatgcaaactcttccaaaaagacaagatcaatcacccggtgagggtgagctcccaaatctagccaccccaactttgcccttcttaagatcactgcaggaaagggtattttcaggaaggggagggatacatcccctggtgagagctagggtgttgaatttttaaaaacttatcagagtctcccaccgtcatgttttatttatttttaaacctctgcactttcttttctctgtgaaacttttcattttagccttctttttcagttattcgtcattgcagatattttgcaaactcaagcctccctactaagaactcaggaagcaaccaatgcttccatttcgtgatgccaatctgccccctcccctcccgcattctacattctataagtgtgcggtccacagcagaagggttcctgagccgtgtccttatggtctgctaggcagcaggatggaccggtattgttcgtgtgttgtgttattcgtttgtgtgtgtgtgtgtgtgtgtgtgaatgcgcgcgcgtgtgtatgtcttcctgcaggggaagctaaattgaggtgtgtgtgtgcattatcctggttttcagttttgtggaacgaagtttagggtaaaggaagagtagggagagtgcagagaaagcaggaaagacaggcatactcccgcttaagagcagacggggtttcagggtccaaggtaaacacgaaaacctttttcctccctactccccttgggcgagtgccagaagattctccactcatcttttcccggctaagtgtaacgatttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccgcacaccgcttcaggtctgggcagcctgagtccctaagcctggaaggctaaagtaccctcgggcgccccgcccactccagtccggcagcccctcgcagggtgccaaactttcccccatcccactccatggctggcttggctctgaggtctaacccgtgggcgctcagcgtctccctatgctggaacacgcccctcagtgtgcgcacacctcttcgtaagcagccacgggtccgatgggcgggaagcagaggggcttgcgaacgcggactgggcagagcgcttgatgacctcctagcgacgcgcgggaggggaggggagagacaaaaaggggagggggagtggagcggcgtggaggttggggggcgggctggagccttgccgtgtttaaccctttagtgacacgaat

SEQ ID NO: 6158 - DNA, 1921 bp, artificial
  synthetic oligonucleotide
acagattgatgggagccctcactcaattcctaaagctgtgggtagccttgctgcctctgagcagaggattgtccctggctgaacacaattgcctcacatggagtcaggagatatggtagtttgacagtctatcacacttggagggaaaagagagggaagagaagtgactgcatgagacactagtctgtcaaagaagaaactatgttgtgggccttggttccacagaaattactggccaggtaacaaagctgaaaagctgtaccaatgtgaatgtattcttggtaacaggaggctatcagggacaagcctcctggagaaataatagtgaaatgaagtgctaacagttggtgagtcctgactatgtgggaaggactatgctaatcatgttacattggttatctcatttgattttagcaactctgaaagatagacgccatgctaatctgagtcttggagagatgaagtagtttccctaatgcgttaataaatgacagagctaaaatctctcttgaggtttcacaaggacatgaataactagttatcccttcagtggaaggaaaaaaggaaggtttaaaccactggtcttattggaaattatatcctattctaagtcaatcgacagaagaaggcagatttggcaggagtttggtggtatgaatcacagcttgttggttcagttttgtttttgtttttaattttaaatgctaaagtaattaaagtaataattatttaatttacacagcactttgttggttataaagatattgaagattctcacttgattctgaacacaaccctgaggggtaggccaggtaagtaatgctattggcctttttttttttcaggtaataataccgtgactcaaaaaagtgacttgcccaaggtcattaagtagtaaacttgttctggccttctgacttccagtacaaggctcttttcactgttatcgccacactttatatgttctgtgttgtttgatatcattttgattagtagtccatatttcaaagcctagttttacctttcctgttatcctgcaataaaactctctgccatcatcactggtaaagaagtatgacataatcaagtgtgccagtggcaggcattctcttggttaacgaaagtaatatgacgctggacccaaagggaaattgtcctctgacctggatagctcctagtaataaaaaaattaacgtggccatacaattacgcacaaaagcatcacacaaggatcttactgagaaagactgagagtgcggctctcagtattgcctcccctcccagggagcaacttcccacagcttgttcagatgttttaccctagaacctactgctacctttttcacagtgtttcacctccatttatttccctgttgaaacaccatccagatctgcatccttttccaacttctccctgcaggcaaaaacaccatccagatctgcatccttttccgacttctccctgcaggcaaaaacaccatccagatctgcatccttttccaacttctccctgcaggcaaacacctggtaaaattacactcctctctagccaggctatgtataagggattaaggttgctgaatcctaaatggccactaactacagtaatcaaattctaacacctaccagccagggcttagagcaaggctgactgttaccatctggattttgtgctgctcaactcttgatagcatatccagaagggctgaccataaaagtacaaatgcaataagagagaaagagagaggggtgggagggaaggaagagatcagtggtattataactcagtctgataggcctggaaagggaggaggaagaggagtaggaaataaataagaataggatgagcatgttgcattggagggctagaggtggcagcaaacactcatagacttgtagatgacaagggatgcttattttc

SEQ ID NO: 6159 - DNA, 769 bp, artificial
  synthetic oligonucleotide
gggacctgcgtttataatataattatcatgaataatggcaaaaggaaattaaatgaagtgaaccatcagccttcatgaaatcactgtctgtctggtagtcttgctgggtgtcttccagcctcagatttagcctaccttttatgtgatgacacaatgaccatttagaaaatgggcagtgatgccaatgattatcagacatcatttactgtggaccaatataattgggaacaccacttctttttctcctgatttggttttcctgccatgagagtacacaatgacatttagagcagcttcatgcaaccatactaaagtgaaaaattagtcattttgaacatcttggcagtggaactgtataattacttctgtcaagtgtttgtgttttgtctgcattgtacatattttttctttcctatgagtgattggaggagtggagggggaaaataaaggacttttaaagtctataaacattatcataaaaaaatttcagggggcaactgctaaagataagtggagtcttaggaatgttaggggttcttttataggcaggggcttaattaggcagctaaagttctgttccataaccttgcggtagaaaatgacttatggctaattttgaggggtgggcttggcttggcagtggctatttctggtcaggctcttcccttttataattatgaaatttccttcccctgatttcctagaacatttgcttattgtcaggataattcatctgacatttactaaatctggccttgtagagttaatt

SEQ ID NO: 6160 - DNA, 1835 bp, artificial
  synthetic oligonucleotide
ttttgccacttaacgcgcgtagctggttctctccagactttcgagccttgctcttgagcgccttgatccacacgggaaaagctttgcctttacattgacgcacgtttcctttgattaacatttcagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtgagttcctagttttcttggacttcgcgaacttttccttgtccaaagcactgtcttttctctgttggtgttttgggactggtgtacacattaacccttttgtcattaaagaaggccaacacgattctcaagctagtattagccttcagtgtttgtgctttagcactttcacttaggaggtggaggtgttggttgtataaaagatatggaaataacaatctactttgatgttcaccaggtcaaaaaggtgaagacttttagaaaaaacagattggcttgtatgctaagtagggaagaccagtttattaactgagatcttgtttaaatgggcaagcagagtgttaagcctctaagtcaaactaagtcgtcagacctctcattttttctcccattcctagctcctattttttttttttttttttggtttgagccggctctcgttctgtcgcccaggctggagtgcagtggcacaatcttggctcactgcaacctccgcctccctcccgggttcaagcgattctcctgcctcagccttccgagtagctgggattacaggcgtcacttgtaattatagtgcaccgccatacctggctaatttttgtatttttagtagagacggggtttcaccatgttggccaggctggtctcgaactgacctcaggtgatccgcctgcttcggcctcccaaagtgctgggattacaccgcacccggcccctaactcctttaatatttttgcaaatattgtcctaggactggatttgaagttttaacaacaggaattagctgaattaatttggttttctttaaactggtattccatttttacatttttcttcttctttggttcattttccccctgattataaaagcaatatacgctcactataggaaatttgcaaagggtgggaaagtataatgacacaaggagagagaactactactcaaagggtatcatcactcttcactttttattccgcttccttttttttcccctatacaagatctgtttccaaactttattcataaactttcctctccttctactgatttttaaatgtaaagttgggtattttgggggttggttagggcactggatattaatgttgctcttcagtctccaaagcatgaaacttcaaggtaggaaaggtgcttaacggtgatttcatccagcaactcatcaactgagactcagacctcatttactgaagctctaatgattcatgcagaaatgtatagcactgagtggcaacattaactcactccagatctctctctcttcagagataccttgctgcttagagggaaacttgacactacccatgcctgcatatctttgaaagagaggttcagagaggagcaggagataattttca

SEQ ID NO: 6161 - DNA, 741 bp, artificial
  synthetic oligonucleotide
tcattttacccagaacaaaacccagtaatttttaagtttgagaacgattacattttaggggctgaagttttaatatgctcacagagacaaacaatgaggccataaagcaggaactgagttccatccattaagccatgagccacccttttatacaaagaaaactggtaaagtttcacccacagggccagaaatatagcaagaaagctcaccatttgtttaggacaataaatggaaaaatagtcatgtctaaaagaaagggcatataattaatcatttcaaaatcattagggaaataggcagggattttgaaaatgtgattaaaccaagagagtcaagaaagggtggtgggagaataaaatatggttaaaataaaacacaagaacattctcctgtgctcatgatgaagcaaaaggaactgagtttatctttttgtcttaaacaactaaaaacgatggatgaaatatataaaacaatggttatcaggcattggacatcaggcagcaaaggacactgatccttgaaagaatggaaacaaagtaagccctatgatcatctcagctcactttcaggtcacagcacaggcatggggaatctaactagaatctggcggactccctgagtcaaggagacacaagtgaccaagtactggagacttcacgtacagcatagtgacaatagttagtaatgtttacttgaaatttactaagagagtggatcttaagtgttctaaacacacacaca

SEQ ID NO: 6162 - DNA, 1283 bp, artificial
  synthetic oligonucleotide
ctgtgtggtatgggaatcacatgctgaaaaattaaaagctgggacagaaccattgaaacctatagaatctcagcaaaagcaaatgcaatacatttttatgatccagggtaatggaaccccacagaaaaagaaaggatctgctgaagatgggctcagaaataagcaacaataaaaatcaagtccttgcatataaatgatacgccatgaaggagagtcaccagttgccataaggagaattagtacccccaagaaatactgctgagaagaactgctactctttttttgagagtgaaatgaggaaattttcagggaaaaaaaacaaaactaaactaagaaaatttagcaataatagcctctcacaagaataactaccacaagagatacttcacgaaggaggaacttgaaagtagggagaaggggtgaataggaggcaaggaacagtgaacaaaaattgtaaacgtggggaaatctaaatgagcattaattatataaggcaataataatgctaaagaatatgggagtataaaaacaagctggcactaaaaacacagaagcacacaaaaacatgtaggacacaccccataaatatgtgcaactattatgtattcataaaaagaaaaataaacatgtaagacagcagggcactattcatatttaaagcattctaaggtggttgtattgtttggaaagacagtagggatattgcctgaatttagaccttgttaagtcaagtatgaatgtttaaccatttaagagtatggacttctaggttctggcaatggcagaattagttatttgatttgacttcattattgaattaatgaagaaatgctgaataaaatatttcaaaactactttaaaagcactgaagagctgagaggacaaaggaaaacttccaggccaacttttggatgacagctgcaaccaaacaggtaaacagaatatagaggcatcaaagccaatttgatttaagggcatttgcctacactgcccacctgagctttgattcaatggccacacaggattgggggaaagaaggcaaggctcaggatcaacccaaggtaggagtttaatagggaaccctctccacattaacctgagaccccaagggactatctctgcagcctgagggccatccagaactaagcctattatagatttagttatagtaggagcttctgttcccaatactccctgagaactataccgaagtctgccttggtgctaagtagagctctcttgctaaaaaagaaagggttaaaaagaaggctacaaaatctatt

SEQ ID NO: 6163 - DNA, 1244 bp, artificial
  synthetic oligonucleotide
aggagccgaagcaggagctggaggatgagaacccagcgcggagcggcggtggcggcaacagcgacgaggttcctccccccacccttccctccgatccaccgcggccccccgatccctctccgcgtcgcagtcgtgcgccgcgccgccgaccccggccccggccccagacccggctccgtaccccgccgcagcctaggccccggcccccgccccggccccggccccggcgcggccctgggggcggatgcctggatgtggattttgccgtggggccaccaggctgttctcacgtgaacagctttaaggtgggagagaactggaggcaggaactgcgggttatctaccagtgcttcgtgtggtgtggaaccccagagaccaggaaaagcaaggcaaagtcctgcatctgccatgtgtgtggcacccatctgaacagactccactcttgcctttcctgtgtcttctttggctgcttcacggagaaacacattcacgagcacgcagagacgaaacaacacaacttagcagtagacctgtattacggaggtatatactgctttatgtgtaaggactatgtatatgacaaagacattgagcaaattgccaaagaagagcaaggagaagctttgaaattacaagcctccacctcaacagaggtttctcaccagcagtgttcagtgccaggccttggtgagaaattcccaacctgggaaacaaccaaaccagaattagaactgctggggcacaacccgaggagaagaagaatcacctccagctttacgatcggtttaagaggactcatcaatcttggcaacacgtgctttatgaactgcattgtccaggccctcacccacacgccgatactgagagatttctttctctctgacaggcaccgatgtgagatgccgagtcccgagttgtgtctggtctgtgagatgtcgtcgctgtttcgggagttgtattctggaaacccgtctcctcatgtgccctataagttactgcacctggtgtggatacatgcccgccatttagcagggtacaggcaacaggatgcccacgagttcctcattgcagcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacatt

SEQ ID NO: 6164 - DNA, 2406 bp, artificial
  synthetic oligonucleotide
cacgaatattgtatatattacttttataataataaatataaactagcaacttttaaagtggaatgtgcatcaccctggagtacaggagttttaaggggatcaatttctatatcctcaaatttcctgtgtagtcttttaaaattgacctgccagagaacatacttgcagtgtaggaatcaaactggttctctttttctatctcccctttcacaatggtcctttttgcactttacaaaagaaaaagcatatcttttacctatcctgaatcttaacctgggtgcgctgccctgtgatgtaaaatccttggggcacaggagagacaattccgaacaatgctgacgatggtaaacaaacaacttgctctaacaaatgaatggggataaaatccttttgcaactcagatggtttccaattctttgcttccagtagaattgaagaaaaaacctatgaagttatcagctgataaatcatgagaaataattttgaggataaatcattgtgtaatttccccccatatatctccaaaggaattcaaagacttgcgtgcattgctaaaacaaaatgtccattcctattcacttattcatataaatgaggtttctgtgtgctaacatttaaccaaacaaaaaataggaagagaattgatgctgaagcctatctcattctagcaaaaagcaatgtttatccatggatacacccattaattttttttaaaaaagccctatctacaatgaacttttgttttacgtttaataattacctatcaaaatttgtaatatattcacaatgttttgatccattttattctaatactaattgtcatgataattcaaacaagagcaaatttttaaacaacacttagagccttataatcagaggaacatttaaagagcatttaaattgaaaaatatatacacatttttgctgcagagaaatacgataggataatcaaaaacatttcaagtgaaaaaacagacaattattgagacaaaattctgttggaaaaacagaatggaattaagagctgagaaaagggaaaatgtacaacttccaagtatcaaagaagagctcagttatacatttttaaaacagatgatggtggctctcaagtcactaaggtatttaggtttcaccggattcatgtgaaatagtgacataacagttttatttttgaatattaacatttgtcacaaattacattatttgtagccaattgacatttgtgatgcaaaatatcagacatcaacccaaaaatgtgtgaaggagcacacgtttttcttaatatttttagagagcattttatataaaccaatagttttatataaacatacaaaacatatatgaggaattgtcatttactcttttgccaccttgtggtcagagttggatttatcacccaggtgcatctactgcgaaggagagctgtctctcctaaggatagccccaactgcctgcattctgtcagatctttgtgaggcagagatggtaacatttgctaggatctgggtccagatccacataaggacaaagcatctaaagattttggtgacaccctccacacgtgattcaaaacaaaagcatcatgtaatcaggaaatgaatgtaaggaagtacaacaaagttctgatttttcccacgaggactacttaaaaaaaatcaaatgtcaaactgtttctggtattttttcttttttgattttttgtctttggtgcctcttctctgctagtgacatagactttccttagtgtgccttttggggaagccatccctgatttcagtagccctggagtaagttggagtgctgtgtccacagctcttggtacatctggccctcggtcagtgcagaataaacatttgttgagtgaatggtgacagagccctccattttcagaacacgctggcctgggcagagtccaggtggacctatgggcttctgcaggaagttgatcactaagtcaacaagttaccatggctaatcttcaatggtagacagtcccaggtacacagagatctttaggtctttttgttgtcagtctggaggtgggatgagagtatcctccaccccctcatccatgacctcggttgtttttagcagcagcagcagcagcaggattccttcagtgagtgtgctagttgcagttcctctggttgcaggccacaaagggcaggcatttattgaaaggatgctggggtgcttcaaggaattgaagcaagagctgactcaggaagggtagggcccagggcaaccctcagttttatgggaaccacgcatcctcctttcaagggctcctgattcctgaggcccaactcctgctgctaaccctaggaggcctccccatcccctccctagaggaaggggccaggtggagagctgatgtccagtgctgagcaaggagaatgttgctag

SEQ ID NO: 6165 - DNA, 2779 bp, artificial
  synthetic oligonucleotide
gagcagggatgccaccagattgctcagagaagcccagtgtctgcagcagaaatgggagggggcagggtcgatgccatgtccactggacatggctggagcatcaggagccagggcagggctccagcttgagatgcacctcggcaggttgggctcaaataggctttggtgtcagggttagaaatgattttggagttggggtgagatgagagtaagaagtgggggaagctgggccctgtggtggctcacgcctgtaatcccagcactttgggaggccaaggcgtgtgggtcatgaggtcaggagactgagaccatcctggctaacacggtgaaaccccgtctctactaaaaaaaaattagccaggcatggtggcaggtgcctgtagtcccagctactcaggaggctgaggcagaagaatggcgtgaacccaggaggcggagcttgcagtgagccaggattgcactgcactccagcctgggcgatagacagagactctgtctcaaaaaaaaaaaaaaaaaaaaaaaaaaaaagaagaagaagtaaagaggtaggggaaagttgagagtttggggttagggttggtggtaggggtataatgggagactgggagatgaggttaggatggagtttttttttttcttatcttttttttttttttgagatgaagtctcactgtgttgcccaagctggagtgcagtggcacaatctcgtctcactgcaacctccaccttccaggttcaagcgattctcctgcctcagcctcccgagtagctgggactacagtcacttgccaccactcccggctaatttttttgtatttttagtagagacggggtttcactacattggccaggctggtcttgaactcctgaccttgtgatccacccgcctcagcctcccaaagtgctgggattacaggcgtgagccaccgcgtccagcctaggatggaggtttaatggaagttggtgaagctagaattgggtttcagcttgggactgggcctggtgttggggatggggttgtgatgtatttggggttggagatggagttaagggtaagttgtggttgagggctgggatagaggaggggatgggatgagactggggctgaggctggaaatggagttgcagttgaagatagggtgatggttaagggttagggacgtgggagttctctttggggattgaggatggtattatggttggtggttagtgacagggatggggctgggagttagggatgaggtgggagatggagttgggcttgggaatgggtgttagcgttgtaaatgggctcataggtgacctgtggttgggggttgggatcagagatggtattgtggttgggggttgggatggggtttgggctgggaatagtatggcattgaaatcggagacagggttggggaaaaacgttagagcaggagttgaggttgaggaaggcaatggaaatggagtagacattctccccagtggatgaagacaggaacttgtgtctgctttgattcctggtgtttccctagggcttggtagggtgcctggcacacagcaggcactcaatggatgtctgctcaatgaatggtgaagcagatgaagttatcattggagcttgggtgggggtgttgaggctgtgtttgaggcccttgtcttccccctcccctaatacaaacctggtgaccttaaagatcctgaggaggcgcacacatcggagcactgagatgcccaagggctgcatggcgcccacctccaccaaggtggtctctaggatgcccccacagaccacaaagcagtcaaagcggttgaagaaggaagacacataggcagaggggcccagaccgtacaatttgagaagcatctccaccgtgaacagacagagcaacactttgttggcatactctgtggggagagaggcagggatgatcgggctggccagtttctgtggtgacatgtggggaggtaactagggaccatggggtgacccacggtagctggtatcaggccaggtgctggctgagggaaggcttagggctagggattggggtgagtttgtaggtcagagtaggtgaagttttgaggggcttggagatggggatgaggggcagagtcggggtgggggccagagtcagtgtctatgagtccagaagacccaaattcacaagtagagttagagtctagggtttcttcgggactggggctggtttgtgggttatgggttagaaatgtgctcggtattcaggctggggctgagattataatgaataatagtaagagctgacacttataaagtgttagctatatggtgggccatacaatgtcctaagcacttttcactttacatcatttactcctcttcgctgcttcatgaagtggatactactatctatcatctccattttgtagatgtggagaacttttccagacagtgtgatgataagagcctggattctggagccaggctgcctgggttctaattctggctctgccactcgctagctgggtcccgagattagtcgcttaacccctcagtgccttgatgctcagtgttctgtgccttagtatttaattcgcataaggttgtggtgaagaaattgtcagtacacataaagaaaggtgctgagaaaggagcttgaggcacacagcaagtgctacctgtgtaagctacaaggtgggatgggacaggctaagggctctggatttatttgggtaggggggaaggcagtgtcttgggggctgaggcgccctagaggttttggatttaagcttctggggtagaaggaatagg

SEQ ID NO: 6166 - DNA, 1817 bp, artificial
  synthetic oligonucleotide
cagcctatgtctgccttgctcaccacatagtcctagagtccagagcagtgccaggtacaaggcaggtgctcagtgatcccagtggatgtagcctcgaggtgggagctgggcaggagctacttgcggggggaggtattggccggttccaccctgccccttcctctcccaggtctgttggtatcccagggtgggagcacacctgaaggggtactcgaactcgacctcgatgctgaggtcactctcggtcttgttggcacaatccacgctcagctggagctccccactgtagctgccgcatgtggcaaaggcgaagatggcgaagaccttgggcagcagggatggggatggccacagtgaacctgtgtgcatgtgggagggaggtgccctcctctggacagatcgggggcccagcacaggcagcagcagatggagcagtccccacccccaccccctaatcagggctcatcgggaccaaggacaagctgattacaagggtatggctgtctcttcctgtttctctctctgtgtctctctctgtctctgcctttccatgctgacctccctcttctctgtttgtctctgttgttctctgtgtatctcactgtgtctctgtttctctcggtatctctgtttctctatgtgtctttgtctttctcagatgtctctttgtctctctgtgtctctgatcctctctgcctctgcctatctgatctgtcgatgtctctttttgtctcttttttctctgtctgtgtaagtgtatgcctgtatgtctgtgtctttctgtttcttggtctgtttgtctctgtctctctgtcctgtctctcactcggtctccggatggttctctctctgtctccctcttgcctctgtgtgttggtttctcttttttctgagtgtctctttctctctgtgtctctctctccctcaccctgttttcctgcctctctccctgcgtctgtttctctttgcatctgttttctgtgtctcctttttctttgtttctgtttgtctcttctctcttatgtctgtatctcttctcatctccatatttcttttttttttctcagtatttccatctctgtctttatcattccctgtccctcattctctctgtcaccttcactgtctctgggtttctctgactttgcatctctcacccagcatctgctacaggctccacctcccccacccctccctcacttcaagagaggaggtaggacgtcacagtctcccacttcacaacgggggtaccctcagccctatgtgacgtcacagctcatctgttttctggcttcagacccctgaaacctcaccctggagcccaattcccccatcccctacaacccccgcactcatccctggctactcgcccctactccacccctgctcttctggaccccatgacctccctctctccctgcactctgccccaacagcccggaccacactcacccattgcagcaccttcacaaagccgaggggctccttgaccacccggaactgacccccagccaccagctgaggagagaaacagtggggaaggggtggggttgttggaggtacagggaggtgagcggcaaggctgcccatcaatgaccccaggggatggagcatgtgacctcggggagagggtgagaaggagaaagtgacaccttggggatggtgtgagccccagggtccaaggactggtgggaaggtctgaagagatggtgagtcagatggcagaggaagtcgggggtgagggagatggggatgaggtcaggactagttaaggagggggagcaggtttgaaacgtaaaggcgagtcggatggggaa

SEQ ID NO: 6167 - DNA, 2587 bp, artificial
  synthetic oligonucleotide
aaaaaaagacaatttcagagagaagtgagagtcatgaagctatgaagctagcaaaaggaggttacattgtgggagatgatggtgagcttctggcctctttgaagacataactcttgagctgcaacctgaatgaccagaagccaggtatatgaagcactgagtgaagggcattgacagcagggggaatagcaagtgcaaaggtgttgaagtggaaccaggttcatcttgtttcagaaattcagacgtgtcctcacagagttggaaagcacatactcatcactaggaaaagtatgtttcatcccttccactattcactcactcttccggcaaccggggctgaaagaggggagctctttccttagttttgaggggccctgtgttggcagagagagcaggcaggcccttgggttgaatcctcctggccatccagttatgattctcccccacttcaaatgagatgagaataaaaacaacttctagtctggagagtgtgtccctcagggtacctctgggatcctgattccaggagacgagatgcatgtcttagatgcagaaattaaggctgagctgggggaaattacttgctcaaaataacacacttagccaggcgcagtggctcacgcctgtaatctcagcactttgggaggccaaggcgggagaattgcttgaggtcaggagttcaagaccagcctgagcaacataacgagaccttgtctctactaaaaaataaataaatacaaacaaagtgtctacaaatgtcacccagccttgcaccccaggagccatccattcatcttgccaatcccccagaaataaactttcctattcctcatgtacgattgtgccgactggcccctctcttcagaaccaggaaactgaggcccaacatttagggccaggacttccttgggattgcagaacacagaatcagaccttgggctctctgggctctaacactactacaaaatatgtttttttaaaatagagacaagctctcactacgttgcccaggctggtctcgaactcttgagctgaagtgattctcctacctcggcctcccaaagtgctaggattacaggcatgagccactgctcctggccttgggctctaacacttgaaacaatgcttgccctatttctgagcaactcaatgctcaccaacccctattctcacacagcctttacactggcagggtcttattctcatcactgctcagaggtttattccactgtccacaatccattatccaaaaacaaaaagctctggaaactgatggttttcccacaagataggcactatttggttacaaaacctgacctgatctaacgaggaacaattttctttcttcctttctttttgtttttccttttttggagacagggtcttgctctgttgcccaggcaggagtgcagtggtctgatcatggttcactgcagccttgaactcccaggctcaagcaatcctcccacctcagcctcccgagtagttgggattacaggcacgtgccaccatgcctgggctaatttttttcttttttcttttttttttttttttttgagacggagtcttgctctgtcgcccaggctggagtgcagtggcgcaatcttggctcactacaacctccacctcccaggttcaagcgattctcctgcctcagcctcctgactagctgggattataggcgagcgccaccacacccggttcattttttgtgtatttttagtagagacggggtttcaccatgttggacaggctggtctcgaactcctgacctcgtgatctgcccacctcggcctcccaaactgctgggattataggcttgagccaccgcgtccggccgcctgggctaatttttaaaattatttgtagagatgaggtctcactgtgttgccgaggttgatctccaactcttgggctcaagcgatcctcccacctgaggctcccagagtgttgggattactggcatgagccactgcgcccagccgaggaacacttttcaatccttacccagttattgtgaacgttcataccttttcttgaagaaataccgtttttgttgttgttgttgtttttgagacgtagtttcgctcttgttgcccagactggagtgcaatggcatgatcttggctcaccgcaacctctgcctcccgggttcaagcgattctcctgcctcagccttccgagtagctgggattacaggcatgcgtcaccgtgcccagctaatttttgtatttttagtagagacggtgtttctccatgttggtcaggctggtctcgaactcccgacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaa

SEQ ID NO: 6168 - DNA, 1461 bp, artificial
  synthetic oligonucleotide
tccctgacttctcctccaaacctcacttttctgctcccaaaccccttatctgctctacaacgccttgtctttgccccactctctctgagcccccaaacctgtctctgatctgccaaaccctagctccatcctcttaccaccatctctgcctttcaaacccactctttgttcccaatgacttctctctgatctccgcaaaccatttatctctcccaactccctgcctgctcagtaaaatatctttgtcacttcaaacaccaagtcaactccccaaaatctgttctgccgcatgaaccctcatgtctgccttccccaaaccgtatctcagccctaaaacacatctcattgtctccctgaatctctccagctccaagcctttctctactccaattctatcttggcttctcaaactcccctttactagccacattctgtctgcccaaacagatctttgactcctaaactccatctctcctccagaaaaacccttgaactccccagacttttctatgaccctcagaatctgactcccacactacttctcaactttatttctgactctcaaacttcgccccgatcccccaacctcgtctgttttcacaacctattcctgagcccaaaatgtgtctctgaacttccaagctcgtctctgctccacaaccccgcccatatctgcctccccacaaactccatggctacaccccaaacctctctgacttaaccccatatctgaccttcaaattccacctctatctccccctaagccccatatctgccccctagaccttatatctgctcccttcagcccggtgagaccctcccttgagggctgggattggaacgttacctggggtgaggggctggggccgagggagagtggagggtgccagctgctgcctgctgccgccgttggggcaacacttactctagtggggcagctgataaggagctttcatatcccccagcctcgagataaactttatctctgtccggagagtgataactgggggtgaggaggctgggcccctgccatgggaggggtgggcagccctggactcaccaacgtgtgaggtgcaggggttgggggcagtggggctggagggagatcatggtgggtaaggtggagttgaggggatgagggaatagtggtgaaagagtgagcagaagacacacaatgagacagggaagagagggagaaacagggagagatgggaagagagagacagagacacagagacaaagagcaagagacaaaagagacatgaagagaaaggaaaaacagagagagagaaactcaacgagtaagagacagagacagacagatggccggagaaaaagaaggaaagacccgggagcagaaaaggagatagaaatgcagagatacacgcaggtagcactgtgaagaggcagagactaacacagaattagagacagagaggaaagagatggagaccaagatgg

SEQ ID NO: 6169 - DNA, 678 bp, artificial
  synthetic oligonucleotide
ctgagactttgtcaaatctgcattgagatcccaggcttgccctgaccaaacttactttctccccttcgctcaatcttgctttctcacctctttcctttcataggtgtcatagccacagcatggtctaagactttccctgcccagttttgcttcctctccctttcatctttcataagatttacctccacatatactgtttgcactactaactctgtctcagagtctgcttccaaaaagacccaaataatacagtgtggctctacagctctacttctctttttctgtctctctgtctctctcttataatttgtacagaagattcaaacactcttacaatctccatgtgctgcatgtcttagggaatgtttttctgctacgagtgggaggctggattcttgggtatattgttaggggcacagttttggggggcccattatgactacatatctagtctcattctgcaattcaatcttaattcgacaaaggtgattttttatctctgttttattcctgtgttttatgtctcaattagtttgtgactctggagagaaataaaaagggctgctttatttatcctttccaccccagcatgaataggggttgaatatttaaaaattcttatatgtaatttagaagacttgaatgattttccaaaggccacatagggtattcattctg

SEQ ID NO: 6170 - DNA, 4490 bp, artificial
  synthetic oligonucleotide
cttcatacagaggcgttagaaaactgtgaacaatatcttcaacagcagttttacaaaacttgtctttttttaaaaaatcaacctttcctttatatagaaaccaaagccacgatagtcatagttagaaaaaataatctgtggaaagccagatttgtatactccagatatacagtgttgtcaggacctaacctaatattgggaaatttaaataatttatagctaatgtatcttaagccagtgcttctcaaactttcatgggcatatgctaccatctggtgatctttttaaaattcagtttcttggctagccatgtgcagaaaacagaaactgtaccccttccttacaccttatacaaaaattaactcaagatggattaaagacttaaatgtaaaacccaaaaccataaaaaccctagaagaaaacctagacaataccattcatgacacaggcatgggcaaagacttcatgacgaaaacgccaaaagcaattgcaacaaaagccaaaattgacaaatgggatctaattaaactaaagagcttctgcacagcaaaagaaactttcatcagagtgaacaggtgacatacggaatgggagaaaatttttgcaatctactcatctgacaaaggtctaatatccagaatttacaaggaacttaaacaaatttacaagaaaaaaacaaccctacaaaaagtgggcaaagatctgaacagacacttctcaaaagaagacatttacatggccaaaaaacatgaaaaaaatttcaacatcactgatcattagagaaatgcaaatcaaaaccacaatgagacaccatctcatgccagtcagaatggcaattattaaaaagtcaagaaacaatagatgctggtgaggctgtggagaaataggaagacttttacactgttggtgggagtgtaaattagttcaaccattgtgtaagatagtatggtgattcctcagggatctagaaccagaaataccatttgacccagtaatcccattactgggtatatacccaaaggaatataaattattctactataaagacacatgcacatgtatgtttattgcagcactatttacaatagcaaagtcatggaaacaacccaaatgcccatcaatgatagactggataaagaaaatgtagcacatatataccacggaatattatgcagccataaaaaggaatgagatcatgtcctttgcagggacatgaatgaagctggaaggcatcatcctcagcaaactaacacaggaacagaaaaccaaacactgcatgttctcactcataagtgggagttgaacaatgagaacacatggacacagggagaggaacaacacacaccaggtcctgttgggggatggggggcatggggagggaacttagaggacaggtcaataggtacagcaaaccaccatgacacacgtatacctatgtaacaaacctgcacattctgcacatgtatcccagaacttaaagtaaaataaaacaataaaaaataaattaaaacaaataaaattcagtttctaattcactgggtctgggctggggcctgggaatttgaatttctatcaggatacctttactgctggtccatggaccacactttgaggagcatatacctcttagagatatcagaggtctcaaatgggcaattgacagaagtttgaggacagataatttaagactggacagataattctgagtcctccatgactcacaccaaaggcatttctttatacctgggagttcttttgctagttttccctttagccctcgtcttcatcattattattatattgtattatattattattactttggttttaagaactatttttgcactcacttagtattttatggcagtagttctcaaccttgaccactctttgtaatccactggggagcttaaaaaagatcccggccaggcgtggtggttcacgcctgtaatcccaccactttgggaggccaaggtgggcagatcgcccgaggtcaggaattcgagaccagcctggccaacatggtgaaaccccgtctctgctaaaaacacaaaaaattagccaggtgtggtggtgggcacctgtaatcccagtgactcaggaggctgaggcagaagaattgctttaatccaggaggtggaggttgcagtgagccaagatcgtgccactgcactccagcctgggtgactgagtgaaactccatctcagggaaaaaaaaaaaaaaaagccccaatgccgggtcccatgcccagaagagtcttagcatgtaccttatcatgcaccatagatgcaggtatctttgttattttgagtgaaaggatctagtatggtaggtaggaaaactgatgtgtttatgtgagggatgaaacgacaaatgaaaggtttggctttatattcatatctattctagttaggctctttttgcaagaaactgagactctcaaatgactaaaaagaaagggcggagtatgggggtgggtattgtatggaaaattggtaggaagccctaaagggagtagccctaaactgttaggaagagggagctataaggacgagctacttttctttaactttctctcttggtatcattgtttcttttagcatatctgctgcagtctcctttcactctcttttttttttctctttttttttattattatactttaagttctagggtacatgtgcacaatgtgcaggttcgttacatatgtatacatgtgccatgttggtgtgctgcacccattaacttgtcatttatatctcctaatgctatccctcctccctccccccaccccacgacaggccccagtgtgtgatgttccccaccttgtgtccaggtgttctcattgttcaatttccacctatgaatgagaacatgtggtgtttggttttctgtccttgagatagtttgctcagaatgatggtttccagcttcatccatggccctacaaaggacaagaactcatccttttttatggctgcatagtattccatggtgtatatatgccacattttcttaatccagtctatcactgatggacatttgggttggttccaagtctttactattgtgaatagtgcagcaagaaacatacatgtgcatgtgtctttacggcagcatgatttataatcctttgggtgtatacccagtaatgggatggctgggtcaaatggtatttctagttctagatctttaaggaatcgccacactgtcttccacaatgaaaaaaaccattatttaaaaaattaattattttatctgtgcggttatgcctttaacttgacatgcagttaaatttgtttcattttatgactttttaaagtctttagagttggcaattttgttattctttatagttaagtttatgttttttaactaattaaaagacttaccaatattagaaaatagaaataatgtgaatatgcacactcacattctttttatttgtgtcctttttcctaatccctctttactgatataataaactttctttttctggtttttgcaagtttttttttttatactttaagttctagggtacatgtgcacaatgtgcaggtttgttacatatgtatacatgcgccatgctggtgtgctgcactcattaactcgtcatttacattaggtatatctcctaatgctatccctcctccctcccccaaccccatgacaggccccagtgtgtgatgttccccttcctgtgtccaggtgttctcattgttcaattcccacctatgagtgagaacatgtggtgtttggtcagtctcctttcactctcactgctggtcagtctcctttcactctcactgctgggtggtttattctgtttttctccatcacagcccctgcttactccctgttgacctcagtttatgcatggacccattcctgacctgtcttcagcagcagctgggattgctgacagcttcattttttttttttttgaacatgcatttcaaattgttgagaggaggaatttgattggcattgtatgccttaggacactggcacacccaagacttagttgctattcgcatattcagtcagtgctgatgggggaggggcaggaggtgtttgatgcctagaaaaagaaatacagctagcaaagactgccacttcctgtaggtaggactcttgccttgggaaggagtcagtggtgaggccagcattctgtggtttggtcctttttattgacttttttttttcaaagaaagtcatctctcctctgcatggaggtagttcagtcatagcatgactttcaggcagggccaagaaatatagtatgagctttattgccctcttgtctcttcatactcaggccaaaccaataggaatatttcacaaggtcagtaaagtgaatcagttaaactaaacaaaacggtttaaaccaaaccacctcagatttgcttcgtatttttgaaatatcttaatttattttaattcaatgtaaaaagaaaagaatctattccatccaaaatatcaacaaatg

SEQ ID NO: 6171 - DNA, 564 bp, artificial
  synthetic oligonucleotide
ttttctctgcctgaggcaggatgataaggaaggaggacaagttgctagggcagatagagggatctgcttctgccccacttctctctgatcattggttattccttgagaggcaattctcagaaaccagcttagcatagtgaggcttacccattcccgggtgcctgaccagcatgatttcagaaggtctttacatatgaaatattcacataatagaagacagacgtgaaatttgggctcagtggaagcaaggaagaattggacaaatcctcaaagtacgcttggtggattctccagactccttagggtcctgggcagttttaagggtagcagactccttcctgccatcaagtgataaaagagataaaatgtggagctgagaccactgctagggaaatagactaattatatttatttaggcagaagagcctactggttaaggctacgattctggagcaagactacttaggttggaattcctgctctgttagctgagtgatctctggaaagttacttaacatctctatgtctccactttctcatctctattatgaggataataacagt

SEQ ID NO: 6172 - DNA, 1949 bp, artificial
  synthetic oligonucleotide
gctgggtactggatacatacaactagtaaaaggcatcgaggagatctgggtagagcagattgtccactacagtcacccagttgcagagtctgcatagtctcgatgacatggctgcagccttgaaacctcagtttccctgacaatgaagttaacataatggcacccatattgatagtgttactgtaaaaatcaaatgtatgtgaaattcttggcaaaccataagcgctcaaaaagtggtggctgttttgaataccaaagacatctaaaatgtgcttcaacaatgctgtaccacttgcaattttccaaatgaggtatgacttgtcatgaagctaaaagccagcccctgaaatgctgctcctctaagcttctcccttgaggcacactcactttcataaataagcatcacttcttctgtgactctttcctgcctccctaagccccactccttgggagaacactttttttttctttttttttaagagatggagtcttgctctgtcacccaggttggagtgcagtggcacaatctcggctcactacaacctccgcctcccgggttctagcaattctcctgcctcagcctcctgagtagctgggattacagatgcacgctgccacacccagctaattttttgtattttagtagagatggggtttcaccgtgttgctcaggctggtgtcgaactcctgagctcaggcaacccacccgcctcggcctcccaaagtgctgggattacaggcatgagccactgcgcccagccaggagaactcttctttaatctgctaccatatgtccctgactttgtacccttcttgtacttatctcccagttgacacctctgccttactaaagcctcttcatggcaggacccatgtgcgtcttatttgtttctaaatccccaacacctcttcaggatccagcactaactgaacaaatgtaactcattttctgaacaatgatcttctctccccttttctcaaacagctgatcatatcattctctctgagaggagccaactcacttccaccatatcttagaatccccctggtgtccccctgatcataaggagaatttttctcatcaatattcagtgaaaatcctcaatctcagagcaaaagaactttggctctggtcatccctgaggacccaacacagagctggcctactcacgtttgcagatgaccttgtcagaccatcgtttgtttgactggcagatcagtagggaagagccatgcagctcgtagcccttctggcagcgaatgtcgcacctggttcccagggctgttttgtagtatcctccttgaggggccctgcagtacacatccccatacttcaccttgatgggggagcaccacggggtatctacaagtagcagaaacaaaagaggagataaatatgaaatgacactttcagaaaatgtgtccccttactcttactgtcccaggctggctacattccaaattttggaccttcaattagtgccccatgttttcttaggtgtctccgggtagggaggttatgatcatgggactaagtgtcagatatatctgaacatgaatctgagttcctctataactgactgtgtgatcttagacaagttagctaacctctctgagtcaatatctatacttatgccatagtgctgttacaaggacgaaataaaaattgcatatcaagcatctagcacagtacctagcatatatgttcaataaatgcttgttctttttagtatttcccttaactagatacataagattttttatttttattttttagataattctttcaagggcaactgatgtcatacatagcggtagggattcaataattggttaatttggatttcgtctgagccgtatgcacattctctctaaaatgttgtaatactggcattaatctaaatgatgctacaatttccaggtgtttgtaacaagatataaatttcgct

SEQ ID NO: 6173 - DNA, 1835 bp, artificial
  synthetic oligonucleotide
atcagacacagtccacagtttccccagcagtcaaagaaaacccagtagaactgggtgtttatggtacctgaaaacaggtccatcttgtgaaataaatttaaatgcaagataaggaggtaaatcaaatgtcttatcttgacaaaagaaacacaaagttgcttctatatacagcatttgtaggaaatgaaggctgaaatagactatctgtgtgcttatttagaacctctcatgaacgtatggctcaagtaaaatttctttttttttttttttttttgagacggagtctcactctgttgctaggctggagtgcaatggtgtgattttggctcaccgcaacctccgcctcttgggttcaagggattctcctgcctcggcctcctgaatagctggaattacaggcatgtgccaccatgcctggctaattttgtatttttagtagagacgggatttctccatgttggtcaggctggtcgcgaactcccgacctcagatgatctgcccgcctcggcctcacaaagtgctgggattacaggcgtgagccaccgtgcccagccagtaaaatttcttaatgagcgttgctaccaataaaaaccacggcctcagagagaacgtctgtgtattattttaatttaactcatttgcaagctggagctgaatggtttttaaaatattaaatattgaattccagtgagcagtaaatccttaatccttgaagtggtagcagatgccaaacttcaaaactgtaatcttaaattcagagaacttccctccagacttcacagtctaattaatgactcgagttagctctgtcttggtcacgcatttagttgtagttacttgccaccataacagacaagaacatcctccactgtgaggttattcaaatccccatgcagctaatgagtaatggtccctgttccacttgtgttctggatgagagatgtagagtgtggaaactgaaagtggagaggagatgagggctggactgtgttcattaggaaaagacccgcaactacagaagcccaattctgtattttcctttgctgcagatttcctcaccttgtctctgcacacccagatgtgtacaaaattacaaactattcatcattgcatataaaaaaatgagcactggaaccagacacagtggctcatgcctgtaatctcagaaactagggaggctgagtgggagaattacttgagcccaggagttcaaaaaacagcctggataacatagtgagaacccatctcaaaaacaaaacaaaacaaaaaacaatgaaaaccaggaaacctacctaacaacatgaatcaaaggcctatgctcaaaccctttgatcaagtcattccacttctaggaatctacccaaggaaacagttgaactgcatgtctgcatgtgaaccttcaatcatccaaattaaaaaaaaatccagatacatgagcagcaagctttctccccccgcccagccctccaacacacatatacacacatacatatattttgccctcggttgtcatcctggttaacttgtctacagtatttacagcatttagtatgaatgactacccattcatttcatgaagctctcttctgcagtggcttccaaatgacaacagtttcccgattttcttcctcctttctaaacagactctctggacagcacatctagatcagcctgccatttggacataagtatttcccaggagtccagtattggtcctttacatatctccagactattttcctgggccatctcactcccatacttgcctcaaaccattccccatgtactgatgataaatccattgtttctagccttgaactgtctcctaagagcca

SEQ ID NO: 6174 - DNA, 2096 bp, artificial
  synthetic oligonucleotide
ctgagcagagccggagggcaggttaggagtcagtggaggtggtggcaagcaggaacatggtggctaaaagttgggagcagcttgcaggctggcagagggagccaggaaagccagggataggtcccaaaagacaggtggtagtgaatgcccaaactggcgaactcatgattctgtggctgggccctggtagcaagctgtactatataaaggtggaagatgagagaaaggagaggggagggcaggggaggagaacggagggaggtcggatggaaaaggagaaggggtccccagcttgagaaaggctcaactaaaagttgaggttcccaggcagctcacaggcacctcccaactcagtgcggaaaagctacctctagcttctcaccttatttgcccgctcccagaaagctgcttctgggacgcttaatgacttcctcttcccctacaggttcattttaacctgattcctgctaaagggggtgggagaggaggtattaacacaccatgggaataacagttgcctggcagtaaggataaaatttcctttccactttaccctgaatcagttcctacaaagcagcttaaaacttaagagtcagctcaaaacacaaatgttcctgtttattaatttacaaatttgttctattcattcatttatttaggtgcgtgcagagaatttcccgcagccatccctacatctcccaagcacactgctagaaagatgggcatcctctatccttctaccagaactcagtaggttcatttctcataccctagatttaagctgcccacggtgttgaacgcagagccaaatatttgcacgccctatagccgacgtcacccactttcccattaacactaaattaaaacgcatccatggatttcctctccattccgaggcaacaggagtgcatggcacattgccctactcccctgaagctcttcgctaacctaagactccagggtgaggaagttagctggagctttttaaagtgcatctccaaagagaattttgctcacaccatgagagcccccaagaaacaccagggcccccttagatgccggagaccacgccctccaggaataagccgcaccctctgcccagcagatccttgcgcgagtagccctctttccctggggctaatcaagtgcatgccacatgtcaccactctcagctggcaattcttcctcagaggcgcagactttctcggaatccccagcagggggggttaagagattcaggggaggccccgcccgtgccttccacaaaagtcgctttaccgtggctcgtgtcctgcggccccaagggggtagcctgggacgtgtagtgggagggcatagaggctccttccaggacaagctgccagcctccagtgggcaaccatgtgagaggcaaaattctgggggtgagaaagtagcaaactagtctgcggccaaactttctctgtggagcctcctacaccgaaaagggtttgattggaactctggaagcccggacgcagaaggtgctagggctcccgtcgccgcgagggcgccccgcgcctggagatgggatggtcagttcttcccggcgcgtgcccagacaccagccccgatccgcatcatccccaccctcgggctgcgaaagaggagttctgcgcaaacaaagggcgcccccggcacctccctctatcccgagcgaagggtcccaacggcgactccgggggtctttggtgcccagctgaggaggcagccacgcctccgatcctacctgggaagctgcggctgggcgggacgcgcagcagcagcagcagcagcagaggcggcagcagcagcagcagcgcgggccgatgtgcggggctccccatggcgagcgggcgcttagctcgcctcggcagcgcagcgcgcttcccgggggcggcaggagaccgaagagaccaagggactgcgtgctagcgggcgggcgaaggccgggctggaaaactcctcctctcgcctctttccctccctccttcctgcctggggcctgccctcctttctccgccccccctggaacactgcgcggttcggggctctgacccacccacctcctccttttgtgccagcgctttttctggcca

SEQ ID NO: 6175 - DNA, 501 bp, artificial
  synthetic oligonucleotide
gttaatgatcccaaagagcaaatttcagcaataaaatgcttccactcttgtttctttacagaaaatacataccatcagaacaaggcaaaatggaggttatctacattgtatccctctgtcttttaaattctaaagtaagtaaatgcttacgtttcttgtgttctttccaaaaaccatccaaaaaattaacttaaactgctctcaccaacaataacgaaaataaatcttcatattataccttttgtttctgaactggtgataattttaatgacttttcattggaattcaggctcatgatgtgtgtctgaaataaataaaaaatatatattataaaaagaatacagtatatatactatatatttgtatatagtacaaatatatagtatattttcaattatatatatttttttatatatatatatatataaaatgaagggaaaacagttcagatagtaatagaatccgctctcaattgccatactaataatgtgaggatcaaaa

SEQ ID NO: 6176 - DNA, 1612 bp, artificial
  synthetic oligonucleotide
ttttaagagcaccaggattgctgtatgattgtccatctcatcaacatccatgtttgctcatcaacatccatgtttgatctggcccagcacactacttgttttttattttttagtgtttgttcacccaaccacactaactctgcaccaggttttcctggggtcatgagaggctttgtttattgtctttttttgtttcattttgctttgttttgtttcagccttcagggtgttttcattaattcctaaataagtttcaaacttataccaaaagaaaaaacaccaagcaacaacagaaactaagggttggaaaggatttatttatagcaaccatccttttcatggagagagtgaccatcactctctcaaaatggtcattgagccctgcataaatcatcccatcattctcagcaaactattgcaaggacaaaaaaccaaacaccgcatgttctcattcataggtgggaattgaacaatgagaacacatggacacaggaaggggaacatcacacaccagagcctgttgtggggtgggggaaggggggagggatagtattaggagatatacctaatgttaaatgacgagttgatgggtgcagcacaccaacatggcacatgtatacatatgtaactaacctgcatgttgtgcacatgtaccctaaaacttaaactataaaaaaagtacccagtactaaggcactctttatatactcagctattttgtctgatatctatgtagtctgactgttctcatcaaaagtttatacaatctgactgagaattatctttgaaattgagttagaattggtcttgctatgattcttctcattgttctcccattttattagtatctttataaactcattggatgctaatacatttgaaggtttcaatttattataattattattcttattaattatcaaattgtcccatatttggtcaatgtcatctttgttcaagttgggtcattttgacctaactccatcagtcttcgataactctcttgctttgtggtgtgacaagatgttccaggctcatcttgtacatttctttattaagaccaagaattagccattgctctaagaagacttggggcattttcaattactttcaaagtcacacttgggagaaatttcctttcttgaatgatattttgtctgattattaaaataatattccttttgatagaatatactaaagaagattaaaaaaatagagccactgataccaccatcatccagaaataatggatgttaacattttatctctggaaccatctttccacttaaagtttcatgccgtgcctttcctttttctaaacagtaggaaaagagatgatgaatgaaactagacattttaaatatttagacaaaataggttgaacacatgttttaacttgttaatcatttttgaaaaatcctaatattggccattaaacttccagggcaagctggtatatgtgggaaactttaaatttgagtaatttggattttgcaaaagtctttttgctaccattgttggctaatgccaaagattgtctgcagagctgtaagaatgcactggaaggcaaacagtactgtatatattaatagaaatgaaaagagggtaaaat

SEQ ID NO: 6177 - DNA, 1831 bp, artificial
  synthetic oligonucleotide
tacaatgataattacacctacctgatatggctgtacatactaaaatgagataccttatgatacatgtttagcacagtgcttgccacatagtgggtacacaatgaacatagtttcattcctcttcatttgcatgccttagagttatgtttgctaagtaaattgagagtaaggtctgaagtctcagataaggttttataatgggtatgtaatgatcttggcctcgaggagaagccaaggattggatggaaagtaaaaaagaagaaagacctcccaggcaggccctagtaataagatagcatgaaggtaatctttgaagtcccaggcagccaaaggtaggattaatgagtaaagaacacttgacaagtagtagggatattgatttggaatgtagccttaaggaaacacaatgaaaaaagtcttacatttgtggatttgagttgacttcaggctagcccatggccacatggagaaatacgcaatatttttctttggtgcttttccattacttatttttgctgtcatttctatcctttcagcatctctttcaaggactctagtgtactacttatgctcacttatttgggaggaaagtgggatgaaaaatatctaatttatactaaggagtttttgacctaatggattaacccttctaaatcatcatcagtttaaaagagaaccttggtttgccttgtgattaatcaagagaaaagactcttcagtgattcaatttccagcacttctaagtaaggaagattttttttttatcagaaaggctatcaactcaaatcataacaaaaagaaaactacccacttcatttatgggtgggaagaacccaaatttatagatctagacatgcacagtccagatataatcatgctttagtgtcaacattttaaatgaggctttggaagactttgcctcaattcctcctatacaggtgttactgctgagcaatagggagaagcacttcagggattcctggctgatacaaagaaatggagaagtaggcaaatgaggaaagtcaacacccaagataacagtaccgtattaaattcaaagggccagaggcatgattgccaaccatccttcatgtttgaacttaggagaagatgaagttcaaactaagaaattgttaggagcaactgttaagtccaaggtggttatggtgaccagtccatccatgacatctgcagcttatgtttcctcagtgactgccagttgtaactagcttcaaaggttaaaaaaagagcaagtgtagcaaatgcagcaatagacttctgatgctatagggaaagtttaaataaatattagagcagaattggtagctattagaacactgaagttatgaagctagtagaatacagaagttatgacacatgctaccacaggaggtagtaaaatcactatttaaagactcattagacactcatttttaagacaggatttaagaaaaataatgagatctatcttgtggtagtcctgagatatgagctaaataacccacgagaggtcccttcaaatccaagcaattctgtttaaacgttaaaacccatctgctagaatggaaattaaatccgataagcattttccttagaaaaacattgctttgtatgagcaatggtctgtttgctcttctctttctctcttttcatcccttccaaattaaaaactggctcaaacctatctcaaaagtaattttcttgatattaacccctaacaataggattcatatcataatataccaagaatgtccaataggctacatcttgataaaggattcctgaactttgtattgggaaatattctgaagctgcatttagagagctatgg

SEQ ID NO: 6178 - DNA, 2046 bp, artificial
  synthetic oligonucleotide
aaacgtgactgatgggcagcggggcacccataaacttcccatagccaggtgcaggcatacctgcaaatgtaacgcccaactgtgtacaaagcagaaatctaaatgccagggcggactgggagaggttcccgtgacctctgacccggcctctaaattctcccattccctccccactgtcctgccgcgccccgtgtcgcctcgcctggcctcgcctggcctcgcctccctcctccgctgggggtctaagcctgcgcagtattgcgaacgcgggcggcgtttcccgcatgcgcagtcactgcccggcccggctttttcagtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatt

SEQ ID NO: 6179 - DNA, 906 bp, artificial
  synthetic oligonucleotide
tagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatct

SEQ ID NO: 6180 - DNA, 2065 bp, artificial
  synthetic oligonucleotide
gatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactg

SEQ ID NO: 6181 - DNA, 1475 bp, artificial
  synthetic oligonucleotide
tttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatc

SEQ ID NO: 6182 - DNA, 1655 bp, artificial
  synthetic oligonucleotide
aaaatagagcagtgaaaaccagcaaggaaagctgaaggaaaaaaaatcataagacaaatgaaaaacaaattagaaaaaatggcaagttcataaacaaattcaagaacagttgtgctttttcagaaggaaaacgaaaaatcagatagactaaacaagaaaaaagaaagaatatgagaacaaatacaaaaatctacatatgagattaggattatcatcatagaaacagagaaacttgaaagagctagatgaaaatatttggcacatctctgtggatgaagtggttaattttctaggaagataaaaagtattaaaattgtccgggcgcgctggctcacgcctgtagtcccagcactttgggaggcagaggtgggtggatcacctgaggtcgggaattcgagaccagcctgaccaacatggataaaccccatctctactaaaaattcaaaattagccaggcgtggtggcacttgcctgtaatcccagctactcgggagactgaggcaggagaattgcttgaacccgggaggcaaaggttgtggtgagtcgagatcgcgccatcgcactccagcctgggtaacaagagcaaaactccatcttgacttaagaagagattttaaaaaactgaacggactaataaccaaagttgtgttattaagtgttttttcaagtaaatagaaacgacttcagtatttcaataggaaggttttaacatggggaattgattatataggctttggaggggtgaaagaacacaaaggagaaattgaggtaatgcagagatacttgttgtaaaaagcagctaccacccctacgcagggctggagaaacaagaaggaagaggctggtattaccaaaatctaagagctcagagaagaggccctgggaagttgacgctcagatttgtgaagaaggaccctgcccagctgctgctattgtctctgtgctcagaactgggactcagacttctgaggaagggcattaccctgttactgctgctaggtcttaggggataccatgaggctgtttcttagagaaccaaagaagctgcaggttgaaaccacctgctgctgctggagtgaactgctagtgctaacaggaatagcagaaaacgtaaagaaagtccatcttctctctgctcacattccaatttctctctagttcctcctgttaccaggacttaaccaggggctggctggcaaaggagtctggaaaatgcagtttgcaaaattccagccccaacatttttttactcttgggaagtttaagttttaatgtattggcagattctattatctacgtgtatgtgtgtgaatgtatatatatttaggatttttacatcaatattcattactgtaactgggctatagtggtgttttaagcatctctgtgaggtttatgtatcagtgtcatattggtttgagaaacagaatccaccaatacatggaaaaaataatattcaacaaccaaacaatgtttaatctagaaatttaagaatggtttaatattagctagtctattaataaaattggccacacaaactggtcaaaaggtaaaaactgtaaaatcgtctcaatagcggctatcaagtcatttgactaaaatcattcctgattttcaaacctgttattatattatagaacatatctgcttatcag

SEQ ID NO: 6183 - DNA, 1290 bp, artificial
  synthetic oligonucleotide
tggaaatgcagagggaagcaccatttcattcctaacctcccctggaggtttagggaaaaggaaagctgtgaagccctgaaatgagctcaggctgtagaaacaaatgaggtggagaaatgaagaatccaggaagaaaataaaagcccagtttttaggtgggtaaaaattaagctgaaaaagttgaagtaaaatgtcttcttacttttctaattaaaaaagataaatgatatgtgtgactttctctgcttggaagctggcctcttgtgtcagttcagaagaaatcattaagaaacaacactgaccttggaactctgggattactgttgctactctggctacttctgtatccattggctgggctctttacaaactcccctatgcctcttttgggggtgaagtgtggagaaaactaggtcgcttggagatggaaacaaaggaaggagcgaagaatagatgtagttttgtgctggcttttgaggcaagctgaaaatcaccaacgagatgcctgagcacagcctccctgaggtggctccttgatatatcacattaacagttgaaattgtccactgagagagcagagagggctgtttgcgggtagaagaggcaaaggatggtgtgctatacagctgccatatctgtctgaggaaaggatttcccctctaaggcaccaagaactagtagcagtgtgaggtccctggttagaaaagggtagaaggatgagagaatgattaattaaaaacctagcttggccctgaaaagatcaaatgagtaataatgaaatccatcagcatccttggcagaaaaagaattttcctaaatgcttagaaccagcatgaaggccctatcaagctagtttcatgtttctttaaatcatgtccttttctgtggataaaagtcctacatccttaaggcagggtgcgatggctcatgcctgtaatcctagcactttgggaggctgaggccagaggatggcttgagctcaggagtttgagagcagcctgggcaacatactaagaccctgtctctatttttaaaaaaagttctacaccttcactgtaggaccttaagtacataaagagagacaggaaaagtaacctataatattaccacccagaacagcccatggttaacaccttaacttctttatttcttctgtttccttggtttcgatttcctctgtaaaattatagaatggactatatttatttaagagctattggctacagaggagggaagctgacagaggccaggccctgggcctcacattgctcgctgttcaacgtagcagtt

SEQ ID NO: 6184 - DNA, 1520 bp, artificial
  synthetic oligonucleotide
aatatgaaattgctgccattcctccaatgatgaatatttgctttgctaatatcgaatttatgccccattgctctgtttacatgcctttctgtgtacatgataccttttcatttcaatgctaaatcatagtataatctttctgaagacattttaaacaacaattcaattcagtatatgtagcaccagcaatgcacaaatctcagttgaagtgatgacaatgtgaatagctatgatcaactttgtatatacaagggcaatgacaactctttcatgactgccatctagcctacagcaattgtaaaatgccattgatttgggagcagaagtcagtgccaggacaaaccacagccaaagccaagccagttatgggtgagctaaggggattctggactgtcgggaagaagaaaaacccacatataggcagaaagaggcaaaagtaaaagcctgtaatacccagagtagaggaaggagggagtaaggggaagagagaggaagggaaggatatttgctttctgaagacttctcagctttagaccagttttatatacacatatgtataaacatacacatacacatacatatacatgcctacatatttgtatgttttaataaaccaattcttacttgagctacttcaatagggtttctgtgctggcaaacaaagactcaaacactacccttttaagatctgtttcagttcaaggactgaccttcagaaaaagtctaaagaagctcacctgaaccaccacaaagcaactgcatcggttgggtcagtttgagggattctaactaaagaagaaacatgaatttcatgcagcttaatatgaactgacactcaagcacataccctctataggatttcacccatgactaacaagccttttaatcatggcagaagacacggagattttgcaaacatgcttttacagtacccacatttggtgttcctgaccctgttttcttgccagattgtgagaagcacctgctccttttcaaacagttgtcagatcaatatttaatcaattgccttttgatatttggtagcgctgaatgaatgggatgccaatatttctgctcagagctgttcctctggtgtacctcattcgttttctgtgaaagccttcaggaacctgtgaacactaagtggcatatcctccgagttctgtggctcctccctctactgcagaaggactctgtggctagaggaggcgcaagacgctggtgcctgtgctactcttattaaaatgacgtccaaactgagtcatgaaaggaggagagcagagccgcatttgggacactgggggagctttgccaggtgagggctatttaatagaccagacacattaaagaaaggcggtgatgtagtgaaaggagcctaatgagcagtagtgaggctaccgtatctaaagagaaaaaataatgagctgcgaaatatcccccaaggcgagattgccagccttctggaaggaggtctcagcctacaggtaaaaaggctcatgtggtcccttatccttgtatgg

SEQ ID NO: 6185 - DNA, 1073 bp, artificial
  synthetic oligonucleotide
gtgagaagggaggatgggatggctctctggaaatgtgaggacagcctttgcccataaactcaagatatttggagctctccatggaaggcctcttatgccaggaagagaggaggccccaaaggaacaaatgatactttgaaacctcaacactaaaaatattttgcggcaaccacaggagaaggtctcaccaatggtgatctcatgggctcctgagagtcattgagctcaacatttgtgtttgaccaactttgagagtgggaagcagagaccccagttctagcttccagaaccccagccatctttccactgctcccatgtatgtgctctactttttcagggtgtttttgaggaaaactatacagcagccatgattccaatgtgtaacaacctttttagttgaattcatccaatggcagtgacttcgtcactattcctcagcagaacccttgatgatgttctgctggtccagtccagtccatgcatattcctccctctcagggtctgttgctcagctcctatagtatgcaatatggagcatccttctagtaaattcctcttcatgccagagttgatttttggtgcttctaattgaagaactctaactgatattcctattcatgttgcattcattcattaaatcatcatttattcagcaccaccatctgccaggcacagatatcattagggaaaaagcatagcccttgccttcaagggcctcagagtctaatggggaaaagacacaagtatgaagggccacaatagagttattaggtaggtaccagagaagcagaggaggtgcaagcagcttagacttggtagagccagggaaggcttccagaggagaggatgcttacgttttgatgaatgggtagaggtggtccaaacagaggaaggaggaaagatgcattctctttaggcagaaaaccattgtgcgaaggcttgaagatatgcagaagctggataaatctgaggcactgctaacagattagctggaatatagggcaggcatgaaaatgcagcaggaggggcagcttaaagaggttggcaggaagatgccagaccaagatatatac

SEQ ID NO: 6186 - DNA, 726 bp, artificial
  synthetic oligonucleotide
tgtgttgcaggcacctgctgcctcctttttgaaaagacagaaattaatttccaccaaccatttgctctcaaagcagggactctggtaccaatgatgtttggcccagcacagtgtggaacttgcagccaccaagggtgctgactatgctgttggctgttctgagagcattatttgtgatccacccagagaaagcctgagaagggaggatcgttacactggcctgttgaggactgagctatccatatccacaagctgtctgaggtcacctgtgtctctgacaacagaagccagagcctctggccatagccatcagattggatttctagacagctctgtctctaatctggaggagactcagtggccaaagaaagtgggtcactctgggctcttggctgatgtttctcaactgccatagtgtccttgtgaggtaacagtgggaattttggttcttcccatcatcccatccccaacacacacacacactttagcaaggcagcacagcacaatggttaagaatttgtgtatacgctctggggttaaactgccagcctcaaatgccaggtttcctacctaggtaagtcacttaacctctctgtgccttggtttcactctcataatagcaccacagaggactggtacaaggatgaagtgatggaaaacatctagaacattctaagagcatctagcaagtgcctgataaatggtaacatttttaaaattctgctt

SEQ ID NO: 6187 - DNA, 943 bp, artificial
  synthetic oligonucleotide
ttgaggacgagaggacagtttgcattaattattagtctggctcttaatttgaatcaatgaaaatgccagaatgacggaggtgtttgggctgaataataattagcaaggctgacatgggcctaaacaaagagttgcaggagaggaggacagtgtctgctagcaggccatgggctaagaaggcaaggctggggcttcattggaaagaaaagcaagagtcttgcccagagacccctggccttttccagagtcatctggagaggctgagaggggaagaggaggcatgcaggacagggcagggcagggccaagctgctgctctgcaagtctgggccatggaaatttgcagtctctagagcattcttagcatcactgagcttttgaatctgcctattgttactcttttggaaatgggccaacttgtgtatgctttcttgtatctaaacacagccttactgtgggaccagggatgtcctcttggaccttaaatatcagctgtcccaaggaacccttttaatatgcaagtgagtgaagtgaagctgagagactggggaggccttggtcaaagtcacacggctgggaaggacagagatagtagaacacccaggtcttctcactcccccaaccccagttgtcctttcgccaggccccagtgtttcgtagctttgcataaattaattatcctaatgtatttctaccctctaactgtgggcaggacaccaaccagttagatatttccctggtaggaaagaggagagggcaatttgggatagatggatgttggttgcttgggtgagacaggactcactaatagctggaaggagtagctagctaattcccgggatttgcaagaacccaggtgtttttgctctgaaagcttgtcttaaattccactaggaaatattatatttgtagtaaatatttctatctttctatggtcctttaaa

SEQ ID NO: 6188 - DNA, 1691 bp, artificial
  synthetic oligonucleotide
aaagggagccagtcaaaggtgcattatcaagttggctggcacggtgggcaactggagtttaatcccactggggaaactaggaactagagagaccagtgcttctcaagctgtctggggaaagtaccaggttgtctgctgttgttatcaatccattataagtggatacttttgtaaaaatacaattaaaatgtcacagcaatgtcaaattgctataaacgttcgtaaacgccaactttccatttgtgtatgtaccttgaaatgtacaagcaataaacatttcacagcttgtcaagggcctggagaccacacttcaagtagcactggtggagaacgcacaaccttatccaagttatctcattcatggagctgggctgtttatacactagcttgcaatagtcatgtaattctttcatgtgcacgggcagtgtggtggtccacagtttctagaaagccatcaggcaaagagacacacacactggcagttaggagtcagcctgaacaggctgagggaacagggcggggcaccgacagcatatagaggcgcccaccctgtcggtgtccttatcttgcccctgttagcaacactctaggacttaagatgagggcaaggcagaggccagatgagtgtatcctgaaagctgggagatctggagcccaaattcaggacttccctatggctagttgtaaaaggagggggaatattgggtggattctactttagctgcctggcctagcatcagaattcagctcttataaaaacagctaagccactgttaaaagaaaaccaaaaccaaaaccatcccagcacccggtcagcattgataacaaacacagaggggcttttttgcctgaccgcagtgcaggttgttgtttggtttgctcctgcctggagcttgtgcttcacaggcttcttttgcaggcttgttttccaggggacctggcagctatttctgactgtgcgataaactcatggcctgcaagatggaggcaggaggtgactgcagtctcggtgaaggggattaagggattgaaaagtttatctgggctgcccagcagccctcgggaagacagaccagcctggtctctctacagtcaccatcactagggctgactgccattttcagggctcaagagaagatggggataagagtaatattaaaataatgacgatatctggaatggacaccttcagactccacctgggcagtgactttgggctgggtcctttacatgcactatttcatggtcccaggaacagttctgaggagtgtgttacagtgactagaagtgacatcacccatgtcacactgcttgggtctggatgccagatctcccatctcagagctgagtgatttaatgtgcttcagtttcctcatctgaggttctacctctctccttgagttgttgctgtattaaatgtgctaatctctgtgacatgcttagagtaaggtgaggcatggagttagtatccagcactcatgcagtcctcagtcccaggccctgtggggaagtgaccagtagcaggttggctgggccccctgctgctgaaacacaattttactgctgtcatgctgatggtagccaaagaaaggaatgtgattaagactttccattttctgctgttggcactctgtactgctactccttctaaggctacctgggaaatgtatgactacagccttgaaggccac

SEQ ID NO: 6189 - DNA, 2561 bp, artificial
  synthetic oligonucleotide
aatcctctcttaaaaccgcagctgaggcagccaaacgtgcctgccctctgaagggcctttcagacagtagcgtgtgtttgggaaaccttattttttaaaccacctccccagttctctctccccctaaaaatgaaagaaccatcaactcctagcctgggtttcaccgtgcactgtactagggaaacccccccgggaagacaggctccctgctggagaaatgttcctcctgcacaaagctctgcagcagaccccagatgggggctcgggcccccatccttctggggcctgcgttcctcaggggagaaataattggcctgtctatagagcatcaggattcaaataaagcttaaaaatgcacgcagccctgagaattctacaaatgtggaattacaaatgatggcccaccaccatatacacacacgtgcacacacagccctgaaggccacctctgcttttctctctgattgtttcccagatccacctgactcaaataaacccactctcatttgaactggaggtaatcagggtggaaaataccccgttccgttggtgcaggtccaaactgtcaccatttggcatcctgacacaccgatgtccccatcagctgttaacgtcagccaaaggggccctcccccagtcaacaaatcagagatttcattaaccagcaaagcctcccggaaggatgagcgacctcacgtgggcctccccccatctccctcactgccccgctcccttctgctacacaaacaggctcacagcaactagattggattcagatcttgtagatgaagaaattcagatacgacagcagcgcctcgccagacccggagcgagggccaagccccacatggcagctgggctgcctcggtaataaccactcgtaatatctgacagaaagaacccacgctggtcatatccgatcctgccacatgaaaagaagcattacaccagcctctcgggggccggggctaggggagagcctccgcacaaatcagaaacattttccacgaagctgctattcaagggctgcaaaatcaacaggggctgctttcctaacatcctgagagatgctattattctccgggcggtgcagctcacagaacgcagcaaggccagcttaacccgaattcactgagcatttggcatttctgagctcagaggccttgaacgggtgggaacaaaaacccattctggttgtgggagtgggctgtggggctccacaggggtgacattctaaatatttaacaacggagacagcctgggcctctgccattcagaatgagccccagcctcagccctggggcaggaacatgggtgcctcaggctatggcaagcagcccaggtggaagggacacttgggacaatgacagagaagcatttcaatactatagcaactggtagggctattgggatgaaccctggtccagaagcccctcctgagccatgctagggggtgcctgctcatagcatctcattctttgggcccacgacagccctgagccacccctcctcagccaaaagcttccagacacagggccatgcccttgtagagccaggactacatgattgagtctttcaaggcccatgcccacctgaagcagaaacttacaactcaaggctcccagcatgtttcaccatggctggattttaaatgctgagcgtccctagacacacccaaccacctgtgataaatacacaagtaatggccctgtcaatactccccaccacctcaaattcttgtccttcacatcttttcattgcggcagcattgtcctagccaggaagaaagggctagattcccccagccctgtctctgtctctgcaaccccaagctcccagccccgtcctcctcctggcttagccttgtacacctatgggggtcttagaggccaaagtcactcagggacattgagtctccaaatctttacctttttggtgtaaggcagctttgtcatggtggaccttgagacattcaacaagataaagtgatctccacccagcagtcaccttgtttgagtgtttttgtttttttttggtcttttttttttttttttttttttggagatggagttttgctcttgttgcccagactggagtgcaatggcatgatctcggctcactgcaacctccgcctcctggattcaagtgactttcctgcctcaacctcccgagtagctgggattacaggtgcgcaccaccatgcctggcaaatttttgtattattagtagagacgggttttagccatgttggccaggctggtctcgaactcctcagctcaggtgatccacccacctcggcttcccaaagtgctaggattacaggcatgagccaccgagcccggcctcacattgtttttaaagcaacagatattgaactcataaatagctgtctacaatgacaggtagtgtatgctgaaatctcatgggttgggatgaaaacaaattaagtgtatataattcacttcactcttactcaatttccctgcctgtaaaatcaggccagtatagcttctctgtgcctcagcttactcatccagaaaatgggatgaataggcaccctg

SEQ ID NO: 6190 - DNA, 3319 bp, artificial
  synthetic oligonucleotide
ggaagtagactgagacgggggtcctgaagctcccctgctgtacctgctgttaaccttttcattgttggatggaggggcaggcggagggggcagtgggggcagagcggcagggcctgggagaggggtacttggggagttgaggctgtttaccaaggagcacagcggattttgatattttaacagctgctacggcctggcttgagcaggccagcttgagtatgacccaggacagggtctcctggtggctgggaacccccaggtacacatgactgctctgtaaggcaggttctcccaggcccccagaaaggagtcctcatgaaagagggccccttctcaagcacacacactctctgccactaccactgcagatgcatggcgtcctgtagggctagctcatggagatatcatccccacagggaggacagaatgatttgcactgagcctgagcctctcaggcttgctctctctctctctctctctctctctctctctctctctctggcccaatgcctggtctttgaggctgcctttgtgagaaagaggaggccaaggcccccactggctattctctgtgcagagctaagtagcctggggggctgggaggaagcccttgacctcaggggccctaaactgcggctgacagcaggcagcaagggggggcccttgggaatggcgctttattgaggaacatttgtcttcatttggggcagtctacatctcatcccacaggcgtgccctgaggcccgagtctccctgacccctaccctgactgtctctgcactgcaacccctgtcccctgcactggattgaaggggaagttgtctcttaaagctccttggagccaaggtgacagacgtcagggaagaataacaggaaattccctcacaccctagaatgctcccagaccctgcccaggaaaagaggcttaagatagggatgggcacctcacagactcagccccaaagacctgggtcctccctggctaagtgattctgctaattcccactcaaattcagcataatagtcataggtttggataatgaaaaaatatgtacctatggttttcagtatgcaaactaaagaattaaatctcctcaaaataattgtggttggtcaggaggcccccagacactgtcttctctctcatagaaagagactctggtggaaaggactctgcgaaggggctttagaacctgaaaatatcagagtgcaagattgtggtgtgtttttcttttcctgaaaaagtcaggatatttaaaatgttagaagaccacgaactatgccctagatgctgccacaaatctgaggagctgttaataaatcatctcacctctctgtgcctcattttccaatttttaaaaaattgcctaatcatcaaagaggcccggaagctaggctaccaaggcgcgacgctgtttacaccccagacccaggttctcagctcggctttgcttgggaaaggctcggaacctgtctgggcctgggggtttagcacagaaggctttggttagctgcactgtgctgagcgcagctctgcagcgaggtttagggagctgcggtgcgttaggcacaaggcacgtggcgcgcctcgctccagcactttgcaaacgcacagcagcgcagggccagagcggctggcccccaggggtgggggcgaccagggacaggaggtcccatatggtgtcgtcgcgttaaaaacgtaggtcctaaggggcgagccgcgtccgacctccgcgcccctgcccgacgcggcgcctcgctcgccggccccgctcgctggattcatttccatctggagcgcggcgcgtcccaaccgcccttatctcgccgccgccgcggctctgcaggcgcgggcgccccgggctccctcccttcctctcccctcccccgcccgcgcctttgtctggcccggcggcgcgctcggagccagcagggcgggtaattggcggccggaggaggcgaacggcccggcccggcctccgctaatgagcgggcggagccgcggggagggcgcggcagggctccggcgcggagccggggagggagcttccgtggccgcgcggaccccgggatggctctccgagtcccggccgccccctcccgggctgtggcggggaccggcgccctgaggggcatcccttcctcctcccctctccctcccctatcccgtccccggcgcgctccaattaccctgcggccgtgccaaggcctgcggctgcccccgggccgcccccgcgtccccggagaaatgccagggacagaacgcgcgggcaggagggcagaaggaggcggctccctgggggcttcgctgcgctgcaggggacccaggcgaccctggggcacggccaccgttgttgtggtgggggggcacccccggggtccgatgccagagagctctcttagggaagccctcaggcagctgcgaaacctgctccagcatagatggtgataaaacccaccctggtttctaaattaattatactcaatccgcctcgctctgccggccccgagctacacttgtgtatcgaagggcgcggtagcccctcggtgggggtggaggggatgctctgttgttggctccgagaaaccccctttccaggactgtgtgcgggaagtgacagaggccagcggagctttaaggaaaataggggcaggaataggggacagagggaagcctttctccagccagtacccccgtcgactccccctcctggaagcccgccctgctgccatcactggcccgaggaccccggctccaggagcgggtcccgcttcctgcggtgcagtactcaattgtcaggatttctacaacaaactggcccttgtgcctccatgctcaactttcgcttatctccattgagcccggctccgtctccattcccgccggtgctttgttccctagctgcgttctgggttcttgaagtcactaatgcttagcattaacaggatccttcgtggccgccctttcaatcgtggcttctcagacttgggagctgaggttctgcctgtggaaggaagggcccacacctcagggacttgggggtccatgggggagccccacactggccccagcacagccttagggtatcacaagcagcctaggacagccccagagagggagtgtcccagtggcttccagggtcacttgacttaatagggactaccacatcttaagggaaaaaaggtcatttttctttcaaagagtccccagctagaacctttccctttcctgcccagctcccaccacagtggccacctgggagcagcccacccacagagagcttttccccctttttatttacttttttattgaggtata

SEQ ID NO: 6191 - DNA, 1383 bp, artificial
  synthetic oligonucleotide
agcaaacaaagcagaaattgcatggccttttatgacctagtctcagaagccacacagcatcactctttcagtagtattttggttgaagcagttacaacccacccccaccccccaccccggattcaaggggaaggaccagagaacctgcctctggatgagaaaagtgtcagagaatttcctgccatgtttcaaaaccgtcaaggggctgacttctgtacagtacccactttcactgtcagccagccttgaacacaatattcttttatcagtagcagtgacattagggcaacactggggatggggaggagaatggggaagtgaagggccatgagcaaaactttggtttgtcttttttcagcatctgattctactctcatttcttcgagtccatcatagtccctcttttcctaccctcaaagcctgagtgcaggtgaggttagccctttacgccaccccagggcttctatcctgagaagcaaagtgctagaatagaaagcgatagatagattgtctctgagattatggcctgggttcttggcacagcaggattctagggtgtttgtttttcattcctgtcccaagaatgcacctgataacctccctgggcctctaaaaaagcacccatcatttgtacaggtccttccaggtgctgagataggaaaaaagagggatccccagtcagggctggaagggaagctacctcccctcctcttggggaattcaaccctgtcctttttatgattgagggaaccaaagcttagaggggctgtgacttgcccagggtcaccagtgtgtcagcggctgagttggaactgtgcagaattcacccttcaccctggggcatttgcaccctggggcactttccacagtcgactgactgcggggagaagtgggaggaggttacactcagggcaaagccactaaaggccagcattcgaccagctcagccagcctccctgggcctcttggcagctctgggcctgcagggagggtcctacccaccccagccaaccctcagaggccccccaggctgccaaggccacgtcaccgcagcctgcggtctgcccagctaatggcagctgctgcgaggggagtggagccgcagtaattacagcatcaaggaatcacaaatggatctgcaaagatgacattaggagcattagacctggcacggctgcctccggagaggtcgctgggaggaggctggggctggggcctggggatgggagacagacgtgcctctgtctcaccccacccccttcgttcccaaccggggctgcgatgacaatgccaggattcacaagcccctcgcagaaaccacatcggccgccagtctcgtgtgtgtcagcgaagataacagatgtctttcacagggaagtaatt

SEQ ID NO: 6192 - DNA, 7624 bp, artificial
  synthetic oligonucleotide
gtttattaaagccattgctggatgtcattactgataataacaatggctagtatttattaagcatgtattacatgccaggcactatattttcttatgtgatcttcagaacagtgctctgactgggcagctgactagcccatcattcccatttttttttatctttttttttctttttaagagatcagggtctcactgtgttgcccaggctggagcacagtgagtattcacaggcaagatcccactactgatcagcacgggagttttgacctgctccgtttccaacctgggccagttcaccctttcttaggcaacctcgtggtcccccgcccctgggaggtcaccatatagatgctgaacttagtgtggacacttgatcagcatagcgtgctacagcccagaagtccttggctcaagtgatcctcccacctcagcctccggagtagccaggaccacaggcatgcaccactatgcctgacccatcattgccattttacagatgggcaattctaggtttagagaggtaaagtaattttcacaaagtcaaaatgtaagccaagatttttctctctcttttttttttttttggctgagcacagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtcattgatggcaacaatatccactttaccagagttaaaagcagccctggtgaccaggcgcccagtacgaccaaatctgttgactccgaccttcaccttccccatggtgtctcagggatgtggtttggctgacgatgcaaaagaagatgcggctgactgtagaacaggaggagcagagagccgagccaagatttttctgacttacctgtctttggccttaaccactacactgtgacatttatgaatatgaaactttcagctcaccagcagtggtatcaaaaggttaagaaatgagtttaaaaggtggggagaggcagtggtaagggagaagaaagtattgctttatgcccctgaaaatacttctcatatccattagaaggccgttctccctgtttcaatggtctattgctgtatagcaaaccaccctaaaacgtggaggcatatgtaggggagaaaagatttcttttctcattcatcactgggttcatggatgaggcacctaaaacaagatcgattaacaagagaaaagcatacaaatgtatttcatatacgttttacgtgacatgagagtactcagaaatgaaaacccaaagaaatgggtaaacttgcaaatttttatgcttaggtttgatgacgaggtggctggtcatggagaagtatgattgcacaaagaatgtatgatccaatggtagtaaactggggtggggagaggaacttcgcaagcctgtttattcaggttcctctctgcgtccctgtgtcttcagacataaagaagttcctttctgttggctattgaaagggtaccacctctcacatgagggtcttatgacctgcttcatggaaaagtcaaaaaagtattttccaggttttatggcctgcttcaggggaaaaggttgggagaagatcagaaagtcctacctgcttctgtagttttctcaaatgccaaggtgccatattttggagtagtgggtcctgaaccccatcccataaaacaacaatttatgatagcctctcatagttctgtggattgactgggctcaggtgggtggctcttgcttggggtctctcatgcagttgcagtcaggaactggccagggctggattcctctggagattcaactgggctggacatccaagatggtgcctgcacaggcgctggcagttgacaacagctgtcatctgggaagtcagctgtctaccagagtgccaacacctggactttccatgtgacttgggctgtgaaatttgaatttcagataaacaattaataatttttttagtataagtttgtcccggccatgcacagtggctcacacctgcaatcacagcactgtaggaggctgagatgggcggatttcttgagctcaggagtttgagaccagcctgggcaacacaaggaaacctcatttctacaaaaaatacaaaaattagctgggtgtggtgacacatgcctggagtcccagtcactggggaggctgcggtgggaggattgcttgagcccacaaggttgaagctgcagtgagccggggccgcatcaccgcactccatcctgggtgacaaaatgagaccctctctcaaaaagaaaaaaaaaaaaagaaaaaaagaaaaaaaagtttgtcccaaatattacacaggacatactcatacttaaaaaaaaaatcattgtttatctgcaattcaaactggggaactggggacatatttatacttaaaaattctataatgtatctgaaattcaaatttaactaagagtcttgtatttttctttatctggtaaccctacctaggaaaccatttttctaccattctcaactattcgtggtttgcgtggagtcagccttaacatctgtattcatcttctcttgctatgtaacaaattttcagaaacagtggccagctcacagtttcatgggtcagaagtggctcagccggattctctgcttagagcacttagcacattaggctaaaatccaggtgtcaacagggctgtgttcctttctggaaaatctgggaaagaatgcacttccaaactcactcaggttgttgagagaatgcagtttctcctcacattttccacgtggtcccctccatcttaaagtcaacaagggcacttggagttattcttgtgcttttatttttttatgattttttcttctcttttctcttctgccaccagccagagaaagttctctgcttttaagggttcgtgtgattagattaggcccactcagataatctccctttttaaagatcagctgtgctatataacataacacaaccatgggagtgaaatctcatcacatttacagtttccaaggcgtaaggggtatcttcgttcttttgcatcgccgtaaagggattcctgaagctgggtagtttataaagaaaagaggtttgtttggctcacagttctgcaggctgtacaagaagcatggctccagcagctgcttctgatgaggcctcaggctgcttccactcatggctgaagatgaaggggagccaaggtatgccaagaccatgtgacaaaagaggaagcaaggggggtggggtagaggtgcccggctttatttaacaatcagctttcgtgggaactcagacagcaagaactcactcattacagtgaggacaacaccaacaccaagccattcatgagggatccagccccatgacccagacaccccccaccaggtcccacctccagcactgggggtcacatttccacatgagatttagaggggccaaataaactatatctatatccaaaatatatccatatccaaactataacatgggacatggggtcttgggggccattcttagaaattctgcctgtcacacccccagacctaggggtaggccctgagagtcttaagccgatggatgcttctgatgtccacctgaagccaatggtgactggtgtagggattggcatgtaatccaatcagagccaatgagatggaagaacatgtttgcccaggattgagggaaagaatgttttctcttccacaggattgggcgctacctggatataggtctggaggcaccaccatctgaagaccatgatgggtgggctggaagctagcagggacaaccacagagagcttgacagggagcctgcccaagggagcaaagccgaaaactgggttggtaatgtcatcacagggctaactcaggccactccaggaccctactctacctgtttacttgtaattcacgggggacagaatgagggtggaaagggtgttgtacaatccccttcatgcctaagaagctttagtaggtttttcctatcatctgcacatctgcaactgaaacattcatatatatatttgttttattataagtgtgcaaagatctttacgcattgggcaaaatagccatttctttatgagaatagttcctcaaactcactcttgcaaccaccatccatcaagacacaggaaaaaggaatgcagggatttaggaatgctatacttgcttctcttcaacttcagcagcaaaagtaggaacgttctcaagatgctcctgacaataattatgttgtcctaagcaataggatgttggagagtatggaggcctgatgcacaggccttcaagttctcaaagtgtttcatcttctcagttcaggcacaatgttctcggtgaaaccatgccaggcacaggagcatcctcttcacccgattgggtacacagggccgaccaaaaatggtgatttccactaggttcccagagtccactatgcccactgtcagcagggcctggatcatccactccatttctagagttatggctccatctgggccaaagatctcatccgccagccatgcctccaggtagaacaccaaagggtctctcagttcctgcaccggaaaccacccgaaacattcttaactgatacaagagtgatgtcactaacctgtgtgcagcatttctggctcttggtagacaatttcaaacttggtagacgatatcaaacaagtgccagatgagtctctcagttacaaaaatgcaggtgtgaacctgtgctaggttactggtaatccaacagcaggaaaatttctcccaaataactcccagagagcatcaggtctccaatagttttgtgaagactgaccccctaatttttctaacctcttcaggtgagcagccaggctgactcaaaggttaacaagagaaaaagcaatgtgcttggcctaactcattgtcacctgccctttctggaactttctcatgtctttcaattacctgcccattcacttttccaggactttgtcaggaaaaaagttcctgtggaactttagcctggtgttacagctctgccagtacctatgggcattgacagctctgggggagaggggtgtctttaaacaacataaaacagcagggactcttggagtcctgaaacctcatctctaaataactaggttctctatctccccaagataggaaggactttggtcagtggaattcactttcattgagcagctagtaggtgtcagagactacatgatagtgataacacaaacacacaaaatactatatacacataaggccgggtgtggtggctctcacctataatcctagcactttgggaggccaaggcaggaggatcacttgagcccaggagatagagaccagcctgggcaacacagcaagactccctctttaccaagagtaaaaattaaaaaatactatatacacatgcacattttgaatcctacagcatctgagtgaggaaggggtatgttttcactccttttaaagatgagaaaattgagattcagataggtaacttaacttgcctcaggacccaaagcaagtggggaaaagaggcaggattcacacaggtggccacctaacttcaggcagtacgctccagtacctggccctgagctgggcgaatgaaaactgactggggcaagaacctcaaattgtgttttgttttgttttgttttgttttgttttgttttgttttgtttttttgtgggggggagtctcgttctgttgtccaggctggagtgcagtggcacaatctaggctcactgcaacctccgtctcctgggttcaagagattctcctgcctcaacctcctgagtagctgggattacagacatgtgccaccacatccagctcatttttgcatttttagtggagacggggtttcaccatgttggccaggctagtcttgaacccctgacctcaggtgatctgcctgcctcagcctcccaaagtggtgggatcacaggtgtgagccaccatgcctggccaattgtgtggttttaatccttccaataatcctgaaaaactaggtatcattaacattggccccattttacagatgaggaaactgcttacagagtagctttttcaatgtcacaaaatgagtacagagttagagtttgagcctagggcttgtagatgcgaggagagaggctcagagcagaactgggcagaaacttggagtcagaaatctgataatactctggtgtcattcactcacccatttatcaattcactcatttgtgcatctagttatttattgagcaccccttgtgtgttatgctgtgagaaaggctcataccactgaactttgctctcaagagatttataatctatcgagacagatgattttttttgtgcgtgcccaaaaagaacattctagcagggggtgtggcaggagcagaatccagaaacagagcaatggcagagttcattgcggggaaccgaaccgaccccactttcagtatttcaacagaaagcaatttaatacagagaattgaatgttaaccacatcattgaaagagctgtggagaagacacttaggctggccctccagaaatgacccccaggactgaccctccaggggagccactccctcagccacaatcagaaaactgggaatcagaagttgccagtgggactaaggagttcgagaacata

SEQ ID NO: 6193 - DNA, 990 bp, artificial
  synthetic oligonucleotide
taaacagcatctcacagcatggccgagcaataacaaatggcgcctggtggctcgcctgctggtggcttaaaaaacaattgatgacttttaatcagctgaatgagcatgggacaaatgacagcatggcctgaatgcagcccagacgtcatcggctgacatcagtggggaggagggaggtgcccttctggtgagcttgggaacaaacaggagcagaggctggcgcttgaggctccaggaggcagctctgctctcaccccaaagcggttgccttcttctctcccttctggggagaccaggtgagccaagggctggggcactggaagaccggggttcagggtctccagatgtcacttggtaactgtaggcatcagttcccctccagacctcagtttccccctctgataaatggaggagatgaaggcaagtttgtgtcttctgttaagccgccccatatgtgggatagctttagactgaatctctaaaggactcaagtgaaggtctgtttatatatcctgctcctatcaaaactatcaaaaccatcaacactccccactgcacggccactttcccccacctccccctacccacacaccaaatggatactcaccaagcattcctttttttttttttttttttttttgagacggactcttgctctgttgcccaggctggagtgcagcagcgtgatctcactgcaacctccgcctcccgggttcaagctattctcctgccttgtaatcctagctgggattacaggtgcgtgccaccacacccagctaatttttgtatttttcatagagatggggttttgccatgttggccaggttggtctccaactcctaagctcaagtgatccacctgcctcagccccccaaagtcctgggattacaggtgtgagccactgcacccggcctcaccaagcatctctgataaaggagtgcaaatttgagcaaaggaagcaaaaatggcaggaatgaaaataaaggtatt

SEQ ID NO: 6194 - DNA, 2133 bp, artificial
  synthetic oligonucleotide
ctacccagaattttgcccactctttcaggggtttgcagtccctacttcaagcccttgcagggctccgcctccccaccccagtcccggtgcggctgagttggacccggcggccgcaggataaaatccagagaggagtccgtgtgacggcgcagcaggattaagaaatctcccagaccaggatgggcacagaaatggttaagggggtggagggttttgtttttcacctctgaggactctgttatgggtcattaagaacacaagaccgaacgagcattccatttgctgggcctgcctctagcgcacagctctgcttcccgacaagataagttctgtgcaggaaggaaatcctgggcccagggaggcagatgggaaatcaccccagataaggcggctgctccgagtgctggagtcacacagggcctttctgctgcaagaatggcactgccgagagtctgcgtttcttgccagctgaggaggaggaggctcttcggaggcgtctcctaacacattgctgttctaggcagctctgcaaggggaaccccccaacgggggtgcagcaccgtgcctccaagtgaaggagaggccctcgggttcccggagtctggagaggtggcctccagcggtgccccggccgcctccggctaggcccgcacacagtttacccccacccaggcctcctggcacccccgccccgcatccaccacccaggtggtacctgtgcccgcgcaggtgaggaaaaaggcctgtggaaaacatcattactgataaataacagttcctttcaggtttaatgacacgttgcatccatcctaaatctctcaaaaaaaaaaaaaaagaagaagaaaagaaaaaaaagaaagaaaaagaaaaaagccctctcgagggactgcgcctcgcgcctgtaaataggaacgacaggccggggcgcgcgccgaggcgggcgcacggcttggagcgggcgtataaattaaccgggggccgcagagtgaatacattgcacgcggtatttattatgcggccggacctccgaggggttctccggctcccggacgtggcaaatcttgtccggagcgccgctggccgcgctgccaagggctaggacgagaggacccgtggcggggggcggggggcttctcctccagtcctcgggagccccggggcagcccgcttacagcggcggcagcggggagggtttaggcgaggagagacgcggccccgggcgccgctcgggctaggggccgggcggggagggcggggcggtgggagcgggcggcgcgcccggccccttagcattccgccggcgcgcccgccatcgccgcgtgcgcccccgcgccccgctgtaattaccccgattaccaaatgaatctcgcgcttttgtgctcgccgggcggtgggtgcggggaggcagttctaatagttgtcattagggccgggggaggcggggcgccgggggctgagggtgggagcgcgggggtgggggaggcccgccattccctcgctggctcgcttgttcgctggcggtcccaggcggcgcgcaggccgctgctggctgctgagtaatgattttttttctaattggaggcgaacagcggccctaatggatggagccgctctcggcgcgttcgctgcgcccgcccttcgatcaatacggctcgctgagaccgccgggccgcgctccccggccctttgtggtcagagatgcctcgggggccccaatccccgccaccaccaccggccccccatgctgcctcagcctcgcccggggagttcccagccccgccactccgagacaccacccctcctccggcctacccccaccccggacactccaaccccaggctccttcccgcacccccgcgcccgagttcccctctcggaacactcttactccagctcccccaacactgcccccgcgtgtccccgccgtcccgagccctccatcccttcttgtcctcacactatgcccagtagcctggtccccgtggcctctcagacagggtgggttagcagggaggtgtacgggagggcagacccgggattgccaccctcaccccttttccgtgaccgcgtttctgccaagcgccccaggccgggaggagagccgggcacaggcgacagcctccgagagtttac

SEQ ID NO: 6195 - DNA, 3172 bp, artificial
  synthetic oligonucleotide
aaccttccccacacctgccccctccccacctctgcctgactgaccctagatcctttttcttttttcttcctttcctttgtacaaaaagggaagagcaagtccggctcaaacgtgctactctccaggaattgccgaaacttacactgaatgacacccaaatcccttcatgggcacctccgataaccaccttggtggccgtttttcatacccatggctcattagggtttctggggccaggccaagaaattgccaaagacaagacaagcaacgcctgcctggaaattccgcagagcccactcccctcagaggcccttcctgcagcgtgagtgagggggtgagttgcgctgagctagagccgcgcctgacaagtgacacgcctgatgagagacgcgatgacgagtccctggggaggctgtggagtctggttcctgcagacactgtctcccctgaggcagtctccgcgcttgagtgctgagtgtgtggtgtgtgtgtgtgtgtatgcacacacatcttgcttctccaaagaagattctctgagctccacagcaagcttgacagaggccccccgaacactcctggggtccacggacatcaagaacaggcacggcaggccgggtgcggtggctcacgcctgtaatcccagcactttgggaggccgaggcaagcagatcacttgaggtcaggagttcgagaccagcctggccaacatggtgaaacctggtctctactaaaaatacaaaaattagctgggcgtggtggtgggtgcctgtaatcccagctacttgggaggctgagacacaagaatcacttgaaccagggaggcagaggttgcagtgatccgagattgcgcaactgcactctggcctgggtgatagagcgaaactccatctcaaaaaaaaagaaagaaaagaaaaaaaaagaaaagaaagaaggaaagaacaggcatgacaagccagccacagcctgctgagttcaggaggtccctcatggagttgccctatcctcacctccctgttccaagcacatacagggatggattgatccccttgggagctgctgagccctgcctggtacagcaagggaggtaagatccagcctgcaggtgtgtgattcgcctgactcagcccaaacccagatcatgcctggaccatcagccctgtgctgggcactgggccatacagaaatgaataaaatagtctctctcttcagagtgcttgcaatctaggtactgcagactatgtaagggtcatatgttccaaagaagccaaggtcacaagaaaaatttttttttcctagccctcctctgatattcccacccccaaaagctttctgaaggatgtggcatgtgattttgaaaaatgcctaggctgacaaaagcccacagagatggaacaagaggaggaatgtcttccagcagggtcttgtggttaaagtgaagagttccctttgggggaagtggatgtaatgaatgtggaagatgacaaagaaccaaagaagctcaaggcaggactgtatgtcaagtatttggtcccctgggttcccctccagacaccaacaagcagccaccatctttttcttcatgctctgcagggagtgttacaaagtcatacatggtccccttcttagatggatctgaatgtcttagagttcctacctgtactgagccaaaaggtgcagctctcttgctattcaccctggggcctgcaaaaacaaggctcatttctcttccaccaatgacccttcaaatatttgaaataactgtgttttgcttttctactcctgcctaagaagtaccaccaaaacttaatggtttaaaacaacagtgtgattatagctcactgcagcctccaattcctgtgctcaagtggtcctcccacctcagcctcccaagtagatgggactacaggcatgagccaccacactcagcttaacaattgattctttttctcacaattctacagggtcagtttggctcagctggatggttcttctgttccacgtggcagctggagccatgcaactgcagtcagctaggagtttgacagagtatggggcatcccagatggcctcattcacatttttggcagttggtgttacctattgactgagttgctcgtgttctcttcccctcggcctctctcttcagtagcgtagcccaggctttttacatggcagttctattcgagaaagcaaagacagatgctgccaggtctcttaagtcctagactcagaagtcacatgggaacacttccattgcattctcttggccagaccaagtcacaaggccagcctgggctcaaggggaggggaaacagattcttgcttctttttgatgaggagagtggcatgcatacacagggatgggagaaattgctggcaaccagttttgcagacagtctgccaggagcttccaacaggtccaaagtcctttcttccaagccatcccttcccactgaacccatgctggtttgggtacacctctcttaggcttgctgtagagcctccttcagtatagtgaggggaatcatttgagcagtacggaatattgaggactttcagaggagacttggggatatgggctgaggccagagcaagctctaacctttaaggcagcccccaaattgactagggccagaggagcgggggtgagggagagaggcctcctgatagaggatgtttagagctcccccttgtccaaaaagcccctaggaaagaaagctttctggctggtaaagactccagaaaacctgtcacacagcagaacaaagtgttctttaaaaaccctaaagactctccatgtcccagctggtcacttggagcaaacactgctggttagggaacttgtagtgcttagttggcaattaatcacttggagctctgtgatgtccctcatattgtcccgggttgttatttaactctagctgtgtttacgctgccaggcagagtagagcctctaagacagactgcagaccagcctagaacaccctcttcctggtgagagagtctctcctctctctctttctgatcattttaatgttcttctttatattcttctgtatttttccattttttttctataatgactaccttatactttcataacaagagaaaaaggttaggggaatccctgacaaagatgttcattggaatattatttatattaacagaaatt

SEQ ID NO: 6196 - DNA, 1654 bp, artificial
  synthetic oligonucleotide
ctgcccccacctgcccctctcctttgtgactaatggaaaacattggcaaaattgcccacaggcagggaggcaggtaggcaaggtggggagagagttttccctttgtgtgagttaactgcccggagttgcgggcgtcacaccccaccactctgacctcagctgagcttagtgaggcagagaggctagcctagcttaagctgtcactaaacaattcttgggggagatctttcatgcctagtcagttcctcaggaggggagtctgtgtagagaaatccagtgagcagtacccttgttgagggatggtcacattagccagacacatggctctctggtcccggcaacctgagagagattcccagagacccctcgcagttcctcagcacaagctttgcaacaagctttgcaacaccagactccacggaacagcaggtctgcggtgaactggaagagacgctacgaaaacactaatcagccaccgcaactggggggaaaaaaatcagtgagcaactggaaaaaaagcatttttacaaagacagtataatactctttcattttcaaatagctaaatagaatttctgtataattttcaaacagtgtttgtcttaatgactctttgaaagcctcctttttccaatttgactgctactgaataccaagtagatgccatgccctgggtgaagcattttttgtaaggtaaaaatcataataatgactgcctgtgtagtgactttcagcgcttgacacagtgcgtagctaaagcaggaacatggtccctagccacttgtcgacatatctcttttttgtgcactctcctgcctttggattctcagctgctctcccacccatccccagggctggcctaagtcaccgtcaccctgaggacagcaaaacagtatgtgggggaggggcgggagagggagaggagggggaagagagaaaaagggaaggggagaaaggagaggagacagaaaagggcaggggagaggggggaagaaaaaagggagagaatggagaaggggaacaaaatggaaaggggggaagaggagggtggggaaggagaggagaaggggagagggatggaaaagcaggcagaggagaagggaaaagaggaaaggagagaagggggaaagagagaagaggaagggaggggaggggagagaattcttctgggatggaaaaggcaggaagtgaaattcctaacccagtgataaatagaatcccagctgcaccaagaacagagcagtggtaaaatcattcaaactctgaattcctgacagtggaaaataaactcatctttgctggtgaatggaaatttagggaaggcaaccgggtgtgctctggattccacagccccatccctggtagagggcacagaagcattggagggttgagaaagggcaactggcagcctttgggccaagttgctttaagtccagagaggctgagaaaagcagctcaatgctgcagaagagaaggtggaagttggaagtaagaaaatgaaagagccaggtggcccatggtggagaggtgcccagagctggcgacagaacccaaggaaccctggttcctggggtgaccttgagaaaagacccggccagtcttagacaaggtgatgaaaggaaggaagaaggctactgagctgaagagaacaaaa

SEQ ID NO: 6197 - DNA, 1708 bp, artificial
  synthetic oligonucleotide
atccccatcataaaagcttaacataattatgcaggaacaagcgacttccggtctgagtcaagacgaaggcattctaataaggccaggccccccactggaagactaacttggcttccagatcttcctcccccacctagcccacccaaagcctacagggggcccaggactgatctccaaaacaaaagtcccacccacagcagagctgaggggctgtggacagcctgagcaccacccagacagtgtggcccatttatcacccaccatttatggggcttgccatgggccctgaccttgtcttcaaaaagcctccaagccagtgatcatatgcatgaatagttagggaaggaaggtgaagggcagcctaatgcagccttgggagggccaggaaagttctagagtttactagtgggggagtaagaaaggtgtgcctagcaggagatacaatgggtacaaagcaatggtggatcagggaggccaaagtgaatgagcccagtgaaaaggtgcagaggggctggggaggggagcaggcacagtgcaggctccctgggtctgttggcatcaccagcctcagagggagggaccagaactgagacagacactgcctctcttgtgatcatctccttttcagctcatcctccccattccacccccaaaaaaccactccgtcccctgagataggcccggtgtagagtgccctgcataacaggtcatagcctgtggacagttcttccccaaaacctgcctgaagactctaaaggtttctcctctgcatgccagtccccatgttctgctctggtgacaccgcagtgaacggaacaggcttggcccccacgctggtggagcttacattatggcgttggagacagaaactcaacaactaaacatgcaaaagcacctacaattagaagctatggaaagtatgaaggggaatagtcatgaaaacaatggaggaatagaacggggacctgcttcagatggcaggctatagcgacatttcagccaggagctacagctagccagggggagaaaagggagaatagcagatgcagagtggcagaggaagggaaaagtttggagctttgaggagaccaaaaagccagagtagcaggggcaagagagcaaggaggaagggacatgtggcaaggggtgtcttctaaagcacgctgttccacaatgtgactttggcattcttcctccaatgaagagttggggtctatgtccccttcccttgaatccaggtggaagagacaccatgtgactcttttttttttttttttttttttgagacagagtcttgctctgtcacccaggctggagtgcagtggcacaatcttggctcactgcaacttccgcatcccaggttcaagagattctcctgcctcagcctccccgagtagctgggattataggcatgtgccaccatgcctggctaatttttgtatttttagtagagacggggtttcaacatgttggccaagctggtctcgaactcctgacctcaggtgatctggccacctcagcctctcaaagtgctgggattacaggtgtgagccattgtacctggccgactttcaaagctaggtcagaaaggaaaatcagcttggaccttttttgctggaacataggtgcttgggtccctgggccaccactaaagaagtataactgctctgaagctgccatgctgtgaggaagcccaacacacacggag

SEQ ID NO: 6198 - DNA, 1233 bp, artificial
  synthetic oligonucleotide
ggactaggagcccaacttcaagaagcttgtggtctaactgaataaacaaggccatgcagtaaatgacaatagccacctgggtcagggattgatctgttctgccttcttcctcagttggattactcccaaattttacctgcgtatatagccaccttgaacaaagactacatttgccaggctcctttgcagttaggtatggtccaaattctggtcactgggttgtaaaaggagtgtactatcccaggagtgtactatcactcctgggaagtgaggagcacaacagagggcttatgagctcagacactggcatgagactgtctgaattcaaatcttggctcaaacacttcctagctgtgtgatctgcccaagttacttaacctctctgtgccttcctttcctcatttgtaaaatggggctaataatagtagctacttcatagagttacatgagaattaagtgcacttggtttttctttggttttgggggggtttttgcaggggggttgtttggtttgtttttgttttttgggtttttttttttttttttttttgcagggaggggttgttttgttttgcttttgagacaggatttcactctgtcacccaggctgcagtgcagtggcacaatcatagttcactgcagcctccaactcctgggatcaagcaatcctcccacctcaacctcctgagtagctgagactataggcacataccaccacacctagtgaatttgtttaaattttgtgtagaaatggggtctcactatgttgcccagactggtcatgaactcctggcctcaagtgatcctccggcctcagcttcccaaagtgctgggattacagccaccgcacttagcccaagtgtacttgaaacagcaattggcacacagtaaatgatgcatagggatttgctgctatcattattattattattattattattattattattactaaccctgaaaggaggcagcacctcctccttccctttcctccttctcatggcctggagtgaagtcatgatggctggatctgcagcaggcctcttggtccatgaagtgatactgggaaccaaggctacacacggcaggctgggctagccagacaactcttggagaagtggaaaagagaagaggagctcctaagatcagcaggtcaaaagcagagagagaactagatcacgctcatcaacacaatcccagctcagagtctcagctgctcaaaaagggaggtag

SEQ ID NO: 6199 - DNA, 1292 bp, artificial
  synthetic oligonucleotide
tcaggcagagcaatgcaggaagccactggcctgtaagcgaacagcctgccatgacccccagcatgggccagcagggcaccatcagttcctgccacgcttggtcaccatatacaggagctacgctctgctgctccaagatgctaaaggcaactcccaagtttgcccactgtattgcaagaaacacaaagccaagtcaaattagctgagaccaaagcgggaaaaaaaggacaaaaagaagtgggataggattttactgactcttgtaaccaaggagtcaagggagaggaatggcttcaggtatagctggattcagaggctcaagtggatccagagctctgccttcctccatggcttggctctatctgactctgtagacaggcagacctgccaacccaggtagcaccagattcacatcctcccagcttagcagtcccagcacaaaaaaagagcctccctccctattgactgtggcagagatactctgaggaagattttgactggcctgtctagaatcacatgctcatcccttaaccaatcactgctatcagggaaataggacaatttgattggccaggccagagacacatgctgcattcctgtggctacaggaggatgaggcactatgacaccccctctggctacaaggaatgggaaagaggtcctttcaagaagaaaaagggccccacagattagtgacttgctaaaagccatggggttattcagaagcaaaacccaaaccttgacctagctgctttattcccagagacagcctgttatcaatcaagaaacacaggcttgctgcctcaacaaccaggctgcaaatctagctgggtattcttgagcaaaggtcttaacctttccgagcctcagtgttctcatctataaaatgggactattaataccttcccacagggtggttgagatgcttacatgacataaccagtagaaaatgcttggtgtgtatgcccacggcattgctgccgtactccaaaaccacacatcttctcatcttctttttcaagcttccaacatcatcataagccaggaataaaggaaagacatcagtgaagtccttgaaacatttttttttctttttctttttttttttggtacagacagggttttgccatattagccagactagtctcaaactcctggcctcaagtgatccaccgttctcggcctcccacagtgctgtgattacaggcatgagccaccacacctagccctggaaactttcaaatgacatcttaaaggacaaggagaaggttatctattacttcataataaat

SEQ ID NO: 6200 - DNA, 11241 bp, artificial
  synthetic oligonucleotide
agtttatctgagcaccagatccatgtcaggggggatgttttcacggagatgtgttgcaatgttctttattacatgctttttctctccttgcctttttttaacaagactccagtgggaacaccaaatggcctcagaccctaaggaatttgaaaggattatcatgattacttaagcaggggttttctgaaactcccagccaagtgggaaagagaatgaaacttctaaagttatatcccttcagcgattggttagataagtgtggggcctgagcaaacagacaaaccaggagcagcatttctccaattaactctttcaaggcctagaaaacacacactggaagcctttgaaagtccctcggggcactggtactctataatttaccaagacaagccttcattccttaaataaaagttcatgaaccgatcctttcttcatctgtttttatgcctgcccgatcccccaaagcgctacaactccatccatcccaagccatctcattcttccaagcagaaagcagtccctgagggaggaaggcagctgctgcagggctggccagagactgtccaagaagtctcagatctcgtggccatgagaggaatcccatctgcaagtcaccctagtagcggaaccagatggaaggcctggcctggtggcaattctggtctggcctcccaagatggcatcacaggcctcccctgggtctgagaagcacctgtgagaaagcctcaaggcacatacagcgacaggagcctttgctgcagaaagaaaactgcaggagacaaatctccctagttccagagatatcatcccggatcaacatgacaaaggtggaggtggttgctggcttgtgcccaggcacgcaggcatagatagggcagggagccccaatgtcagagcataagagcagggaatctctgctttcaaattcccatcgagtttgcaaaaaaggaagaaaatatcccacaaaaagtgacgcaaatttgtgtaaacccaaggattcaggatccagagtcctggcctgtctgtatctgggggaacccaggttagctcacgggacaggttttatcttaatgagggcagacccaacccctgcagcttgggtttgggcaactaaagagaaatgggtaaaagacaataatataataactgtataaaaagaggtgcttttgaattctggaaacaacccctacaaagtacgaagggcatcaagacaggttggagcaataacttttccaagaattgacgacccccccaccccgagtcttgccaatcctggacccaggaaagaggatggggcgggaggggtcttaatctgccgctctacaggcttcctgcataggcaaccacccaaagtcagtcccagcccgcgcgcagggctccctcctaccctacaacagccccgaggggcctcaagtcccactgcctggaaccccacaagccacccccgcccccgcgccatttccagtcctctgggcgaggggggtcaatgtcgttcaagtaatttctctgcgaacacaagatggcagccttaaataaatgcaaccctgcgcagcttttaatcttacacatcattaaattcctaatttacacattatgttttcgtgggccaacccataactcattagtgttgaactcacgaggtataaagaccaacgcacgacgggcgccggggcgccgtcacctgcctgggttaacagttcctgccgcgggggcagggagaaaggcgctagaggggcgcggggtgccggcggggccgagcccggggcgcgggcgagccctgggtgccaggccctgcgccgcacgccactctcgcagcgctgccgccgggaaagtgccggcgctggctctccctcccctcccgggaatagcgggcgcaggcacgcacatccacacacatccacacacacacacacaccgcacactcacacacccgggtggccgcgcggggctccgagccgcgcaggcctccttggcagacatcttcctgtgggaggatttcaaacgagccgtgaaagccagaaactacacgggttacaaactccggaatccctggccggcctcggcctccctccccacctccggcccggccccctccgttcggcccgtggccaggagccccaccaaaggacaaagctcacacgccgaaagcgcggggagatccgggggcgcagagactgccccgacggcccttctaccttctgaccctgggacccacggccaagtgccgcgcagccgaggtcggccttgctgatctgtggtggcccagggcgacccgaagcgcaccggcttcagggtgcgccctggccagggcgtggggtggagggtcacataagccacctggcatccgagggtggccgcctcgccccctcaacgccgctctccagggaaggaggcggcggggtcaccagggcgcagctgacagccccaggccccggccagggcgcaccctaaagaagagggaggctgctgcctgaactggcctgggggcagagggaagtgggccccgcgctgtggaaggccccaggctggagcgccggggacagctgtccaagcggcgagggctaggagtggcctcgcctagcgctgagccggccaggccctggaggtgctccgcgccttctcggccaaaagccagctccgcgccgctggcggagtgggagggaggcggccaggcgagcgccccgccttcgtcgcccgcggtcacaggggcaattacactcctcgctgcagacggttaccagctcgcccgcgcatccctctctcggctcccctctcctcccctctcctctcctcccctcccctcctccgcggaactgctggctccatattagcgagggtgccctggcagcgcgaccgaggccaactacccctggggaccctcccgaggctccccgcaccctgcacaccctcaagatcgccaaggcgagcccaccgcaccccacagcgcgtcccaagggcaccacagccgaggaagcgacttttgcggtagcgaaagggtggcagtacccagctccacgcgctgcaagactctagcagccgcgcttcaccccaaaactctgcccctagccagcacagctcccctagcgccccaaatcccaggtgtgcctgtttccctggagtcccgccggcgtgctttgctattcgcagctcgacgcctagacctcctgactgcaacctccgaggcctttgcgctcccaggcgtcctttgctgcaagcaaacaggcccccaaccgccccctatggtttgtactcttctggaaggtgtctttggcgctgtgaatgcaaactcaggctttggattaagggcttcattttcaactaactgtgtgatttgaggccagtttcttaacctcagtttctttatctacaaaatgggagggatattcgtataagtgtggctacgaggtttaaagaagatatagttatatgtcaaatgcttagcacaaagtcctggtggttagcattattattaccatatggccagaactgtgaggacattaaaagtgaagtaggctttttcccaccaggggtaagcctcgcggagtcctaggacacatcccacaaaccgaggtgaacctaagccaccggctacgtctgaagggaggacagacgagacgaggggcagccaactgagcgaatcactctgccttccgcctttgcaaatgaatagggctctgtctacagcttccgccattcctacgccagatctgcaacgcctaaggcttaaacttggcgcggcggtaaatttagcccgaaggcagcggctcctaaggggcggggatgtctccttggaagaaggaaagggaacagggtaagaaaatggagttgcctctaggaagaagaatcaggcagaggaaacattcagggccgctggcggaccactgacaaaaagaaatcggacgcaaaagaaacctccccagaagaaactgggccaccgtgggagccgtgcgagacagacttcccatctgggaagggctgcctacgggtaattgggtttgctcgagttgcctctataattaataagtgatttgacttggagattggaaatagtcatgaaaggaagccgcgggcgtaggggtgtgaggcccaggagcctccatccgaaatccaaagaccgcggaggaggacggtttaaggaacaggacgaatgtgataatattggcatctaaccttctagtgtttgagtaattcgttgcttagctactttggataggccattattttgcaaactggaaacatttgcaagtggtgatattttgctcttgcctgacgcaggggctgcaaacctacgccggctctgctgaactcttcgaaatatatatgcataaattgttcctaatgagaccatctgttttttatggcccctctggaagcaggaggaacccgaagcctgctccgtcttgcagaaatctgtggccaggcaggcctgggaaataaataggggagattagaacggtgtgcgtgatttaacaatacgcagaacggcaagttcggtggtcgagatgtgtgcctcgattcccaggggtgcgggtcatttagggtgactccagacatgggggttcctcctaggaggcccagggactttgcggagttccacggcacacacgaacctcgtttttccatatctggaacatcgccagagccacaacgcgaaaccacgagcctgtagctgctctggggacccaaaacaagcacccaggttgtaggtggtccccgacgtcgcccactatctagggcctccttctacggtggtgaagggagctgaacctgggccacagaggcagagaacgagcatcactccaccccatacccgggtcagagcacagagctcattccgggcctatcccaaagactgagctgctccgcgagcgtctggcaggcccagcgccccggcctgagaccgcactgagggtggcagggcaaacacttttcacattaccgcgtggctgttaattggggcagtgcaaaagacgccgcgactacccctttgcggcggcgggggaggggggagcgggtcaggagtgggcagtgggggctgcttataatagaaggactgccctggggagcctcagatatcggtaacccccatgattaattcataactctccactgcgcctggcaccgtctcgggtctttaatcggttctgaatgtcagcgaggcttccccgacagcctgagcactgctttttcaatgtgttgaaagtcgctgcgcgcacaccaggagacaaagttgccatctgctccggggaccaaggcaactgggcgctgggaggggccttcctcccgcggctcccgctgccccgggcggcctcctcttcccggcctgccccaaagccaacactgtcacccggaacgtccccgccccccgccccgggtgcatgcatggtggaaactccggcttgcagcgaaacagagcgctgcgcgcgggcgcgcagggagcctcgcggtcacccagaccgagacctatgctaatgagattataggcccgggttgtttgtgtgcgcggacgtcaaagggggggcgcagataaagtgtggaaaccgggatgacttggaggggggaggggcaggaagccccaggagaacaaagctcctggccgtcggcctccaaagagtcgcagaagtgaccgccactggctcgtgcacaggcggaagcgggggagggcgggggacgccaggcctaaagcgcctcgtgggtttagagaactcagagagggcaccgggtgggggtgggaagaagactcaacccgtagctaaatgtttggcctttggctattttttaaggaaacgaatctcagggaggtcggggcgcgggggatgggggcatcatcgcgcctcggagatgggaagcgagttcccctccgctttctgggaaaagccttgtctcccttctttcccctccccccatcctgctgagggtttgcgttgacccatctctccgctcgggaccggcaggaggacggagccgcaggggctgaccgcggcccagaggctgcccaggggtcgcgctgctgccggcctgcgcttccgcactcccgggttcggtgcgtcgcctctcgcggcagcgcctcgcttcttccagactgtaattccacactcccgcaagcgctggggctgcggaatcgtttgagggagttggaactgcatcagatgagcacgccgggaggtgagatcgggtaggaaatagccgaaactttgagttgtgcgccaccccaccgcccccaacacacacacacaggcacacacacacacacacacacacacacacacacatttaccctcccccttcccagccgcaacctccgccaccctctcgattcttcaaggtttgcagcccagtcctgtcatatggttttgtttctgtgctgctgttttttttcagacacgaaaattggacacgtggagaattagccctgctggagaagcgctgggtgcagactcaaacaatggtttccagcgccgaagctgaggcatcaccttccccacctccaccctcaaatggcagctgcctctatatacagcgggcacaccccttcactacccaccccctcccccaaagcctggttagggacctatgtgggctgcacgctctggagccccttgcccggacacaaaccctaggtgggcctgggctgcccgctgagtagctcattgcgcctgggatcccctgggatttagaagtatagggctctctatttttccctaggaaggtcctgtctcaaagatgccacccccaaaaattaatgtgtaaaaacccaaccaagctccagtctctgtgtcctttggcaaatctatctttcctagggcatactttcctaagctgctgggaccttgccccccatctgatgagccatacgcaggtggtctggcctcttcagagcagcttcctttagttattgtcttctccagaggccccatcctccacggcagccctaatcttagccccccagcctctctgagcccccatcccacccccacactgcgctgagctggcagcagccacagctcccccaggcagttcctctctcactgcgcggcctgtgcatctcgctggggcacacactccgcacagaagctccctcgcctcctggagctggtttcctcttacaggctccccttagagctgctggtgctgtgacaacgcctgcatctctgtgtctccctgcagcgctgcgagctgtgaatctgccttctcttcccttcctgcaaaggtcaagctgcctccttctctcgcagggccgcagttcagttctggcctgcagagcttctacactgcaacttgaatatgggaatggggtgggcatcgtgcaagggagcagtcacactcaagccaggaggcagggacaaaagggtgtgcgattcagggagggaaacactgaggacaaccctcagaaagcagtgcaggatttgcagctaaagactcaaaagagggagagaaaacgaggaaaaggctgttactaggtcgtgagtcctgaagtgtaggcctttctcctcccaccccgtgggttgccctaggggaaggccagaagaggcctcaggtgtctgcactgtgtcctgtgcagttcctagggccatgcacttccggtgaggctgcactttactccaagcaggagtcagaagcatggaattcagtggccgcaggagctcaagtcggctgcagccctttcaaagagggaccccgaagaggcctttctgccaccccagccccagagaggctatgaggctctacaagcagcagagagaatgatacggagaaaaatgagaggaaacgctattaaacttgcttcctctaaagagcgctacccaccgttttctctgaactgtacctaaaaagtcaggagagaactcgttaacttttgtttggtttaacattgccagcttcaagtcaaccgtaggccccccgaaggttttgtaaaatatttaatctagctcagacaatttcctgcagtccctaaccagaccaccccacttactgagccgctgccaaaaaggatgcttgactgcagactggcaaccagaggccttccagtcgcctggctggccttgacctccactcgaggcgccaggaaagacccttcccggaatcccgagagaccaagacctgggtaatcctggaggtctaaacccgtgaggaagcccaagaaatggagttaaagacccttttcgcacaaccgattgttgtctgtgtgaccttctgcggcccttgccctctctgaaccctctaaaatgggcatgaggatgtctcaccttcctctgggtgttatgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggctaccgagaaaacactccgcatcgctctgtgctcagagcgtgagtcagcttcccagccccgggggaacaatggggaccttgccaagggtccccttctgtcgacccctgacggcccccaggcccgtttgggtggcgggagtgccggcaccctgggaccttcgggcccgaggttcgggagggctaagggcgctccaggcgaccagggttggggtccagccccaggattagcgcggccaggaatccctctgcccgcagctgccgcggaggggttgagggttaaacagacaccgggcagaggagcgagcctgccggctgcggccggcgcggcgcggcgcggggagaggacgggagggaagagggcgcacgctacctagcctcccgacgagaagacgtctcctccccacgtcaggccgggctctcgcccactcggctggccgcctctgctccctggcctctcaagtctcagcggaaagaaacgtagcggctgccaaaagcaccccactccttttattgtccccataagcctatacacgtacactagccacccccccaacacacacacacaacacgcacacgtgtgcgggagactcgaggatgccctgcctccatcgctcacagagtgagtaccaaggccgagcgaaacggcacccctttggtggaagacacagtgttgggaccagtggtggcctccgcgctacgtcttctatcgcaacctctgggtttcctttgcagaactgcataccccagagcagaggccatgtggagacctgcggcttggtcccgactggtgcagtggcctctgctctggtgtgggctggcggtttccccgcgcccggtgaccttaagggggtttccggagtcgcgcagccagcccttcctcccagcttctccggccaaggccgctctcggccgcccagcctggtcgggctcggctagtcggctcctcgccccgggcaggagtgcggttggtgaaagcactcggggcctcacccacgctctgtgcacacgcgccccgccggggcgggagccggagccgcgctccaacagcccgaaattgccaaatggtcgctgggcagggttggggatagactttgggaaccgggtttgagctggagaagacgaggaaaacgagtgaaacgggagaggcggggtggggtgacggctcataaatcatccagccccaccctcgggcctcagtgcagaggcgccctagccccacgaggaagaggaggttcacccagccactcctggccgacctctgagctctccgggagccagcgccccaccctaggctcaggccgcgctaggaccagctcccggcccagatcgtaaaccacccgccggaatcggcggaaagccgcccttggacacagcgcgcatccgcccaaggggaagtttatttatagcttgtaaacgtaaaggaaaccagaccgcgctacctcgccgcgctccggctgcttcgctccccacctgcccaccaggagggcgcgacgggtggagggaggtggggtttggttctgtgccccccctcccccgctcccgctccgctgccaggggagaacagggtcctaagaggctggcaagccttacattcctctcgggacgcctatccagtgccatgaaagccggagggggcggaggacagggcccgggcaccggagtggttagggtgggggtggccgagctggcccacttggcacggaagggcaggcaggccaggcgacgcggcgcgagattccacagctcccgctccggaccgggggaaatcctggagtgccagagagcccggggagggggcgctccgggagcctctccttgaaaggcgggatgctttccccgttcctcccgcgcacgtgtcctcagcagagcaggcaagcgctgcgcgcctggggctgcgatcctcgggtgacagcgactgagagcgcgccctctccacccccacccccgccgtcgccgcctctcctggggagctccagtctccagggtgcgctcggggcaggccccaagagccagagaaacggaaaagtgccggggaggcgattaggaagagaagacattaaaaagcccagccctgaaagacaggcagccgagctgaaaaagacgcctgcgaacccccaccccgccgcccctcgcctactgcgcccagacggcccctccttgtcccggctgagcgcacccacccccggcctcggccggggcgaattcgtgtgtgtgtgtgtgtgtgtgtgtgtgtgtgtgtgtgtgtgcgcgcgcgcgcgcgcgctcgagtgccgggagggcagttgcgaaacgggctcttggctgcagcgcggcataatggaggtggctggaacaatgcgcgctttgtgcgcgcggggagttgttttccacccgcctcgccccccttgctcgggccgtatggcactttaatctccgccacgactcggcacaaatgcacttgtgtcctgcgggtcactgggggccgtgcggctggagccgcccccaccccgacccccgcggaacccaccgccggctgccccatcttccttcctgagcaccccccaccaccacctcaattcccggcgtgggccggtgagctggcgtggaagcttccgggcccgccggccacttttattttccgtgaagacggcccctcccccgctccacgagcgcgcgcgcgcacacacacacacacacacacacacacgccgcccgcag

SEQ ID NO: 6201 - DNA, 1326 bp, artificial
  synthetic oligonucleotide
aggagggaaagactgccagtgttttggcgttgcaggcttgtttatctttccgcctttcctccaaggcgaaactcgttttgcaagcaacattcctacagaaaatggcacacgtcataaaaagagaccaatttatagaactggcaccgaagttcatgtctcactccagaagcatctcccagctccccatcggaaacccaactagatgtagaagtccatgttaaaacttagagagtagacttagggaggggaggtgctgagggtgggggggacaggagagaatgaagtagatttgcagatatcctgtaggctgtacacccagagaccaaagtcagccctaaatgatcttccaaaacccaaggaggaccaggcaggtgccagggcttggaaggcttcaaccttgggactcatgggggagaggagtgaatttttacacccagcttgccccaggacggtccagaggcaggtccacattcttggccatcctaagtccacctgcttgggccagccatgaacctccaggactggcctagtgggtaactgccaccaccaactgctctccctcccaccctggcgcctctctgcagggcctggcggggtaccaggaactcaaagaaagcctgttgctgtgggcatctagttgatgaagtcagagtaggtggtgctgtgggcaggcttcaggacggcacctttgcgtgctgcagttgaaggcaaatgtgctcttgaaaacgggaaggcttggaagaaaaggttaagggatgtgggtaatcaaaagccaatctgtcctcccttccccccaaaatacaccccccttagggtactgaacctgcacacttgcatttccaagctggaaacagtgtcgagtgcacagaacacagcacccgcctgtctctaacttgtctgaataacagggccatttcagaggggaacaacggccttcagagcctctgcaatttccagaaagctttcagttaataacacattctttccaacaagcttacttagggctgaaagttattttcacaaatcttaaaaactcagccataaacagctgaggacccagttcaacggatcctggccaaaccccaccaacacggtgacactcacggccccgtgggccttctcccgccacctctgcctcaccacaagttccctaaaccacaacatacaaaccatcctgcaccccaccccaatcctgggaagtcataaagatgtgtgttggggatggagggcgggtgtgccgtggagctttctctcatctggggatgcgctggccagaaactggccgccacctctgcagctcgtccatgggcctgcatagtgcgcgct

SEQ ID NO: 6202 - DNA, 19044 bp, artificial
  synthetic oligonucleotide
tgccccagtttccagctcaacaaagtctgggatttttctctcagaatatcgctatacatctctgtatttgcatacccatgtttacattccccttggccagttctttatctcttatgtatctcttgttccatttgggcaacggagcccaagtgtcttgatttgtctcagcacatgtcattcaagcgcacatcttaatctgagcattcgtactacttccattctttttgctttgcctataatgtggctctttcccaggccagaccaatatgggtttgcagtttaaatgtaaacagaggatcccttaagatcacaaactcttaaagaaaggaagaggagggaggaggagactggaatgttagtaatgagttatttatgtatagggtaacccatccgcccatttcaagctgaagaaagaactagataaatgtctgcagaggtgtattaaaattttagaccaatttaatattagccatatatatacacacacaaacgatggatctcacaacacatcagtgtccagctcctctttggaggctgtctccttgcacatatctaactcctcacaagttcctggttaaaagtatgtctatttatatagagacaactcaaagaccgctttgctctcttcagtgcatacctgtacatgctggcggggcatttcaggctcaggtccttggtctgcagcagtcatagtcagaggccccacccgactacagctatgtgcagaccttcccgtccttgaacacccgcatgaattctctttgggaacattgagtctacgtctgtcttccaaactcagtttttaaagtgagggtgttcattgtgtgtgttcacagctccccgactgagaaatacctggtcaaactagatcatctagcagctgcgtttggtttgtggaagaatcgagcccgatgcaccaagatgtgaccgtgcacacataagagaaaggaaaaccctaggcccagactcacagctcctccccactgcgagctactctgcctccaggaatttccactaggctctttgcccccctttccctattacactaccccaccacggcctttaaagggttaagagaaacccccacggccttccctccacccagctcgctgggcccggaggctagctcgctcactcgcagctcacagagtctgctgccatctccgcgcctcccccccctccagtccttcagccgggagggagcctgcatgcctgtctagaccgatctatcaccggcacaccaacaacacccgcgagagcgcggagaccctgcccaggtcccccggcccgcacggttcacggcggacagaacccggggagcgtgacggtgcctgcggggtgggggtagggggcccacaggcactggccgctccgagcgcaccacgggtcctctccagctccggccccccgcgctcccaccagcccggctgccggggcacagtcacagctccgcgcgctgggcagtcctatttttatcttgtctaatcctaaactgggcggggagcacaggcgtcgtgcttagagaacaagagataggcgcgggaggcggggaggagcagccaggcagcgacgcgagcgggagcgagttaaagacacagtggaggcgaccgcgggcaggaagaaagagcgggctgcgcgggcctcgaggcgccgcacgcaacgcgccgccccgcgaagttacactcgcttccccgccgtccctcgctaccggcccctccccacttcccagcggcgctccccgcagcctggacagcgaggccccggcctgtgtgggaggcggaggccaggacggccctgcaaagggctggagagaatcgctaatgagctgtgcagcccattgatccggagaacacttcctaattaactctcagtcacctactggtgacagcgcctcaaaggacagcgctggggccagccgagccccagccgcgacttgccggccgggcgcctgctgcccaaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgagtcgaaaaagaaagcagacggcaacccgctgccctccccttcctgctcgcgagctaacgccgaacccagcttcccagcttccagcccacctcccccccctccgcccgactcgcggcgctcagcggcgaccgcgctcccgcgcacagacacacacaggctgcaaacttccactctgcgaactccctgctctcctcctggcccaccgggaggcgccaggcccccagccgcgccccctccctccctggtgcccacgcggggccgcttaggttggctgcattttaaataacatagctatgaaataaaaacgaaagcgagccaagcagccaaagggaagcgcgaggcaaaagcttcgcggggtacgctgcgggagggggccccgggagagggggccgactgcagccctcagcgcgcccgcccgcccacccgtccgcggtctcccgggggaaaggtgttccgggcactgacctgaaatccccggtgggggagtaggcagggagcctgcgatccggctctttgaagttttcccccaagcggactcgaggcggcgagaaggagcggggggcggttgggtgggtggagagagatatgaggggtggggggggttggcgacgttaacgagcggagaaggagccgggccggagaagcgcggcgagcagcaaagtttgcggtccccggctgcccgcagcccgctcgcggcgccgcgctcactcgactccctcgccgtctgctggcagccggctgccctcggggtcggccccgccgaggggtgggctctgggccgggtgggggcggggcggggcgggctcggggcctccgggcaggtggcgacagccccgtgcgatcctccgggctcccgcagctggactgggcttggccgagctcagcagctcccgcgctgccgccgccgcccgcgctcgggcaggagccccagcgccatgttgacggttcgccgcgagcgcccgctcgggctgggtgtgtgtgagtgtgtgtgagtgttggccaagtcgtccctgcgcggcgacagcgcggcttgggctctccgcccggcggctcgcgggctccccctccgccgccgccgcccgcctagctcccgctctcggtcgcggtctgggctcctgcgcgtctcccccgcagccgccgagctcggcccgcgttcagcgaggagcgcagctctgcctcaccttgccgctgggagcccaggctccgtctgccgccgcacgccgcgatcccaacgcgtcccccctccctggttccctcctcttcctcctccccctccctccgcccgtcctccctcccgcccgccctacctccctccctcccaacagccgcctcccctccccccgcaggcgcagcgctcgggcgacagccgcccgcccgccgccgcctccagctctcgcaagtttgagctccgccagtctccgctcaccctccgctgcggcgcctccgcggcggggtttcgggaggggtgattccccaggaaaggtttgcccgagtttccccggccgtcatcgatgcacggcccggcacgttttggcctctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacatagttataaaaacagcccttctcaaagcagaagtgaaacatctctaccgtttgaaacccgaaacttcggcagaattaaatcttcatgctccagagctgcttataacaactgatgcaaaagacaggcgagcaagtgcccccgcgagcagtgcccagccaggctgggccgcgaacgcttccaggaccagcgcctgcagaatggaatgcacgcttttttcttcctggtctttctgggggtggatatctctgcaagccaacccacacatttttttaatctccggtaacaagcagaaagacacctggactattatgctgtaaaactattttttataaagacattttaggaccagacattaaaagttattagattgaacgcatgcgagttacagacacagctggagaaaaggcctctggttgtgtgttgtggcaacatttctttttgaagcgactccttttattcaaaacaagtcaaaaataaccgggaaggctgaagctgggtatttgtggggaaactctgaacgtggttccaggcgaggaggccgctctgctgctgcaggctggacgggagaactggcctgggccagtgtggagccgtgccaggctcttccggctcggttaggccgaaccgcagaggccctggcccggcgcccagccaccttctatcccctcccctcgtctccccaactctgcccccaggcacaggcttttctcggagttcgaagtcgcatgtaaacgtccagaacttttagaaaatccaggaaccgagctcggggcctgcagcctctcagagtcttacggcctcccggggctgctgacaaagaggcctgtttgtctaactttaaaagtcctagaattcgggaggctgagccaggagaatcgcttgaacccgggaggcggaggttgcggtgagccgagatcgcgccgttgcactccagcctgggcaacaagagcgaaactccgtctcaaaaaaaaaaaaagaaaagaaaaagaaaaaaaaaagtcctagagttaaaatgaacaggggtggtgggggtgctgtaaatgcgaaggggccgaggggagggctgactgggggagaaatttgatgctggagacaaacaggccagtaaattcgcctttgacgtaatttgcaacatcctcccccaccttttctagggatcttgcctccacggtaggctggtaggattaaagggtttctcctccatctcctagggatacatttttcaactccgtgggatttcaaaaatatcttattaagggagtcctaagaggcatgagtggtgggggggattcgtgactcactgggaattaaaatgtgggattttcccgaggcgctataaggcagagggggggaggggagattacacctattggcccggttagttccaattgttctggggaaaacaagcagaaagctgtcgaagggcaatcccatcttgtgtcctcacttaagaaggggctcagggagctggggatgccgcggggcctgcaatgggtgccggcggtttggcccttctcctgccccctcctctcctgccctcccacaagcccttcgggagctgacccgggggtcaggctgctatacccagcactcagcaaggggaggatttcaatgaaaacagaggaggaggagagagtgagcaaaggagtgcatgggaggggaggccgtgcagcccacggagaaataaagaaataggtgccgaaatgagaggtgctgcggatggagcagcgggggctgcccctccgccaccaatctcccttcccatggaagtgtctcctgattataacaaaccactcgacctcaggctaaccaggccctgcaactgggcaatcgagctggcccttctaggagcaggccttgagcctggctgcccttctcaaggcaggttgactctgcaagacccgctagggcctctcccacacacctccagctccaccctggcctaggggaaaggccaggcatcctgtgtttggggggaccctggccttctaaccttgtgtgcaagatttatttataacgtatactaggatccacatcataaagcttataacgtatgtgtaggcttccgatggtcctcctcggaggctgttctcagggcgatgacacttggtactggaacaggtgggactcggatgagtacagataatgtatttttacataatgtgaggtagcctttctttaaaaacacacccacacttatagtcttctggtcactttgtacaagaactctgggcttatccaatggcactttaaaaaacatccgctgccccatcctccaagcacaaggcacagctggcttcccctctgaaactcaaacgaggtaacaaacaggaggcgcatcctcctcccaggatttcactcatctggaaacatctaaaggtagctgcctcccagggcagaagactgctggacttaagggtcgccaggctgaacatgactgttctttcttcttcctagcctttggagggttattgggtgtttggggaaggaaggccctaagggcagcctctccgtggttcctagcaaccatcttggaatttctggtctgggctcgatttgggtcaggccctgagctccccgaacacaggcacgtgtgggtgaactggcatctacactacgggggcccgcagggtggttgggtgtcgaccaaatgggcataatacaggaggcttctgggaggctggccgcctcttgcgctcggcaagggcttaagagccctcgacgccgccgcgctgggccgggtgctcctgcagataaacccggacgccacgtcccgcctcggctgcttatttagcaaggcgccttctgcgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgtacctctaagacaatcaaccattttcttttcttttcttttttttcttttttcctttttcttttttttttttttttttttttttttttttttttttttttttttttttttttttttttttgagacggagtctcactcttgtcgcccaggctggagtgcaatggcatgatcttggctcactgcaacctccgcctcccgggttcaagtgattctcctgcctcagcctcccaagtagctggaattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgcagcacccaacataggatctcacactgttttaagtcatcgtttcatacctgctaaaatatcaccttcttagaggcttttccttgctgcctccaccctcaccccccataccctttcttgaaaggccccttgttatacttctttgcttgaagcatcacccatctttataatgccccttcttaacctcgcatctcctttgctggttccctatttatctgtttccctgtacacctggacttcttgaaagaggtgtctccatccatgtggaatttctgcaggcttacctcatgttcactctaaaaatcagctagtcatgaagttattttaagacactggaataagtgcagctttgtttataacagcataggattataaacaacctaaagagtcagcagtgacattgatggcacatgcatacaatggaatattctgtagctgttaaaataataaagaagatctgctctgtgtattgatatggaaagacccccaaggtctacagttaaggaaaaaaaaataaggtacagagcagtgtgtaccatctgctacagtttgtgtaaaaacaaaataggggggaatatagacacatatttgtgtgtgcattaaagatttccaacactgcaggggagtgcccccttcccccccagtttctctgtagatatgcatgtcctctggtctactttcagaaatgggaacacactgcacaatctgttctgtacctcacctatgaaacttatcaatatatcttacttttctagcaacacatggagacaggccttgtcaatttccaggctggtggaatttcactgtatagacacatggtcatttatctcactcctcaacccctccatcctccctggccattctgcagaaagtgctcaagatcactggttacttccttgttgccaggagtgggggccggggtgggggggcggcgttgtttttcagtccttgccttccttggcctcccagaagcatttaccacaccatgaccac

SEQ ID NO: 6203 - DNA, 16680 bp, artificial
  synthetic oligonucleotide
gcagccaacactgtctggagctacagcagacctccctcctgctctgtggtgacataggccctgttcaggtatgtgtgggctatggatttttttcccgatttccatttctccttgatttcagcacccaagtgaacatgcactccaaggctctgctgagggtaaacagaaagcaccatcgcaggggtccttcctcctctctctcggaagattcactttctcttcctaggtaatgactgctttttcctcccagcttcctctcagcctacgtatatttagtgcacgttgccctggatagagtttaattaggcaccaatgcacccaggggcaaaaaccaaggacccctctcgggttgagcaaatggggccagcctcccctggctggtaaatgacgagctgagctgccggcaggtagaggaggttgtccattctcagctaatgatcgccttaggcgccaagtgatggaaaatccagaaggactggcgagctgcagggggcagccagggacaattgtatggaccagtttaacatggcttccggagggatggcagcaggaatgctgtgtgtctgtgtgtgtgtgtgtgtgtctgtgtgtgtttcctggtctcctttctctcccctccctgccgcctttccctctctcttgctttcgattttctcttctgtttctagcccacacgagttgaaattagaaaggtctttgaattcatttatttgttttaataaaagcagcatttttaagcagcatatttgtagcaattgattgttaaactaaacaccaagccaactaaatgtgttagggggaaatgaaaagtcagtttacaagaaacataattaacacgtcctttgacttctcctaagcctttgtctggctagggacaagacagaggaaccataatcaactttaataaaacgaaagatggtatcaaggccaaaggggaacaaaaaactttggagtaggaaacaaaagccaaagaggggattcttaagttataacaaatatgttaaaaaacaaatcttttggccaggcgtggtggctcacgccggtaatcccagcactttgggaggccgaggcgggtggatcacgaggtcaggagtttgagaccagcctggccaatgtggtgaaaccccgtctctactaaaaatacaaaaaattagccgggcctggtggcgcgtgcctggtaatcccagctactcgggaggctgacacaggagaatcgcttgaacccaggaggcagaggttgcagtgagtcgagatcgggccattgcactccagcctgggcaaaagagcaagactccgtcctgagaaacaacaacaaatcttttgtttcctaatttttggtcatcagccattttctccttaccaataggaaggctccggtttgaactctacctgttcatggggacagatgctgagacctggaggggaagagggaaggtggtacaaggaacctgcaggagactgcagtatcaggtggcagtatcaggaggctgataaatccaggctaatggaaattactattgcacaacaccagagtcttcacgtggcctgactttcaataaactgttcccctcctcactccttggagaaagtgaaataagacattagactttcagtaatctcatatggtgatgatcaatcgaaacctggagaagaaggccaatttatagaaattgtatctgcttcactgggtggctggaaccagggagctgaaaagaaaacggtgctcgcctttgatgtgtgaagttgccccaaaatgacaaacgccaaaaaacactggctatacatgtggggtattcaaagggagagggtactcaggagaggcctttgttaggtggatcattgcggggacctgaccaaagacacatgcacatgttcaggccacataaaagcgatttatttttcttatcttttggctattttaagttggagtttccatctttcttatttgttttatcaccaatgaagtttatttactgaattaacttttaacggaccctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggcagcgatcagcagctctgcacgcgcttcagtgcatgaatggattgcggaagatgcctgcgtccgctccgctcaggaggctctaggagcgccccctccccgcccgccgcgcccgcccccgtggcctccctaggccctgcgggcgcctcggggttcgcaagctgggccctgcggcgcgatcactctcacccagaacccccgccgccgttcccagggccttggcacctcgccaccgagtgtcattgggggctgaaatttgacacaagccttcctggcctccccgacgcagacaccgctgtcagccccctcctttcttcgcgcccctagcccctggcggcaagtttactttcaaggagttggaccgtgtttccgccgcaaaggccggcggcgtgcgggcccgggaggagggggcgggctcggaacgtttccttcacctgctcggccgcctggggtgtttgtaggtccccgctggcccccagccctagcgtccatacgcggcgctccccagcttttggcggctaatccaccgagagtccctgcgatccgcacatgcacgtgcactctggataccctcgtcccagcccacatcagcggcaaaatcatgtacccaaattctctttcttggcggcttacagtcttgaaagttgggagagcgccacagacctcgaagtctgccgcagaaatgttccccgtcaactctgcaaagtaggtctcattaaaacaaaacaaaacaaaaaaaccctccagtttcggcctagggctgagagaagcgggaaacgcaagtgaaggataccccaatccctcgagtttgttttggtggagctaaaccagaaacccggggatatttctgtttgggggaccgccaagcccgggatgcgtctgcctaaggcgaggtggggagaaggagagcgcaagaagtggacactcgcagcgatccaaaggcaaagccaagtaccccgcgggaagaggccgagctgacccaggttgcaggaagaccgccacatgtgcgcaaagacgcactcggagaggcagagcgcgacccgccgacctaggagactggcgaggacaggcgagaagctgacagcaagacaaagcgggagtagagagccagggaggctcggtcgaagacccgaaaacgaaggcagcagcagccgcccgagtcccgaagcggaggcgtgcgcagccaggcccagcctggcatagccccattctcacgcctaaggacgcggacacagactcttggcatgacttcctgccagagctggtctctgtagggcttgggcctacagttggctgaggccttcccagcagacagtggggtccccaggggaggtcttcaagaatccgggcccctctggtttccgccccctccttgagcccaggacaaaggtagcgggtttgaggagctcggactgttctcagggcgtctacaaggccatcagagagctggtgcctccactctcagggcctcgggcaactttttatctgacttggcggcgctggagggctgccactttccaccgcatttccatttggccttcgcaattgcaataccctgaaggcactgcccacaccctagccttccagcaatcgggattcaagctggacttcccataaccagcaacagtgtaacgtgaagacactcctagactcaggtttccctcaacccttctcccgcttgtccgcacacggggcggatcaacgccccccacccacggccccacccccgcgggctccgcaacccagggccgcagctaccgagtgtgcttctcctccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaacatgtattactctcttctttatcaaaacatagaaatataccttaccctaaacagaaacaaggttctcacagactgatggggtaggagtgaaggagaataaacatctttgagaggattcagtttttttccactacggaaagggaagagaaactgacagtgggaaacacacttaggttatctgattggaaaggcctgggggattttagatgccaaaaactgtgtgaacttgacctagtgaaatgtcatcttagacaccaaattataataataattttatggattcatttttatcatagtttaaatcaataaggattgagttggaaatcttgctctagttataaatagatggagagaacacctcaggaaaactccaaagtagtaatttgggtaaaagttagaagcggaggaaagaggtggaaaatgacagttaatgagcctgtggcctccactctttgttacctaacagttgtcagagaaccatcaaagggagggaacaggcgcccttctcagaaccatcacaggaaaagcagacattctctggctgctgcagatccccccggtggtggttcctacacccagcctcctgggagtttgcctatgtgtatttatgtgtttccgggctggggagtgtagctactttcacaagattgggccctgagcctgtgaaacccactagcgaaagttctaccacgaggaaaagccattctaaggcaatgctggagaccaggaactgctctgccatcatcaacaatatcttcatgattcctgcactagcaaactgcttcacatcttcccacctcaaccatggggccgagctctgggcctcttacagatccatacaggcgggaccttttgcagctagcacagatgtgtggttaaggcatgagacagctggccaaggggaaaggaggctaaggctggggatggctgggaaggaccaaggcccaggagggcctcctggtacaagcatagaactgacccagcatgggggagttgtacctccagaacccactaagggtggcacttcccccctggacccaccaggtactccaaaccaagaggaaaagcatccttgtggcatgtgggtggattaggcccaaggcgcaggtgagctctgctgcagaaggaacctacacaccaagtcccaaatgcccaagtgctgacagggattggggcaagcaggagggaggggggatctttctgcctcccatcacctcacccttctgtaatgttttcctggaatgaacagaagtcgccagcagagttgttcctggagcccctccctccgggactgtcactacctcctggtgtaagacagggaggaccatggccttctgccgggaggatcctctggctagtacccgagccttggattctggcacgaagcctcacagttccgataaggctttacctcccttcccacgtctcgaagaaaaacaccccctggaactgctggggtgaactcggagcctgaggccagggtcagcggggggacgggtccccaccaccaccaagttgccggcagaggtaacagctgtggaagggggaggggagcgacaggcagccacgactgaacggttgcgatctagaaaattcaacaagaggccgcagcggtggcggcggcggcggctccaattagctgagccaactggggaggcagagagcgagacggcggccccgccgatcgtgtcccgggcgagcaggcaggcgggggcgcggggcctcgagctgccccggcggccctcgctcggcccctcccgtgggttctcggagcgcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgactgcattaaggagctcccgagacagaatgaggaagggaaaagccgagagggcgggaggagacagggagacttccgcgggaggccgatggtcaaagtggggggtgaaaccgctcagggtgaccgggctggagacccaggaacccgattcggcgcgaaggtgccgcgcgagttccagcgagcagcctgcccggccaagtggcgcctgcccagccgtcggccgtgccagcttcctgccctgcccaggaccgcggagcagtcggggacgccgccgcaggctggcccggaatcgcaggacagcggcggggggagggggtagccaggccgcaagtaaactcgcactagagctttctgcacacctccgccctagagagggggcccggacccccggtctgtgaggcgtcggctttggccttccaaccttggggtgcgcgaggaagcaaagacccagggggcacccccaccctcgcccaaggcccgagggtgggggacagctgaaatgtctttggtcttgtttgatgaccgcttggcggatctgctcccatccgggttctgccgttccgagagtgccgggtcagtgatacccaggccggtctgagcaggcatgtggatgagcaaaagcaaatctgtcgctcctccgaccgccacccctcacttaacctttcctgcatccaaggaaggggagggcacccagactctgccccaccccccgcggggcgctccctctgcctcggaagctgagactaagagcgagggttttccccctttcccctgggctcgctgggtttctaacttcctctaaacctccctcctcgctccgaaaagccccgaggagaggagctgagaggaagcacgccgctagtgtgcaaaatgaagaccatgtgtgaggacggcggcatcagagtgcagccgcgggggttagggggtggcaaaggcccccgcgcggccggaggctcggggccgcagcagccagtgcctctgctctgcgttggggactcggagccgcagcgagaggcagtggagaggcagggctggcctcgtggcgggaggcgaggagggggtgcgagggctgccgcgccgtggggggcagggggcggggacgcagccccggcttcctgggccgcagctgcgaccgagggcgcaagagcagatcgtgctctgcggcggtggcggctcgggcccgccgctctagcagctgagaatcaacaaagggaggcggcgggggaggggcgccaccgagcgttcgctggctgctctggaataataaaaaataattaataatgataataagagaaaaatcccccggctttcatggctctgggtttccgtgtggctgcagcgggaagcgcgctgtccttgaggcggcctctctcgcctggcctgcccgcccctccccctcctcgccccctcccctccccaggaaccgggaagagaaaggtctgcagctgacaaatattatccattctccccatcgatcgcggagtgtacagatgtgagcgcttgatgtgcccgcggagcggcggatcctccctgctcgctcgctctcgcccaggctccgctcgccgtccccctcctccccctttgttctcctcccctttccctctctttaaatagatttcagggcgctgcctgttggagagcagctggcgatctctcccgagagagggagcgagcgaagcccgaggtgccctgtcaccagcctcccctcccccacctcggcttttctctacgtcccccccaccccacctttctccagtttccaaaatagaaaacaccgggaacacccacgtccactgcaccgcgagcccctgggagcctttggacccctcgtgctgttccttgtgtctgtgtctgtgcagaggaagggcagtgcagggaggggacccagggccgcggcagaagagccaagggtccggatctttccctggcagcagcagggacgcagcgtgggtcacgctaacagggtacagtttacccattagggaaagtcggcggagacggccctgttattcctcttttgcagatggcagattaatccggcagcacccggcctcaaagggaccggctgctcggcaaagggttaacccgtcggccggtaatcgtggacacgcgcgcacacacacacacgcacgcgcgcgcgcgtcctctccgcctgcccgagcgcccgccgcggcccgcagtgcgcccggggctgggggagtagctgcgggaggggagggggtcgggggaggggcggggcgggcttaaccaggccgctcgactgagccggggccacctcgccgtctgtcacttaaatgattgtcctccgctccgctcagtgcggtcagtacgggctgttaacaggcagttgcaatcagtttccgaaaggtcagccaaggtcctccggctctcgcagacggaaggcattacgaaaccgcttttgtatctgcaggcactttagaaaaagaggcgagaaggggcgcaccgcagtgccgcggctgctgcgaccgggggagagggtcgggggctgcggagcagaggagtccgcacccccgcggccagggtcaggcggcgtggatatcacccgcggagtgacccagggcctccgggtttcggtggggaagcaggaagggggtggggagcaggcggcaagggaaggaggagtgggaggaagtgggagaggcgtcctggctcctctcctcacccagccaacagcccacacccggacccagacgggagcgggcggccttggacgcgaggagaccccactcggactctcaggccctcctggcgcctggaagtagggagggggtgtgggggggggaaagaccctcgccgagcgagcgagtcccagcgcggtgtctgaagacgctgctgccgccgccgctagaagtcgtccatcagcaaccagtccaacctgccagtgataatgtgcgatcaacaccaaatcacccccgccaggcgcgatccatcatcgcagcgcgccgcgggcccgcgtgaggctgactcgcggctggggtggggagggggggcgcgcggagcaggaggcggtcgcccagcacacccggactctccgcgcacctcgctgcccctcctggaggcctgcacccaggcgctcataactctccaagttccccagctacagagcgaaaacccagtggctccgagttctgggcacagctcacttaggaatccgcgcgtcctccgcgccctgctgtcgtggtcacaccctgcaaagccattccagcctcggagctgccctgcccatcccctccccctcctccgagaaaccgtggctggcaggaaattaatatttaatatcgtgaaattgattaaagggctggaagccggcgatgggttggggggaagggtagggactcctagcgtaattaaagatctgagagtcgtggtcgttccttgtcggccctggccgcacgtggcctttgtgaagccgaggcggggtcggactgggctgagcctggcgagccggggtcaggagcccgtgcagcttaggctctggcccgcgcggccgggttttttcggggcgggggtagggctggggcggcacagcagcggcaggggatgaggaggtgaccttagggcacccggggctgcgcgcagagccactcttcccctgcccgcctgcaccgtgggccactggagcccgagggtcgggtgctacaactgctgtcttgcttgtacagcacagaagcgcctttactgaccaggtggcctcgagggcgcaccgcctaccccccaggccccctttcagcagcctcactctgggccccgcttcgaggcgcctccccaacccctgacaggagtcttctgagccccccacgcagcccttcgggaggggagtcaggttcacctttccccctgcaacttggaaatcctagggcttaggcgccccggggccccccgccggttctctcctgtccaggccccagcctggtacgctcacgcctggggcagcttaactcgttcagctgcgctgcagatggggcctgctgctcgaagccgctgtctccagggagtcgtcaccgaaccagctcggccagccgcctgtcgtgccgtttaaggttaccgcgcttcccgcgaggggcatcgggactggaccgggcaggaggtgggtgcagctgaggctccctggccacccgagctaacgctaggagaggaattcggtgtgcaaaaggtcagcggtaacccattggccctggctacagtttagaagtcgaatggttggcttggtggtggggtgaccccagctcacggaggcctggctccaaagggctgatgtgaactttttcttgtatctgattttttagtgaagcactctgaaaagtaccaagtgtgcagaggggagaaaacacaaaacacatcaagctgcgtccttggccctaatcaggggagcaggaaggccctccagactccaggccctccagactccaggcccgctgtggggaaggtcaggaccacagaggattaggcccagtcttgggtttattgctgtacttgaacaaagtgccgggggctgcctaaactggagcaagagagaggtaattaagagggcctgcagaaggaagtaaaggctggtgtggctgctgcccagggtaggtggaggaagtgttttccataagaataacaagccggtgcaaatgttatgcagaaagactatttcaccaaaacaaaaccaaaaagttcacattctgcctctcaagctgagctgataaacaacatgcaaactttggttggaaccttgaaccagtgggaggtgtcaacccagtttacaaagggtaatggggaaccgtttctgggtacttctctgtttctaccattgtgattctacctgcattagctgctccctttgggggcccttctgacctcccaacctgagcccagcgggagatcactcagaatgcaccgcattcatcaatgccatttctggtaaattggacctcaggttttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggctaacagtcattacttctgaaaagttgttgtttaggaaaaatgatgaaagtttatttcaaccaagcaaaatatcaaatatcagaaactctggattaatttctcagctcttgacattagctgggtgggacagacacaatttcccaccaaaacacaataccccatttgaaatcagtaaaaactcccaccgcatttcataaaag

SEQ ID NO: 6204 - DNA, 2108 bp, artificial
  synthetic oligonucleotide
atgtaaaaggaggttcaaaatattaggttgcttttgggttccctttatctcgaacattgttgcgtagatttgagaaagggctgatttctactttgttttctaatcagcaagtcactggtttttctacctaagagagactgaacattaaccacagtgaagcagaagggttgagccgcatttacaaagtgccttcacattttggtcctcagaaacccatccgagggggacagagtaggtgttactgttctgattttacacatgaagagactggccactcgcccccacaaatttctggaagctagtcttcctcactgaactggagccagaagccatgtgaagccagcctgctcctgcctacaccctccttcctccaggtcaatgtcatttagaatatattgcatccttttcttggatctgtctgctaggacccgggccaccctcctgctggaggcaaccccgacagcccatattttaagcagctcttttcacagcctgcaaacctcacggattgtctcttacaactgtctgtttactcacttccctccacccagtcaattccgactccaggcccgggaggacaattttaaagtgtttctgcagacagaccctctggccgcgccggaagtgttttatggacctgtgagccgagttaatcccaggaggcgcggctggattagtcccgggtatgggtgggggattcatgtgtttaggtttaatccccatggggggggggcgtaaggagaatgggggtcgggtggcttcagcaatgtgtgccccctccccattaaactccgagatttgcgctagagcggatggaaaccgaggcacgcagccctcgaccccggccaggcgtggagtaggggagcagggggtgccccgcgtgggcgcaccctaagaaaccagtgcggacatggcgagcgagaccagagcgcagttgtgtgtggtttttccccaggtttttattcttccagccctgtggaaaggaggagagccgcaacccggagagggagccggaaagaaacacttaatcaccggcgtctcgctgctcgtcacgcgaagatggcagcggctcccctgggtttcaaggttccgggaaaggcgtgtgttctgccttaaggcgcgcgggctgatgcgctctctccctcggctcggcggccggctccggctcacagagcctctctcaacgccggcaagtgcagccgggccgcccagcccccaggccagcctggccccctctgggcctggggttggcgagggcagctgggcgtctgcgctgcccagcccagccgcggatccatggggtttcgcgagctgaaagtaaaggcttgagggagtggggacacccacaccgacccgcggcacgcaggggagtcaagctgcggccaatgcaagacgagcagggtagactactactagcggtggccggaggctcagccaccttcgcgggagaggggatttaccgccaccctcatccacgcgcaggccccaccgcccggtcctctcctctgatccccgggccattgcgaaacacggagcgaacaggtcctcgccagcagccgtcatttcccgggaagatgggaacccacaagcctgactgtgcttcctaaggatactagcgtgcgcgcagaccttggggggaaagagggcagcgcggtctccccgacccggactcttccctggcgcagcacacaaccgccacgggcttccgaagcgcccgagcggggaggaggaaggaaaagcggaggcccgggaggcgggctgcgcgcttggaagccgtgtgtgtttatgtgtctgcgcgcgcgccctggccggacgggtgttgaggggagagtgatcgtgagcaacccggaaccagcagtcccaacctggactgacgaactgggctctccagtcctgggccgtggggctccatgcctcgggctggcgggacaagcggcggggagcccggagcttcggagccgccgccgggcatctagccagctccgcgggagaagcccgggggcgcgtcgggagccaggggactggtgtgaactagccgcccccgcaggcggacgtttagctccggcacccgggagcactgacactgggcgataaggagttcctcggca

SEQ ID NO: 6205 - DNA, 2356 bp, artificial
  synthetic oligonucleotide
ttctagcccgagaaggggcaggcggccctcatggcgcctccttcggcggtttcctggcgaagcgcccatcctccccaagcaccaggaacggaggccgtccatattaatactcgcgggcagcctgttctgacctatactgtcattttttccatcggtcgggatcgggctgggggtggggtggggcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccggaagagccgcccttactcgactggggtgaggggcgggaaactttgcaagaagactgttccgcgccttccccgcgtggcacctcagaagaacgtgggtgggtttcccgtccgaggccagaccacgctaccctacttttccaggtttcggacctgaacctcgtggactacgggagggagagtacatttcgggccactgcggggggcggagggacaccaaagacaggcgtcttcaagggttctggcagatggccaagtttgtgtcctttccctcccacgctagagtagcgcacgccactttggggaagcgtgagaccgttcaccaccggccacgaggccaccaatgtcttccaggtggggccgatggtttgtctgcagcactcccttccgccttgcggtcctcgcctggctcccacagtcctggggagcccccagagctagcccgcgtcttccctcgcccgctcttccgggggaaagggaggctgtttgtgtggtgtgtagccccgctccggcttgcacccccgcgagccacctcgcagccctccccggcctcggcctcacggatcccctcccggagtagccccgcgggcccccccgccatgcgtaatggggcgcccctgggacgcaggcggggatggcggttccggtcgttccgggatttgcgtgcaagaagaaaacaaggccggcgactacaagagcggcgactccattcttggggttcagacgccctcgcagcctccgcgtcggttccgctctcgccccgggagcccgcttccgtgtccctgcccccgccccccaacgattcctcgtccggcccgtgccgcaccacgcggagctccgcgcgccctggctcccacaccggtccctccataactcgcgctcctccctcgctccgggctcggggagccgctcgctcccagcgcccagagtcagccggttccaccttcggctgcgagagccgccgccccgcgccacccccgcccggcccggcccttgtcccagcccggctcccccgccagctgcgccgccaccgccgcacgtgacccgcccccgtcgcggcttccgctgagctgcctgttccggggcacaaacaatttttgctctgacgcggggtctctcgggggccctggcgtcctctactccctgctccccaccccaccccaccccctaccttccgggtaggagaactcaaaacaactcgctgaccttcgggccgaccagctccgtcttccactgactccagcattccgttcaaacccagcagccacggcttctaagatttcactccgctctgggctgggggggagggggcgagttctccgggagggggtgtctcagatcgaaagagccacttcacgctctttctcctcctccgaggtgagtttttagactatttggaggccttggggaaacgcgagcagccgcgtgcaaaggagcccccccgccttctccccgcacatgcagccttgtctagtgtgacccgatttccagggtcagcagcagagggcctggccagcttcggaaataccaccaagcggtggactgt

SEQ ID NO: 6206 - DNA, 2499 bp, artificial
  synthetic oligonucleotide
ccagttgttttacatacagttgttggggcaggaaacaacctgaaagaattcagattgagtgggtcgcctgctttcaaaggctcatcaggtccttgtacttattcagggggagttctgcctccctgcctaccattagagcaatgactggcaccacaggcatggcacaggcagctgggaaaggtgacaggcttcctggtgtgagcccagaaggtcagctgccagagatcctcccccgtctgtgactgtgctccaccatgatcgttactagttcgtgttgaagtgcactgtttaggctgggcgtggtagctcatgcctgtaatcccagtactttgggaggccgaggtgggtggatcacttgaggtcaggagttccagaccagcctggccaacatggtgaaaccccgtctctactaaaaatacaaaaattagctgggtgcgatggctcacacctataatcccagcactttaggaggcagaggcaggcagattacttgaggccaagagttcgagaccagcctggccaacatggtgaaaccctgtctatactaaaaatacaaaaattagcaggggtggtgtcatgcgcctgtagtcccagctactcagaaggctgaggcaagagaattgcttgaacccggcaggcggaggttgcagggattgcgccactgtactccagcctgggcaacagagcgagactccgtccccgccccccccaaaaaaatttagctgggcgtggtggcgtgcacctctaatctcagctacttgggaggctgaggcaggagaatcgcttaaactcgggaagcggaagttgcagtgagcagagatggtgccactgcactccagcctgggtgacaaagcaagactctgtctcaaaaaaaaaaaaaaaaaagcacgttgtttaattcctgactcctcccccagttaatctccacttgatatttacaaaaccttcccttcccctcccatgaagaacaggctgacaaaggatcttgctttctgtggtgaagaatgttctcatggccatggcattggccgcctgagttaagagtttcgagagaaaacaactgagaggatgtaaattgtacagggacaggttgcttggggagaagttcaaaagacaaggctgggcttggaggactgggccacccgtgcagaagggcgctgggtgccgtgaaaggagaggaacagaactggagaaagggtgtgaaagtaaaggggggatcttggaaagccccccccaccctgttcagtggacagaatgcttctctcccctcatagatccaactccctcatcttcccatctcaccctcttgctgtcattcgattttctgccacaaaatggggaccctctgtggagtgaggaaccaggcaggtggcccagggggccgccaagctgggtggaagctggtctggggttggctgccagaacaatccaggctccactccagcccatcagggggcttgaggctgggtgggtgagataaactgtttcagtggttttcaggagccctaatcaattgcgaggcagagcaaagccctctgcggacagataaagccagtcctgcgtcggtgcccagttggagtttgtgtggtttgaacttttgtgtggtttggacaagttcgccgggttttgctggggcggtttattctgtttccaaactgcagtagagggaggcaaacggcccttggaccctacaagccactcctgaaatacgataggtggcctgtcctctctcccgcatggtcccaaaggctcagggaagagaggcagggcaggtgcgggccataccccgccctcctggttcccgccggtggctccgggtgtagacatttctagaaacgctcccctgcccaaggctggctagaccttcgcgttggggagctgagctgctgcaggtttgattgtcttcccctgcttccaaactagaaagacgaatgcccactttcggattccatcttctgccgcggacgcatccgggacgcgcagccgcccggcgcagaggaagcccgggacgctggggacaccgcctggagcctccgcgcatagcaccggggcgttttttccttccagctggaggcttcccatttaacctctaaggtgccagaagatccggatccctcgcgggcaggcctttggctggctccgggctaggctgggaccccagatcccagtgccgctggcgagcactcggcgtgcagatgtctggggggctgtgcgcgggagaggaagtctgcccaacgaggtggacggacactgggcccgcggggacccatctgacaacgcccggtccccagggaagcctgtgcgagcctgcgggggaccagggcaaaatagaatcaggaacatgtgttgtttgggagggaagctggggcgcatggcatgtctcaatagtgctggcaccctccagggaccttcctgcttccacagaaggtggggacggggaggcgagcatggagagagagaaagggaagtgggaagaaattggtcacggaggaagctatt

SEQ ID NO: 6207 - DNA, 1372 bp, artificial
  synthetic oligonucleotide
caagccaggtactcctgtgcgaaactgctatggctgaattctgtccccctcccaaattcatgtgttgaagtcctaaatgccaggacctcagaatgtcatcttatttgggaacagggtccttaagcaggtaattaagttaaaatgaagtcgttaggttgggccctaatccaatgtgactggtgtccttttaagaagagattaggacacagacatgcacagagagaagaccatgtgaagacgcaaggaaaagacagccatctacaagccaagaagagaggcctcagaaggaaccaaccctgctgacaccttgatcttgaacttccaatctccagagctgtgggaaaatacatttatgttgttaaagaccccagttgtgtggtgctttgttatgctggccctcgcagactaagacagtgaatacgacccctttcctttgggggagacagtgtaaaacacaggcttctgagttatcccacctgagaggtaaggaggctagggtgtttatccaccaatttgtatcagccatttcctgggggttgttctcagggggcattaactcccacacttacagcctgccgcaggggcaggcaaagtggtttggcaaccggtggaagcccccagatgaagaaatgcagggatggccactgggaagctgagcctgaatgcactcagaagttaagagcaaggggatttgtaagaggcaatgatgatggcatctgctacacagacctatgaaacagtgatggactgtcttaggtacccgcccagagggtaaggtgctgtagacttttacctctaacccgaaggaatatgcatgtgtgcggtgtgtctattactagggagattttgtctagatagaatacagacgtttctattggatgatcctgtgtaatgttgtataaccctataataaatgttatttgcaaaggttacctctggttagtttccatgccaaagctggtgaattcaagggaacatgtactagggttcactgtggtcttggaccccagtaactttgctggtttcgctagtgaggcctagagcagttcactgcctcttgctaattttagacttgtgtactgggcacagctaagatgagggtgctttcagttaggtttcttggtttcaagcagccgaaaccaacaatagctgacttcgataggaaagggatttctggaagactgtgttcacagacctgagggaaggtaacaggactcacagccaagaacactcgggtggaggagtacatggggggaggggactttttagcatagtatctgtaggacactgtcactactctggaccctggaggttgccaccatggtgacattgtccctgcttctttatgatgttcagtgttagtggggatgga

SEQ ID NO: 6208 - DNA, 2723 bp, artificial
  synthetic oligonucleotide
aaggtaaccaaaaggccaagtttgcccaggactgatgggtttcctgggactagagactttcgatgctaaagttgagaccataccagacaaaagaccatttcgtctccctagctgcagcttacgcctgagttgctcccctctctctccctctttcccttcttcttcagtgtttttgtttgtttgtttgtttttgagacaggtgacagactcgctctgtcggccaggctggagtgcagtggcgccatctcagtttactacaacctccaccgcctgtgttcaagcagttctccttgtctctgcctcccaagtaactgggactataggcacctgccaccacgccctggtaatttttgtatttttagtagagatgggattttgctatgttggccaggcaggtctcgaactcctggcctcaagtgatccacccacctcagcctctcaaagtgctgggattacaggcgtgagccaccgcccccagcctttcagtgtttttgcttctcatttcaggcatggcatttcttttacctccactgcctccttgggggccacgaatacttcctgggtaccttctgggaacccagcaccctggttggaacagactagaagttgcagcaagagtttgggaagggcatttcttttttaaaaaaaattttggggctggcacggtggctcacgcctgtaatctcagcctttgggaggcagaggtgggtggatcgcctgaggtcagtagttcgagaccagcctggccaacatggtgaaatcccatctctactaaaaatgcaaaaattagccaggcgtggtggtgggtgcctgtaatcccagctacttgtgagactgaggtgggagaattgcttgaacctgggaggcagaggctgtactgagccgagattgtgccactgcactccagcctgggcgacagagcgagactccatctaaaaaaaaaaaaaaaattaactcctgttttagattcaaggggtacatgtgcaggtttgttacatgaatatattgcaggatgttgaggtttggggcatgattgatcctatcactcagggtggtgagcatagtactcaatgggtagtttttcagtccttttctctcttcctcccttctgccctgatgtctatcgttctcttctttatgtccatgtgtacccaatgcttagcttccacttataagtgagaacatgtagtatttagttttctctttctgcgttaattcacttaggataatggcctccagatgcatccaggttgctgcaaaggacatgatttcattcttttttatggctgcataatattccatggtgtatatttaccacattttctttatctagtccaccattgatgggcacctaggttgattccatgtctttactattatagatagtactgtgatgaatatacaagtgtatgtgtctttttggtagaatgatttattttcctttgaatatatacccagtaataagatttctgggttgaatggtaattctatttttagatctttgagaaatctccaaactgctttccacagtggtcgaactaatttacattcccaccaacagtgtataaacattctcttttctccacagcctcaccaatatctgttattttttgactttttgactttttaataatagccattctgactggtgtgagatgatactaattgtggttttgatttgtatttctctgatgcttagtgatgtggagcattttttcatatgtttgttggttacttgtatgtcttcttttgagaagtatctgctcatgttctttgcccacttttttaaaatggagttttgttttttgcttgttgaattgtttaagttccttataaattctggatattagacctgtcagatgcatagtttgcaaatattttctcccattttgtagcttgtctgtttactctgttgatagtttattttgccgtgcagaagctttgtaatttaattaggtctcacttgtcaatttttgcttttgttgcaattgcttttgagggcttagttataaattcttttccaaggccgatgtccaaaagggtattgcctagattttcttctaggatttttatagtttaaggttttacatttaagtctttaatccatcttgagttaatttttgtatatggtgataggtagggattcagttttaatcttctgcatatagctagccagtaatcccagcgccatttattgaatagggagtcctttctccattgcttatttttgttgactttgtcaaagatagttggttttaggtgtgtggttttatttctaggttatctattcagtttcattggcctatgtgtctatgtaccagtaccatactgttttggttactgtagccttgtagtgtagtttgaagttgagtaatgtgatggaacagggcatttcttgaacagggcttagtactttgggtgctcatagttgacctgaacatcattcccaagtggacacattattcacataaacagtgaggatattctggacttgactgacacctggggagaaagaaaaggacaattcctcaagcaggttccccttcaattccttctttccttccttccttccttcaatacttattgagggccaatgatgctctagattcttttctaggcagcagtgagtaagccagatagaatccttgccatcatgggacttacattccctggtccttctgtctccttgaggaaacatcttgagataggtgatcaagtcttcc

SEQ ID NO: 6209 - DNA, 1918 bp, artificial
  synthetic oligonucleotide
gggagtttagaacggggtcagctgcagggattgcagctgggttttgctgattaaggtaaccggaaagcaaaggagcgggtgtcttaggtggataaacccgtgtgaggccgcggaggtgggaagaggccatgtgcctgacacaagataactcggtggagggcctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaa

SEQ ID NO: 6210 - DNA, 1059 bp, artificial
  synthetic oligonucleotide
ttttaaaagttaaaaaaagcttcatttttttctaatttaggttttaggtttgtattttactcttctgagagaataaaaatgaatttgaaccctagcttcccccaatgtaacacttgaaatcagcacagagcttcaagacatgcatagttcaaggctctgagttttatgatatgtgagtttacttaggaaatagattagcattcaagggtttattatatggcagcattttatgaattattttattttttaaatgctttaagataaggtaattcatacccaatgttccatcaattatacagtcttaagacaaaattatgggtgaattctatcaggtactaatttatacatatcttaacactaaatctgattatttttaataccatatttcaagataaaaatcccataaaaattctatctcttgaaattaaaattgaatattaatgtttaagtcactgtaaaaccaacctgaagactttggaaccactgtgtgatttttctgtttattttcagcaatccagcctataaaattacaagtctctgcatttgcatttaaaatctatacctctaaagtgctggcaatttgaaagttacttgccagtgttaggcagcacttaacttttcatgtttgaactaacacaggtatatcaggatgtgaagctaagataatttatattcttttcttatttttcattgcaaatggcttttagaaatacacatgcaaatacaaatttaagaaaaagctttcaacttcagaaaatttttgcttaaaaatgttcatcagcattttaagaataactttttagttagtcttagaattctaagaattttataacctttaaaattcttttgcatgccagaggcaggcccacagccacccccaaaggctgaattcttaaccattaatataaaattatcaggttgaaattacaataaccattacagctacaaagatgtgaggaaaaattctttatagagaattagtcatgtgtaatgtgttaaaatgaaatggtacaagctctcaatgctcaaatgttatggtccaaaatgcaaacattatgg

SEQ ID NO: 6211 - DNA, 1571 bp, artificial
  synthetic oligonucleotide
cttggtccaaacttccacattcatgaacttattagatactataatgccctgccttcagaatagtattttgttttcataattcatttggcaataaagtttgtatctaaaaatcaggtttataatcatactttttttttttttaaatagagatgggatctcactatgttgtgcaggctgatctcaatctcctggcctcaagcaatcctcccaccccagcctctcaaagtgctggcaaggcatgagccaccatgactggcctgcacattttaactttgaatacttctactttttcaaataatctcaccagtacaaacaagtttttcaaaagttttctgctactattatgaaataatagtcaaaaaaagcataaatatgtcaactgtttaaaaaatgtttctatttctttaaagagaaatatgcttttaaggtcaataaaagctttgagtctagaataatctcattacgagagtggaagtctcataaaaaggttgaccaagtaaaaataaaccaaaaggaggacagaaaaataaacagtcaaatgtttagactaaaaagttctcagtgttaaagtaggctgagtatgtcttaaaagtttttccccttacattttactacgaaaagcttcaaacatacagaaagtttgaaagaatcgtgcccaccacctagatcctacatatgttgacagtttgctgtatttgctttatcacatgtctacccatctatccatcagttcacgtatttttcattcatttcaaattaaatggcagtggccagcattagtacacttcacccttaaagacttcagcaaagattgcaatgcttatttttctctctgaggtaaaatttacatagaatgaaatacacaaatcttaagtgtaccattcaatgagttttgatatacccaagttttcactgtaattgtttcaataaagatttgtgtatttcttttttttttaaatagtacaaactttattcataaataaaacttcataaagataaaagcagggacatttcctgtttttaaaagggaatagtggaaggcagtatgccatcttatttaaaatcacaagttaggtttttcagatggatgacagttgagatcattaaatcccattcctgcttctcagattttcacaaaataacacattaaattctcaatgtgtgtgtatttcttaatttacaatgtatagctatgaaactcagcatcactgagcaaatctagaatctgaacctagcctagcttcttctaagagtaatcaataccttttctattatattagcgatcaattaatacattgtattactacacacacacattatcacctactcaatcaaagcccctccttgcaagcacaatactttttaaaaaaaatctgcttactaaggtatactgttttaagttaaaagtcgccatttaagtgtacactgtcatcacttcaaaaaagttctctcttgtccctttgcagccaatctcttccctctatcaccacaccctgttcaacactttttattcccactgcacaaagcaaattctttgttatcaatcaagttataagcaataatgaatcctg

SEQ ID NO: 6212 - DNA, 2484 bp, artificial
  synthetic oligonucleotide
ggaagcaaagtaacatttgtttatttatgtgcccttcactgttctaggtgcttcccatgcattatcatcagttaatcttcatggcattgtgatgtaagcagcaactgtattttacatatgtagggatgcaagttggtagacttccattctactgacattgtctctgctaatgcttttcacttttgtttagttctgtccaagcacaatggtgattgctgagatgtcttttattttaaaaaacataaattgccattaatatgtattgggggtaaaaatttctgcttaccactcatcaaaattgtatgatgtcaaaaaaaacaaaatctttgccgggcacggtggctcacgcctgtaatcccagcactttgggaggccaaggtgggtggatcacctgaggtcaggagttcaagacgagcctgaccaacatggagaaaccccgtctctactaaaaatacaaaattagccaggcgtggtggcgcatgcctgtaatcccagctactcgggaggctgaggcaggagaatcgcttgaacccgggaggcggaggttgtggtgagctgagattgtgtcattgtactccagcctgggcaacaagagcaaaacttcgtctcaaaaacataaataaataaataaattacaataaaataaaaaaacataaattgccattaatatgtattgggggcaaaaatttctgcttaccactcatcataattgtgtgatgccaaagaaacaaaatctttgccaggcgtggtggctcacgcctgtaattccagcactttgggaggccaaggcgggcagatcacgaggtcaagagatcgacaccatcctggccaacatggtgaaaccccgtctctactaaaaatacaaaaattagctgggtgtggtggcacgcacctgtagtcccagctactcgggaggctgaggcaggagaatcgcttgaacctggcaggtggaggttgcagtgagctgagattgcaccactgcactccagcctgatgaaagagtgagactctgtctcaaaacaaaaacaaaaacaaaaacaaaaaacaatctttaaaactagtcttctaaccatcacacatttatatactctggaagctctctctgaaacatgtacgataatccagaacaaactcatacaggttgaatagaagaaaaaaaatggaatcaaattagagcatcctacccttattagttttgcttctggcccatgaaatgcataaagaaccatcagaagatggaaaggccttctaattatggtttggatacaggtgttgatgatacatggaatctctttttgctttaataagtcatgcaagttttttgggagcaacagttaactgttacacttatattcttttttggtaatttcacatataaatagtttttagttataaaacgtttcaaacatacaaaaatggaaaaacacaacataacaggcagctaagtacccatcaccccaattgaaaagatgttaacattttcgttttacttaaaagttttttcatacccgtatacatcatccaaaatgttagatatattaaagctcacttcacatccttccctgaggaaacctctttcctgaagttggtgtatatcactctgacgtatatttttgtgcttttacaacatacatatgcataacaatatgcactttttcttttaaaaatttacacaaatggtatcttactattacattctttgtaactcttttcactcaaattttgtttatctatgtagactcatgtaggtcttgttcattcattttcactgatgtagtgttttactgcatgaataaacaatggttcatttctccatttcccctaacaatgggcaatttggtggtttccactttttccactaattgaaaccatgctcaagtgaattcttttgtatacccaatgcccatgtgtgaagtttatggctaacacctaaaagcagaaatgcttggttgtaagggtatgtacattttcagcttatctcagttttgacaaattgctttccaaagtgattttaccaatttatatgcccatctcactacaaggcagaaatgagttcctgtttacccacaaccttaccaacacttggttttatcagatttactaatttttgccaatctggtaggtatgaaatggtatctcattgtggttttaatttgcacttccctgattactagtgaaatgaagcatcatttcatatactttttgctcattcagttttcttcttgggtgaatggcctattcatatctatacccctccccctcccttttcccctaatgagttgcttatctttttttttcctttttctttttaaaaaattgttgaagtagttctttatatattctgggttctaaatcctttgttatttatatagtttgcaaataacttctaacactatgcacttgtcttttactttgcttatggtttcttttgtcagacactagaagcaaagctaaaaatttttctaatcaataaattgaaataaa

SEQ ID NO: 6213 - DNA, 2597 bp, artificial
  synthetic oligonucleotide
ttatcactccctgagtacaccattttcttttttacttttgtatatattgcttttcattttcaaaacctaccttaattcaaggtttcattccaatcctaccttccctggaagccccctcaatgattaccagccatattaatgccttcctttgcttttcattctataacaactctatatggtccataacatttagcacatacaaacacctccccctccccccacatacacctatatatgtatacatgaattttgccatattatacatattaatgaaactatgcaaatattaacagctaacattttcataatgctttaaggcttataacatatttttaaatccagtatctcattcattcattcattcattcagtagttcagtttcccaatatacctgctgcagatattatactgaggaaatagaaacttctggaagggaaagtaaaggaactaacatacttcctattcatgaggcatcataggaagcagtccttgttatgcctcccttcatacttataaccaccccatgaggtcagcatcattttcaaataatttgtctaagtgagtggacaagtatgtgatagggacaagatcgaaatctctgtctagctatgtcctgtgctcttcccattgattatagctatacctactgggtgtgcaaggaacaaatgcacatctttaagccctacaacagttccatgatagtgtaaagtcctaaagaacaagaaaaaatatatttatactttcaatgtacccctacctaatactcagcagaagacacactgtagacacctaatgaacagttgattctattatttgattctcggtgtggttttatataaatgaatgaaaatactttcacatttatacaggctctaaaaactttaccaagtttccatttcacacctaaggaacattttccaatgtcaaataggattcttctccaaaataatgtttatagttgcctagtctactataaacattattataatggtctagtctactccctagtatggcagcactcattttccaccatcagaaataaagcctggatgaacgtgatcatgcatcttggtgagcaactctgattatctgtatggtaaaattcctacaagctgagttgctaggacaaggggtatatacaatagcattttttttttgagacggagtcttgctctgtcgcccaggctggagtgcagtggtgcatctcggctcactgcgagctccgcctcctgggttcatgccattctcctgccccagcctcccaagtagctggcactacaggcgcccgccaccacgcccggctaattttttgtatttgttttagtagagacggggtttcaccgtgttagccaggatagtctcgatctcctgacctcgtgatccgcccgccttggcctcccaaagtgctgggattacaggcatgagccactgcgcccggcctacaataacacttttgatacatacacaagaccagaaacagtttaacaatttatactcccactaccatgtgtgaatgtgtcccttgctctactaggataatgattattttttttccatctttgccaattagataagaggaaaaaagtcattcatgattgctttaatttgcatttccttgattactacagagagtaaatatttttcatttctttgtcctgtggggagaaaagaaacgctattttaaaaactggctgtagtttaagctggttagttgatctatgaggactaaaaaacatctcatagcgaaggaatcagttttgcttaggcgttttcctttgtaattgtgatatatgagggtaagcacgattcaacttagatgagagaggggttaggaaaaggagagagctaaactgattgcataatgaagcaataagaatttaggctctttctgccatctctccatgctgccataatggtgtgcatgaatgtcctggctgatgctatccagagcatcaacaataccaaaaagaggcaaacaccaggttcttattaggttgtgctccaaagttactgtccagtttctaactgtgatgatgaagcatggttacattggtgaatttgaaatcactgatgatcatagagctgggaaaattgttgtgaacctgaggtaggttaaacaagtgtggagtgatcagccccagatcccagatttgatgtgcaacccaaagatctagtaaaatggcagaataacctgttcctatcccaccagtttggattcactgtactaacgacctcagctggcattatggaccatgaagaagcaagatgaaaacatataggagggaaaatcctggaattctttttctagggatgtaatatatacttacaaataaaatgcctcaatggactctggtgtttccaaaaagaatttgggagatgttctgagagctagaggactttctggagggacccagaagggatgagggaaaagacggagcctggggaggaggcagcaaagtggtgagaagtataaagactaaggagggaaccagtccgtgagaaatacttggaaattatttactgccctgtgctataattatcagcaaggatcaatccattttgtctggtcatatctgaaatactggtacttgaaatga

SEQ ID NO: 6214 - DNA, 1750 bp, artificial
  synthetic oligonucleotide
ccgcggagggaggtggcggcggcggcggatcggcgctggggaccaggaggcggcggcagagacgctccctcctctttctcctcctcccgcagccgccaccgcccgcccgggagtgggagggggcttcgcgggaccggcgctctgtgcgggcgggagccgcggccgccgccttctgctccgcccctacgcctcagcagccgaccggctcgccagccccgctcacccgcctcgcgcagacacgccctcctcccccgtcggcggcgcggcttccagaaccacaggctccgcccactccaaccggtcgggaggcggtggcccagggaaaggggagcgggccgagcggcgcatgcgcggggcgccggccgcgtcacggcgaacgggcgggcaccgggattctagagggcgcggggggttgagtggggcgcgccggctgcagctgccgaggcggggctggttggggtcgtcgcctccgcgcctagccgcgaccaagccgcgaaaggggctggagacaaaaggtccacggctgcacgctcgttgtccggcaagaggcacgaaactctggccgctcccctttccttcttttgtaatcgcagggagcctttcccagttttttgctgggaaaagaggcagggaaagggtgctaatgaatgagaaagctaaaagagaggtggagagaggttgtcactgaatccgtgcttggcagcggatgcttttagtgctaccctgtcattccttaatgaagatgagggctgggggtaaggggaggtcgtccaagaaaaggactaaacaaaaactgcctaggaaggtgtgcgacagcaaacggtcatctatagagacagcttctcccacgttctgccccaaactcaacaaatatctatccagcgcctaccctcactagagaccaacctagagagaagctaggaaggcagggacaaaccgtgactttaagctcatttgtatattgtcctcaaactcccaggacctactctgctctctatactccctataaatgttagacttgtcaggaacagaatgcaactagagggagtgcaggcacaggagcagccagggagtgaggttctgggtgttgccgctgtgctaggttgcattcaatatgaagatttctgttcaactgagcatgtgcggaatgagccagcgccatcagacaggtatatgcctcagttgaagaccaatagtgtctttgttcctccgcacagcaaaagtgcccaattagttcataagtcagtttccagaaatcgtctggtaaatttctcagtgcagtattttttttaaaaaaagtatttattaataccaaagtggagggggtgatgtggagactcacagcctattttctcttcagaaacgtttcgtgcaaacccttgaccactccctcaaaaggctgagagatttgcctgctaaggatttgggtactaaaccttttttttttttttaaatgcagatcagaggacaagtgtaattgcacacggttttcctcctttctcaaagagcttgtgcattctctagagacgggggcttcagaacttgagaaacattgcctcctttaagggtccaagagttactcaccacaagttggcatgtccagctcatgtctaatgaataaggcgtcactccattctgccctgaagtgcacagggaccctctcaagtcaccttgtcagcttcacttcttttccccagcccaagactgagctataccaagccttgtcgacttcattttggggtttgttgtc

SEQ ID NO: 6215 - DNA, 1428 bp, artificial
  synthetic oligonucleotide
tcagtggttctggaaaaactcggaaatagtcattaggaaagagaaaatgggtgttgttattgggcaaaggaaaagtgatagcatacttctatcccacatgcccatcaggaactgtgaataagatttattcagagcaaatagaactgaagatgattaaagaacttttatgggtggtgtgtgggtggaaaatgaaaggtgttaccctcaaggaaagacatgtcagtctgggaaaagcaggctcctgttaacatcgcagggatgtgattcactatgaaaacctgaaaccggttttatagcctgcgtgggtggtggctggggcacagttgttttaactgacacagagtaggcagaaggtgaccgattggataatggaacctggtacctaagtataatggaccatggcgtcatcttgaataagcaaatctaaggaaacggttacactggcccataccaagcagaatcacaggaaaactgacaaagcaaggaggcctggcagaaatattatgccctggtttctttctggcttctcagagggacccaggctaattattcatggttggattgtcagtcatctctggttcagatattggtgatggtcatttaagaaacaataaaagagagattatctggaatcttctgactctggtgccatggtgacaggttccactaaaagaagacacagagagattttctcaccatgtttctgggatgcttcgttgcccaatttctaattctactttggcttttccctccattcagctttccacctttatttttacttattgttttaccaatgaaaatagcttttaaaacatttttgcttttcaaaaaatccaaactatttagaaaaacatgtatggaagaaaacaaaagttttctgaaatctcaccaccccaggatcctcaccattaatgttttgggagactatcctttcatgttgatgcatgcatatttacatgggtacttttacttaaaagagaaaatatgatacacactatcttttaaattgtggacaattttttttgaacaggatttttctttttaaaaaatttaaatttttttattcttaatttttgtgggtacatagtaggtgtatatatttatgggggtacatgagatgttttgatacagacatgcattgaaaaaatgaattttgtttaattttttattgatacttcaacctcccactgacacctccactaacctgtataaatgacttggtatttattttcccagaccttttctcaagatcatagaatttcacacacacacacacacacacacacacacacacacacacacagagttaagaatcatttaacagaaacaggatctaggtatgtaagcactatacttcaatacaatgaaagccatatatcacaagcccacagctaacatcatactccatggtaaaacgttgaaagcctt

SEQ ID NO: 6216 - DNA, 1609 bp, artificial
  synthetic oligonucleotide
aattaagaagctgaaagatggatagtggtgatggttgtgcaaccatgtgaatgtatttaatgctacagaactgtacaattaaaatggtaaaaatgataaattttgttatgtatattttaccagaattttttttcttattaatacagtatttgtttgtcttttctctgtcaaaacctgagccaaccacgttccccaggctgcctgaggaggtataggaaaaggaacacacagggctgaccacacgtgggagaaagaactatgggaggtggagatggctccttcacatggcagagaggatgagaaaggccaccatcaggcaaaagcaccccatggcgtctcagagggcaaagcccagagtggcgtaggagaagagctgttgcttcagagaagggttcctggcataaccaatgatgaggctcccaaacacagtcccaatctgagccgcagagccagccaccccaactgcggcagccccagctccagtgaacttggctgttgtgtcgatgtcccttgaaatggtgctggtttggaagctgcggctagagacaagtgaggtaaggggacgtgagactgccaagctgctgaggctctcatctgtcagtatctccggtcatttcagcaccactgcagatagctgacggctcagcagctgtgaggtgctcttgaccaatgagggagaggagacgagcttggagcaggcgaacgttttccggggctgaggggctgtagcaggagagctgctcccactgcagagaagacagtaccagaatttttttaaaagaagaagctaaaggcaatttcctctttccaatatttacactggcaccataggatgccagcaaagggctgctggaaactgttcctcttctaggttaaaagacatatacacgaaatgtacaggtctagagcttgttagagtaaggaggtgctcagtgtccagcctcctcctcctcctttctccttcttctccggggaagagtaggagaggcaacactttctttcctattcctatttagctggatttcaaacctaagagtataaagacagagtgggtaaatacccagaacctggttcaggaacgtcttggttcagtacacccctctattctgacccaatttttgcactggtggattggggtacaatgacaagaagggtaacgttatggttagaccaatgttaagtttagggagaaggtggatgtaacttgaggagaggcagacgtggttagaaatggcagacacaagcagtatatctgagtatcaatttttctttggcagcgaaagcataaggaatacacaggttattttatgtacatataagctcgataaatctggcatttctagctctcaccaaaaggtccatccagtgtcagctatatgatttgtggggcccagtgcaaaatgaaaaggcaaggtcctttgttcaaaaagcagtgaaaaaatgctgtttaaaaaagcagtgaaaaaagctttaaaatataaagcttttccctttcgtccatggtctctctctttggactttcatggtgttttctatctgtgatttaatgtagttctaagtgaagaaaaattaaaatcttaaattattagaatgaattttaccattcatt

SEQ ID NO: 6217 - DNA, 804 bp, artificial
  synthetic oligonucleotide
atgtggccctggctccaagtggtaaatcccaagtgaggattagtttattagtttgctgtggctgccataacaaagtaccacaaactggataccttaagcaacagaaatgcattgtctcacagttctggtgactggaagtctaggatcaagatgtcagcatgattgattgctcctaaaggctgtgagggaaagatctgtgcaagcctctcttcttggcttagagatggctgtcttcttcttgtctcttcacatagtctttcctctatgcatatctcttctttcacatggcattctctttaaggacatcagtcatattagattgaggcccaccctaatgacctcatcttaactaattacatctgcaactaccctgtttccaaatgaagtcacattctgaggtactgaggtttaggatttcaacatatgaatctaggggaggagaatgcaagtcaacccataacaggtaatgatactaattgcccaagagggtcagaacaggagggaagtggagggcctggaagctggaggacagaagagggggacttgggtcactctcaaaggatgatatggggagaggaggagaaaaaagatatcaagggtgcagaaagatgtgagagggaaactgcatcagcaaagtgtcacaggtggaaatgcagagcacgagcttgggggacactgaggaggccaatttgtcaggtaccaggcaaatagcaaaggaaacgttggaaagggagctgtggttttcatcctgcaaaatcttaaacacaggctaactgggaatgctgcaagatgctatgatttctg

SEQ ID NO: 6218 - DNA, 1981 bp, artificial
  synthetic oligonucleotide
cattagtgaggggctgtgatggttagttttatgtgtcaacttgtctggactatagtatccagttattcaatcagacactaatctaggcattgctgtgagggtattttgtagacatgattaacatttacaatgagttgactttaagtaaaggaaagtatcctccataatctggggaggccttacccaattgactgaatggccttaagagtagaactaaggtttccttgaggaagaagaaattctgcttgtggacagtggtgcagctcctgcctggtggctccgagtctgctacctatctatagattttggacttgtcagtccccataatcatgtaagccaatgtcgtgaaataaatctctcttcctctacccctgattgtttctattgctctggtagaattcagacagacatggggcattgacaaagttcaaattgatgaaaatctatataggggctgtgggaacagagatatgaattgtgtttaagagacatttttgagatggaatctggaagttagatgtaaggcttaaggtaagggtgagaaatagaaaaaaaaataaggtaagatttatagtcctggagagtgcatggatggttatgctatgaatggagattaagaactcaggaacgatgacatgtttgggatgggaaagaagccagtacctggggacatggcaaatttaaggtgcttgaggaactttgctattatgtccagctggcatttgaaaattagtctgattctcagggtggagctgtctgggctggagagaagaatatgatcgttgaaagaatgttctctttttcctaaattattcatatttccttttttagttcatttctattttttcatctttttttttcatgacaactgtttttctcaaatatctgttgatctttggagatcagttcataggcaggcagaggctgtattcaatgcatatactgtgtataactgtggggggtaggatgaagacccattgacatgtgtacctaagacaattctttaataaagtacccagagcttttccattctttacattaataggctctagtcttgagcccttgaagatggctgacatattttaagtttctgtttcctgccttccttttccataaattcaatcccatgtgcttttccttcttcttgggtttcaaaatttttagttcaattccagttttctttttaaatttcttttcttgtgttatgatttaatattttgtatattaaaaaattgtatttttctttcgttggtatcttagaggagaagtgtggtggatattctacatttgcctctccagattcacattacgcccaactctgccctgctctgtgtctcaggagctgacctgtatgagctgcatcaataggcccttttgccctccatttgggttgagttcagctaacagaaggcattgacaagagactggaaggcaggaaataagagagaggttaggtgaggccaaaatttggtaagggcttcattactctacctatagctcctattcaacaattctctcctacagccacaagtctcatcaggttctggtaactgctctctccccttgcccactccatgctagggatggtagtagcttagtattcttgctgaacctggggtgcttcactattccttgttgatttctcttaatcctacctataccttgtaagagtcccttaactgaactcttttaaatcatactttttgagagttccctctaattcctgccagaattcagacctatacaggagtggagaaagatacgtgaattagaagcccagtgaaagagataatgagggcatttggaggttttcaatacctattatttaacttgaaatgaccgatttttccatttttttattgttgagacacaatctaaaagttaaaattccaacactggaatcagattgcttgggtctaaatactaattccacaggtactagctgtgaatccttggaaatttaccttaccattttgagctc

SEQ ID NO: 6219 - DNA, 194 bp, artificial
  synthetic oligonucleotide
tttccgcttgtaattatctcagaatatggctttatttggagataggggctttattgtttcttgaaacaaccttcttttcagtgtgttgatctgctctattttttttgttttctatttcactacatttctctcatatttattatttttttctcttcatactttaggtttaattatattttttctaacttctccat

SEQ ID NO: 6220 - DNA, 3148 bp, artificial
  synthetic oligonucleotide
tcgtcacttggttaaatttcatgtctcctctaggtcttatcctcgatatcaactccaagtgaaggcctttcaagaccttaggtgatgtccctcgaggacctctgtaaagcactcttgcacagtatagaaatgacctggtgacatggctgagctctcccatccataaactggtatctccttgaaggcaggcacagagccttggcacctagtgtataaataaataatttaataaattataacatgatgttatgtgagatctggcaaaaataaaccattatgtctgttcttcctaaagcaaaggattgtgtgctttcttagagcctgagctaccatgataaaaactcgctcacaaatagcatgagaaaatgacaacatgccattagtaacccagaagaagctgtatgtgtttttgtatttttttcatctgggctttagaaaccacaaaagcaactgttttgcctccacaaagaacatatttttaacagcacactttcccaaaaggatactcctccctctgttgcattttgatctatcctgatttaatttaaagtttgaagatggcgtctgaccttatctatcagtggctgagccgttgtctcatggaaatgcagtttgaaactcattaatagggtagcctgtatattataacttagaagctctgggttatcactgatgcttgcaattgctatggaaaccgggttcatatgcacctttcaaagagtctgctttaaaacaggaaaaaaagatgaagaaaaagaaggctttgtgaaagaataagatattttgtacccagcatggataagcaggttcagtgatgcaaaaatgctctgcctacacaatgataaaaacaattttttacctttttcaggagctaataatgtataaccttgtcttagagaactgtgtttatactggtagagaagaatcctcaaggcagctttccccagtgcccacacatagacacacaaacacagacacacacccacaattttcagttttccccagactttttgcaatctgcattcttaattcctccaaaggcctctgcacatgcagctttggctgctaaagcccacccagtgtggactggctgagagctcagtctcttctgcttccccttaaatgtgtattgaatgttgcatctgtctcttatgggctgaatttttcaattataaaatgatagtgctaattggatcaagtttcttattaaaaattcttggatgtattcctccccaaatttgggttttggaggcttcatccctcatctccttgcccacatttctccctaataacctaagtgtggtattgtgttaggtaaacaatagtgtatcatcttgtggaaaatgattctttagacacacctccctccctcatgtagaaccatgtgttactccctccaatgttttcatctgcttatctccccacttgtgagtcatctattatttttccttatcacttctgcaaccccattcctcccctaactgtagccaaatgtgagctgggtttccttctcttctgagcaagaacaggtcacgagggctgagctttctgtcttcaccttcagacagaaggaacttgaaagaaagaagaacgcatctgcaggcagctgttcactccgcaggcatctggaaaccacttctttgcattcaaatagttatgtaaccccacatgttggaaggctgaagagaccatcatactcaaaatggaaatgacactgttgcaacacatagaatatctgagagaagaaagggtttctaatgtcttgactatctatgatattccataaagttaagggattgatgtgcatgggctgggaggactgaggaacaaaggacagaggttgaggtaggtacaaaaagggtctactaactactttagaatttgaaaaaactattgataccaaatctgcccaccctctgtacaaaaaacaaaacagccattggtgcaattttaacctgataatgcatgaaaaatggctatttttgacgagaaaaagttcagtcatttccttgtaaaccaaagaaaattaagagaaactgtcaagttactacaagaaaattcaacaagaactcttataatatattccctctcaattaaacagcaaatcaccctaatgtgtttttcagcctgaatatttatcagcctagataatctactttaacaattatgttttgcatttttaacaaaaccttttctgcaaaagttagtataactagaagtgaatataaattagttacctttcaagtctttaacatattaaaaagctatagaatatatacattaacccatggttttataaaaggaatatggctttataaaattaaaagcaatatcaggatctgtatttgtgttaaataattacaataacatcaagcagacatttcccacttaatctatgactctctaagattaccatttaattctgcattacaatttaactaagtaatttagtactcgacgcatgcgctacagaaaacaagaagcagtgtattacagtaacaaggtttgtatttcacaaacaattgcaagggtgaagcagatatcttctaagcgtcacatattcacaaacaattgcaagggtgaagcaggcatcttctaagggtcgcatgactgggtttgcagtccaccggtcagaggagcttcctctgattcttccgcagcagtcttctcttcgttcgtgccttgtggcgtttcttcgttttcattatcttcactttgtagctctttccacattaattgtctagctaatttgatgttcaattcttcgttgtagtgaagccttcttctcatttcgaactgccgctttttctcctgtttgtggaggaggatttttctcatgtaggcctcactgctctcttgctcgtccacctcacagctgtggtcggaagcatcggtggcttcctttccttcgacaccacgcactgaatcttctccttcgacatcgcgcactgaatcttccccattatcttgcacactcatgtaggaagtgccgggctcatttgccttcattaaatcgtaatctctgtacgttgcgcggtgtgccgcaaggatgcttgattcgtcccacttttgggatttctttctcttcacatcttgaatagtccctccagactgctgaccggaagtcgccaccgaggaacccgacgag

SEQ ID NO: 6221 - DNA, 530 bp, artificial
  synthetic oligonucleotide
tatcttcagaggattcagtggtttcatttaagagaccacatgctctgtcattatggtaaatagaaaggcctttgcatctgatttgagaagaatgtggggacaggtgtcatagtgctcacttctccttgactcatagcaatgataaaatttgccactacaccagagaatccaatatttaaggaaacagatgacaccaaaatcttgctatggaagtgtgctttttgctttgaaacagacattgctttgtttctactttctctataattcctaaatcttgtgctttcatttccccttaaaaatatttccgtaagtcattttgttcataggttgtgtatttcatgtaaaatttttaggttttcaattcatcagtttaacccttaatcactttaacctgtctaattttaatagttttttggagatgtaattcacatacaataaaattcactcatttatagcgtacaattcagtgtttttagtatattcatagagttgtgaaaccatcacagctaatcaaattttagaacatttta

SEQ ID NO: 6222 - DNA, 289 bp, artificial
  synthetic oligonucleotide
ttactgttttagcccagatataagctgcaaagacactggtacacagctgggacattgccattggaaaatgaaataatcaaacatggacagagttacctagagttgcaaaggttttttgtattctccttttctcactaggcattttgccagtagcccttaaaaagcaggtcatgtcttctgctgcactttcagactctacatactagtacaaactggaacaaaaaaacattcatcactgtaaaaccttgcctttcaggctcagatgaaaaacttggctccagctctcttt

SEQ ID NO: 6223 - DNA, 7937 bp, artificial
  synthetic oligonucleotide
ttagaagttaaaatttgatacagaaaatttaaaacaccattagaaaaggtgtttgtttggtttttgtttgtgctttcacttctgggtgggaacttgataggtacccttgacttcttgcctcttttaaatgaacaaattaggcagaatattctttggctactgctattgggtgtgtgaggctgctctggagtgcttgaccaagtacctggttggattaatgaacctaagtctacactgcagggtcattcatatatctgtaggatcacctgagttgggagggggtctcaagatcaagatttaggttgaggatcagaaagttcccttttagcctcaagtccaaatcagatttttttttaaattccaacttttattttaagttcaggggtatatgtgtaggatgtgcaagttggttacatagataaacgtgtgccatggtggtttgctgcacagagcatcccatcacccaggtattaaacccagtatccattggctgttcttcctgatcctctccctcccaccccctaccctctgacagaccacactgtgtttttttccccactatgtgtccatgtgttttcatcatttagctccgacttataagtgagaacacgttgatattacagagttgaaaaatgcaattgacatagatactgcagagtatctatgatgttagagtgtaggggttgcttttgttacctttactttccttgtcatcaaagttaagtcattatcagtttaaaataacctgttataactataagatattttgtaagcctcatggtaaccacaaacaaaatcctgtaatagatgcactataaacaaatagtacagcatcaaaacatactgttagagaaaaacacttaagagcaggaaaacagaaagacagaaatggagaaaggatttacaaaagaaaaaaacaaaaaaaataagtatcaaaatggcagtagaaaatccttacctatcaatatcattgaatgtaaatggattaaattcttcaattagaataaatagagtggttgagtgaattttaaaaaacaagaaccaaatacatactgtctacaagaaactgacttcacctataaagacatgtacagaaagggaagggatagaaaaagtgaagaatgaaaaatattgcaatcaaatagacacaaaaaaagagcaagaatagatcttttactagtaactcttttttttaaagtagagtttaaataaagaatggcaaaaaaggacaaagaaggccattatataatgataacaagatcaatatagcaagagacatacaattttacatatatatgcactcaaccctgaagcagccaaatatataaaacaaatattaatagaactaaaaagagagattagctacaatacaacaacagtaggggatatcaccacctcactttcagcgatggacagatcatctagaaagaaaaccaagaaataaattcagagttagactgcactctagaccaaatgggcctaatagatatttatagaacattccattcagtagctacaaaatacatattttcctcaacagtatatgaaacatttttgaggatagaccatatgttaggtcccaagacaagtcttaataaattttttaaaaatgatatcatgtcaaatatcttttctgaccacaatgaaataaaattagaaatcaataacagaaggaacactggaaactaaaactgcatgcaaattaaacaacatgctcctgaaccataaatgggtcagtaaagaaatttaaaaggaaatttaaaaattccttgagaaaaatgaaaatagaaacagaatatatcaaaaatctataggatatagcaaaagcagttctaagaggtgagcttatagcaataactgcctaaatccaaaaagtagaaagatttcaaataaacaacctaatgatgcatctcaaggaactaaaagagaaagaacaaaccaaaccagaaattagtagatgaaaataaataataaagatcagagcagaaataaatgaaattgaggctaaaataagattaatgaaatgatagttggttattcaaaattaagaagagttgacaaacctttaactaaactaagaaaaaggagagaagaccaaaatgaatgaaagcagagacaaaaaggagacgttacaactgataccacagaaatacaaaggatcattaaaaagtttatcaacaaggatatgccaacaaattggaaaacatagaagaaatgaataaattcctgaacatatacaacctaccaagattgattcatgaagaaatagaatatcagaacagaccaataacaaataatgagatcaaagcagtagtaaaatgtctcccattaaggaaaagcccaggacctgatggcttcactgctgagtcttaccgagcatttaaagaaaaataccagttgtactcaaactatttcaaaaattgaagaagaagaagaaatgctttcaaactcattctaggaggctagcattacaccgatatcaaaatcagacaaggacacaacaacaacaacaacaagaactacaaggcaatatgcccaatgaatgtagacagaaaaatcctcaaaaaaagctaacaaacaattaaacaatatattaaaaagattattgtacttggccataaaaagtaatgaaataatgtattttgcagcaactttgatggaactggagaccattgttcaaatggaaaaccaaaatactgtatgttctcacttacaagtgggagctaagctatgggtatgcaaaggcatacagagtagtttaatagacactggagactcagaagcaggaggattggaggtaggtgagggacaaaaagtcacctatggtgtcaaggtacactatttgggtgacaggtacactgaaagcccagacttcaccactatacaactcatccatgtaattaaaaaacactgtacatttaaagctactgaaattgttttaaaaaagatgattgatcatgattatgtgggattcatcccagtgatgcaagaatggctcaacatatgcaaatcaataaatgtggtacatcatattaacaaaatcaagaacaaaaaccatatcatcatttcaatagatgttcaaaaagcattcaataaaagttatcataacttcatgataaaaactcttaacaaactgagtatagaaggaacatacctcaaaacaataaaggccatatatgacaatcccacaaataacatcatagtaaacagagaaaaaataaaagcctttagtctaagatctggactaagacaaagatgcccattttaactgcttttattcaacatagtaatggaatttctagccagagcaattaggcaagagaaagaaataaagggcatccaaactggaaagaaagaagtcaaatcatccttcttcacagatgaaatgctcctatatttagaaaaacctaaagaatcgacaaaaaagggttagaactgataaattcagtaaagttgcaggatacaaatcaatatacaaaaatcagttgcatttttgtacgccatcagtgagcattctgaaaaagaaatcaagaaagaaatttcacttacgatagctacaaaaatacctaggataaatttacccaaagaggtaaaagagtcttacaatgaaaactataaaactctgatgaaagaaattgaaaaggacaccaaaaaatttagatatcccatgttcatggactgaagagttaatattatgaaaatatccatgctatcctaagtgatctacagattcaatgcatttgatatcacaatatcaattacattcttaacagcatagaataaaatacaatgctaaaatttgtatggaatcacaaaaaaaaaaaccctaaataggcaaagcaatcctgagcgaaaagagcaaagctgaaggcattacactacgagacttcaaaatattctacaaaggtgaagtaaccaaaataagatggtactagcataaaaaacaggcatgtagaccaatggaatagaatagaaaacccagaaacaattccctgcatttatagtttttcagcaaaagcattaagaacattcactggggaaaagacagtctcttcaataaattgtgctgggaaaactggatatccatatacagaaaaataaaactagacccctatctctcaccacataaaaaaatcaaatcaaaatggattaaaaaattacatttaaatttcagctttctacatatggctagacagttttcccaccatcatttattaaataaggaatcctttccccattgcttgtttttctcaggtttgtcaaagatcagatggttgtagatgtgtggtattatttccgagggctctgttctgttccattggtctatatctctgttttggtaccagtaccatgctgttttggttactgtagcctcgtagtatagtttgaagtcaggtagcatgatgcctccagctttgttcttttggcttaggattgtcttggcaatgtgggctcttttttggttccaaatgaactttaaagtagttttttccaattctgtgaagaaagtcattggtagcttgatagggatggcactgaatctataaattatcttgggcagtatggccattttcatgatattgattctttctatccatgagcatggaatgttcttccatttgtttgtgtcctcttttattgcgttgagcagtggtttgtagttccccttgaagaggtccttcacatcccttgtaagttggattcctaggtattttattctctttgaagcaattgtgaatgggagttcactcatgatttggctctctgtttgcctgttattggtgtataggaatgcttgtgatttttgcacattgattttgtatcctgagactttgctgaaattgcttatcagcttaaggagatttggggctgaaacgatggggttttctaaacatacaatcatgtctcctgcaaacagagacagtttaacttcctcttttccaattgaataccctttatttctttctcctgcctgattgccctggccagaacttcccacactgtgtgaataggagtggtgggagagggcatccctgtcttgtgccagttctcaaagggaatgcttccagtttttgcccattcagtatgatattggctatgggtttgtcataaatagctcttattattttgagatgcgtcccatcaatacctaatttattgagaggttttagcatgaagtgctgttgaattttgtcaaaggccttttctgcacctattgatataatcatgtggtttttggatcccttccttacgccttatactaaaattaattcaagatgaattaaagacttaaatattagacctaaaaccataaaaaccctagaagaaaacctaggcaatacgattcaggacatagacatgggcaaggacttcatgtctaaaacaccaaaagcaatggcaacaaaagccaaaattgacaaatgggatctaattaaactaaacagcttctgcacagcaaaagaaactaccatcaaagtgaacaggcaacctacagaatgggagaaaatttttgcaatctactcatctgacaaaaggctaatatccagaatctacaaagaacttaaacaaatttacaagaaaaaaaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttggaatggcgatcattaaaatgtcaggaaacaacaggtgctggagaggatgtggagaagtaggaacacttttacactgttggtgggactgtaaactagttcaaccattgtggaagtcagtgtggcgattcctcaaggatctagaactagaaataccatttgacccagccatcccattactgggtatatacccagaggattataagtcatgctgctatcaagatacatgcacaggtaggtttattgcggcactattcacaatagcaaagacttggaaccaacccaaatgtccatcaatgatagactggattaagaaaatgtggcacatatacaccatggaatactatgcaaccataaaaaaggatgagttcatgtcctttgtagggacatggatgaagctggaaaccatcattctcagcaaactatggcaaggacaaaaaaccaaacaccgcatgttctcactcataggtgggaattgaacaatgggaacacatggacacaggaaggggaacatcacacaccagggcctgtcgtggagtgggaggaggggggagggatagcattaggagatatacctaatgttaaatgaagagttaatgggtgcagcacaccaacatggcacatgtatacatatgtaacaaacctgcacattgtgcacatgtaccctagaacttaaagtataataaaaaaaattaaatttaagacctaaaactataaaactacttgagaaaaatcattgaggaaattatccagggcattggcctagatgaatattttttgggtaagacctcaaaagcacaaatagcaaaagcaaaaatagataaaagggattgcatcaagctaaaaagcttctgcacagcaaatgaaacagtaaacaaagtgaagaaacaacctacaaaatggcaggaaatatttgcaaactatccatttgacaaaggattaataaccagaatataaaagaaactcaaataactcaatagcaaaaaaaaaaaaaaaacaaataataatccaatttgaaaatggacagtaatctgaatagacacttaaccaaagaagatatacaaatggccaacaggtatatggaaaatatgctcaatatcactaatcatcaggaaaatgcaaatcaaaatcacaatgggatgaaagctcatcccagtcaaaatggctattatcaaaaagacaaacatatatatatatatatatattttatatgtatatattatatatatattatatataaaatatatacatataaaaaatatatatataatatatacatataaaatatatatatattaaacaaatgccattgaagatgcagggaaagggaaatgccagtacactgttggtgggaatatagattactacagctgctaggagaaactgtatagaggttcctttaaaaactaaaaatctatctaccatacgattcagcaatccctgctgggtatatatcctaaagaaaggaaatcagtatatcaaagacatatctgtactcccatgtttattgcagcactatttactatagtcaagatatggaagcaacctgagtgtccatcaatgaatgaatggataaagaaaatgtggtatatatacacaagagaataatattcagttacaaaaaagaatgaaatactgtcattttcagcaacatggatgaaactgggggacattttgttaagtgagataagccaggcacagaaagacaaatatcaaatgttctcactcataagtgggagctaaaaaagttgatctcatggaagtagagattagaatggtggttaccagaggctggaaagggtagcagggaggagaaataaagaaaggtattttaatgagtacaaaaatgcagtcaaatagaacaagttctagtactgtagcactgtagggtgataattgttaataataacttattgtatatttcagaataactagaagatttggaatgttctcaacacaaagaaataataaatatttgacatgatggatatctcaattacccatatttgatccttacacattgtatgcatgtatcaaaatatcacatgtaatccaaaaatatatacaattattatgtatcaaagaatttttaaaaagaaaacagaggcacagagagatcaagtaaattgttcatgatgtattaagagaagggctctggattagaatacaggaaaactgcctctaaactatattctcatt

SEQ ID NO: 6224 - DNA, 1710 bp, artificial
  synthetic oligonucleotide
atgtgctggttaatgatttatactgtgctatacaaagtccaaaattcctttggaggtatcctctgctggcttgtctacattgtttaaggatggataggttgatggtttgcacctgctttaatcatttacacattctgattttatttgtgatcagtggaggataaaaccttcaataaacttgtgtcttagcttccttgatattaagatatcttgcacatatcttagatttttataatctgaatgcaaagcacatcctttgcaattgagaaaggactctgtgagctgctcctggatatgtgaaacccctcagtgactgaccgtattttctttcttctgctgtacttgcccttattaaagccttacatgtgaagtaagtcctttcaattgtctgactccgggtgattgttataccctttgatatagtttggatatttgtgccttccaaatctcatgttgaaatgcgatcccctatgttggaggtggagcctagtaggaggtgttagggtcacgggaatggatccctgatgaatggcttggtacacagtaatgagtgagtttgtgctttattagttactgtgagatttacttggtaaaaagagcctggcaactcctccctctcccttgctccctctcttgccatgtgacatgcttgctccagctgcaccttttgccacaattgtaagctttgtgagtccctcaacagaagctgagcaaatgctggcaccatgcttcttgtacagcctacagaactgtgaaccaaataaaacttttatttttataaattatctagcctcaggtattcctttatagcaatgcaaaacaaactaacacacccttaaaccctatatttaaggctgagatcttggaccctcctcctaaaatttaccttaaaaggtgaagcaagcactagtcttggagactataaattggaaaaaatggcaaagcagtaggtgttccaatctttgctttaggcctgagtaagaggccataaagatgcctgtggaatcctagatcttagttctgggtgtaagtagagggaaattggggaataacataggcacagcatagacaaaatttggccaacagatcctagtctccccacttctgtcaggaatataactcaaaggtggaaggaggactgagcttacagatgaaattcaaatagggactgacagttatttctgttggttcatatgacttctattctagaaactgtctctgaggctgaaagcattgtaggatataagggaatgaaagctgcagtataatgaaaattgcacaattaaatcaagatcatccaccaaaggcgcacagtctaaataactacaaaatccactgtcttccataaactatttgttttgagtgttcttggattaacttagagacagctttctgttctgggtactataaaggctctaaatgggatattcattgtaaagcacgtgtgaataaaggaaataattatgaaatataagagaacagcagaaacatttacacacagaaaatgccttgtaaccttaatcaggataaagaaagaaagaaacactaagaaaaagtctaatattagagaactggttgaatgaattatggtatagtaaagtgatggaatattatgcaggcattaaaatgataggtttatgtagaaacataaacaaaatgtttcatataatgttaagtaaaatcagcagaacacaaagtggcatatcatat

SEQ ID NO: 6225 - DNA, 858 bp, artificial
  synthetic oligonucleotide
tcttacctcagcaaacacaggttttataataaaagaatatgattttctcagctgtctctcaagcttaggagagtggccatgcacccacatattactcactgtctttcaagatctcataacttgggacagcaaatttctctttattctccagaactaatttcaggcttagagcatgggaaaccctctgggctgctaccatttctgaaaagacaactaaggcagtgatcacctggtagacaagtttaaataaatcacttgactttgctttttgcttttgcaagattatcacatcttcaagaagattgattgaaggaactgacaaagacaagctctttattcatttggtacaagggtctccaaagggttcaatctttaatttggttttgtggaatgttaacagggaaaacagatctttcacggtcaggctataacactggctactagaaatatgatttttgtgttttatctacaatgtcagatactgattcctaagcttttaaataaatcttttaaaaaattttctgtcttaagagggctcatagttgcttcctaagtagtactttaccttattctaatttatttcaaatgagattgcaaaaataaacacatgttctttgtcttactttggaccctttcgaaagcagactctgaggtgaggacacaggtgcaaattttttatttgggaggtgagcataggaagcagaatggagaagtgagtgagaaaatacaaaaggaaagctaatgaagtgggtattcattagcaggttatcgctgtgggcaactggagcttaattttgctagggcacctctgaaatatcacatggaagaggtttcccaaggactgtggtggaggtgggt

SEQ ID NO: 6226 - DNA, 857 bp, artificial
  synthetic oligonucleotide
aaacttctaacaagactgataaatagagaaaagatacaatcacaagtatcaggaataaaataagagacatcaatattaattttgcagctatcaaaaagataacaagcaaatactacaaataactttttgttcatgaatttgtcaacttagaagaaatggatcgatttctcaaaagctactaaaactccatcaagaggaaatagataatatgagtagctgtgtgacgattaaagaaatcaaatttataatttaagagcttataaagaagaaatctccaggaccaaatggtttgctggggaattcaaccaataatttaaagaagaattaacaccagtatttcacaatctcctccattttatgaggccagttattacctgatacaaaaccagaaaaatgcatgttctgcatttatggtcattatgcttcccatgttaagtgaaaccgttcgtttcctaaggctgctgaaaaaaaaaaaagcaccacaaactgggtggctttcaacagaaatttattctctcacagctctggaggctagaagtctgaaatagagatgtcagcaggatcatgctgtctctgaaggttctaggggagaatctgttccatgtgttttgttgtcttctgatgttagctgcaatccttgctgatacttggtttgtagacccatcactctgatctctcttgttatcacttggcattctcctttgtgtgtgtgttttccttctctcataagaacagtcattggattaggactcaccctaatccagtgaggtctcattttaacttgattacattttcaaagaccctatttccaactatattcaattcatgggtgccaggagttaggatttcaacatact

SEQ ID NO: 6227 - DNA, 708 bp, artificial
  synthetic oligonucleotide
aagacagccatattgtttttagtgggattttaggtaaaatatcaaaaataacagctaatgacttagggagggagacttcagaataaaccaatgagtaggtgtggccttggggaatagattaaaggaaactgtctgctatgtgggccaccacaattgaacatgggtatatgaggaggggtggtagttcatgatgggaaggcatagaagaggctgtcatagagaagcctcttttctaccaccaggctatccttgcctttatatcacccccccaccatccaaaacagaggtggcaggagtggtacattctgatgactaagactccccaggtacctccccacccctctctcacatagaagtgacaagagtagtgctttgtgacgtcttagtgtcccttagctctcattggctgggcgagtgccttgctgaccaatcaaagttgaagggtgtggcccctcattgtgctgggaggggtatacataggatgatcaggagctgtgagcagaccactgggacaattcagtatggcaaaggtgaccagtgagccacagaagcctaatgaagatgtggacgaacagaccccatcaacctcaagtaccaaagggaggaagaaggggaagacaccccgtcaacgaaggtccagaagcggcgttaaggtgagatgatcccgaccaaaccccttctctttgccccactgattccgccacccca

SEQ ID NO: 6228 - DNA, 4181 bp, artificial
  synthetic oligonucleotide
cttttattagaaaaccaaatgagctggcttgcattggtgggttttctttcacctgctctgattgtagtcatcacaaaaaggagaagaaaatacaaggagagatattatatagaatacagatggtctccaacgtataattgttaactttatgatggtgttaaaacaatacacattcagtagaaaccatacttcaagtacccatacaaccattctgtctttcactttcaataccgtatttaaaacttgacatgaaatattcaaccctctattataaaatacgctttctgttagatgattatgcccaactgtcggctaatataagtgttctgagcacgtttaaggtagctaagctaaactatgatattcagtacattaggtgtattaagcgcattttccacttataatattttcaatttatggtgggtttattgggatataaccccatcatattttgaggaacacctgtattagtatattgatgacaacacatgaaatatatagagagcctaagggtactcaggaaggaacccttcctacaagagaaggtggattgactttccccgtgttgattaaacaatgccgtttttcactacatgtttacttttttttcaatggagaaaactaaccccagctggagacctctaggaggcctggctagaccctaagaatgaaatattagaagacagaacaaaggcttagagaactaatcatactataaatcagaatatgtgaaaaccaagaattaattttaaacaaagagatagtttcccgccacttgtcatttggaaattatgttcctttaagggaaaaaaagagtccaacaaccaggtaagaaaaatacctgccccttcttttgcaggtgcgtgaacagacagtatatatttacaaaagatataggacatcataaaggggaactccacatatatttcttgtggcttatgagttttactgcataatcacgacaatcatttttttcaccctatccagaagaaacatttcttaagaaatgtatatttagttctttaccaagttgtactggtaattctgtcttctcttttccttcagaacatgtactgtgaactttcagggctctgaatataaaacttattgcaatatcttaaataccatggccctgaagggtcaagggaagtcttctgggcaggtagtctctgttcaagctgggaattatgttaagctatgctgtgccttagtttctaccctaaaaattgaaggtagttataggaagcctgacatatatccctgggaaggaataaagataaaagaaggcattactgtatcaccaccaatgccagatacaatgggatttatcttgcttctctcacgtggtcaggatcaggccagttcaggttagtgtcctctttgttccccaaaccaaaaggtatttatgaaattgagcataaaacccaccactctgtggtcagaaatctaatcatatcacacttctgatttaaaacaaagccaaaaacaaaagtaatgcagtgatagctgttctctgttgaaatatcaagttttgtattcctgaatgtgtcatatagggcaaactgttcttcctccccctttgatctgattctccattctgtccttaatatcacccatagcccatctgatataatattttgatatttgtccctgcccaaatctcatgtagaattgtaatttccaatgcttgaggtggggcctggtgggaggtgtttggatcatggggacggatccctcatggcttggtgccttcttcatgatagtgagttctagcaagatctggtcacgttaagagtgtatggtacctctccccaccacacttgcttgttcctgctttcgccatgtgacttgcctgttctcactttgccttctgccatgattgtgagctccctgaggcttcaccagaaactgagcagatgccagcaccatgcttgtatagcctgcagaactatgagccaattaaaccttttttctttataagttccccagactcaggtatttattttaagcaatgcaagaatggcctaatacaccatccatgcaaagttcttccccagactttccagaaacctgtgggatcctagcgttttcctcatgccattccatctgcatagactgcatccccaatagcctttctctgcctcctacaaccctcaggtggtatgtgcattatgaagccttcccagatttctctaagtaaagctagcctgtgcctctgtgtgttccagtggtatctctatgcccctgtattagagcatttacctcagtggtaacattctgagtggtgatacagtagtgccctcctttatccttattcccttccagggacatatgtcagtactttagagtcaatttttgatatcatgtcctctccccatccccaccctagccctcaacactgtcagctccttctcagcagggaggctgtccttggtattgaagttctcagcacagtgcttcgcaaatggttggcacttagccaataaatgcagaatgaaacaaataccattgacatattctacactcagtgatacgatttggctctgtgtccccactcaaatctcatattgtagctcccataattctcatgtgttgtgggagggacccagtgggagatgagtgaattatgggcgggggtctttcctgtgctgttctggtgataatgaatggatctcacaagatctgatggttttaaaaacgggagtttctttgcacaagctctctctttgcctgctgccatcgacgtaagatgtgacttgctcctccttgccttttgccatgattgtgaagcctccccagccatgtagaactgtaagtccaataaacctcttacttttgtaaattgcccggtctcaggtatgtctttatcagcagtgtgaaaatagagtaacacagtcagcatatctaaaaattaacttaatgacccagcagcttatcaggtgctgccccttggccccagaatgttctcttggataatattttgccatctttaagcaggtaaagaaagtgctaaccaaagttattacgtatcttctgataagcaggttttactccttattcgaccagttttcatggacagattgattagccatttccacttaccccctctgtttgctgcatactttcaacagtctttgactcactagtctacatttctcatcctgtttagattaagcttttggcattaaattattgcttggtttagtaatagtataatagtcataaaaatcactgctatattattagttcatttattgtcatcaaataaattaactaaacaacaacacacttggatgtataatgctgtgaatgctaaaagccattgaactgtgcaccgttttgaataggtgaattgtatggtatgtgaattacgtctcaataaggatgttaaaaaataactcatacttcccagcatctaaggattaggatcaaaaaataaaaaaaactcatactttcttgagcatactgattattgctcacttttcatcattttgtgctttcccatccacttgctaagaaagtgaggttcagaaaggagaagtgacctgtttggcatgacaaagtttgttattggtagaatcagagctgggacccaagtctcttcatgcccagtctagaactcattttgtttttataattttgtccccgtgttggcagttgtacagtggcatttgaggaagttttactgagtcctaactcagtataaggacacttcttctgacattgggtgaacccttggactacctaaaatgctactcttttttgatttttaatttttatgggtacagagtaggtgtatatatctatgggtacatgatgtgttttgatacaggcatgcaatgcgtaataatcatatcatgaagaatggggtaaaatgctattcttatgctgaaaccttctatggttatattgattggaattgctcttccagggaaaagcagcaccatgatgtatgtataattataatgatttcattcataagatacacgatttcattcataagatacaaaggaaattgggttgttttttttttttttttttgtatttataagaaacaagggagaagagctacctgaacctatttaggttttggattcaggtgcaggggatttctgtaacagcttagcatgcttttactctaccttccatattgagtcaggatcccaggggggaaataagtt

SEQ ID NO: 6229 - DNA, 1971 bp, artificial
  synthetic oligonucleotide
cagtggcttacatttactttgctcttctgccccaccctgtgcttaacaagaactacaataaggttcattttcctaatcttttaaggctataggagatcccagcagttattgagatctcagttgtgactgaaatagaaaattgagtctaaacacctgcttagtttataactttatcatcaagatcataatatcttctattaaatggctattatgtgctggacaccgctggatgctttacaaatcaccaacacccatacccataccctcaggtagacagctctattttgcatgggaagaaactgaggcacaaagaaggaagttactgaacttcctcaaagtcactcattcggcaagccatggagctggaattggaaaccaggtctctctcacttcaaagcctggcatgcctcagttctcatagagattccaccaggcagtctgtttccactatcaactggtcttttgcctgtttgctctacagcctttactccaaattttagagaaacttagtcttccatgaagattataaatgaacctgctactcccaggatcttttgtacccaaacccaggaggtgccaccacttaaaactatcaggcacatcctaatctgtggccacactgtcctctttggtgggccactgtggccagtcttttctgcctgactccctctcagtcctttccggaattgctaggagatgggcagcagggacctaggactggccagctgcaagttcagggctgggatgaacagtctcattgaaagctcccagaaaggctttcactattatttattttttctagaaacattgctgagtataaattattactgccagcagatcagaagcagagcctgaacttctatgtgatggctcctacattctacttgtgttcctccaatatgaagatccaagtagtgggaagatgaatgctgtaaggcagacattgccactccctggctatatgatatcaagcaatctaattattttgggcttcagttttccttaccaggataatgggaataataatgcctgccatcacaggtttcttggcaatgattataatatacaatatgaggtgcctgacacatatattaggtgttcaagcaggtacactcccttccctgagcctgggtcacattctccctttcttgcctttacaaggccagataatggataaatgtgagtcagaaagcattaacaattggcaggcaaacagtaggcacatgtttaataaataatgacccttgaacatgatgtcaagggataatttttatagagacaaaaaaatctatcccagtcttttctttgtaaaaagaagctagggtagattgttgttgcctcttttctagacataggctaaatgttttatccaagtctctaaaggcaaacaatttcattaagtgagacccattagagaaaagatcagcccgagaatgtaagagttaagaattatagaacatttccaaatgaaaacagttttgctcctggatacatagagaaaaatctaacctagaaaaggtctgggtagttgagattttgccaggcatattttatggccagggaagaaaggtttataattgcaagcaccatttacataaaactattgctatatttgggatagtttgggatgtttgaaaacagattgttcccatgaaattacaaacatttctcctgctatcacaattttgcgctgttatttgccatggctttctggaagaaacaaaggtgaataacagtacactaaagtctgtttctaagactcatgctcagaattcacatgtgaatttcttcggtttgagttcatgatgtctcttctttgaccttcgctagattaatgtgattgttgccaaagtactcctccatcattttgtccagtctttccagattgttttctagtttttatagatgctcctatttctttgttcctttctatcatcatagtgacactttctttgaaataattttaattcc

SEQ ID NO: 6230 - DNA, 620 bp, artificial
  synthetic oligonucleotide
tgttctattttagaaccttgtcatcttgcactctaatagtgagcttagtcttttcaggaaagatgcaagatctgtataaagtaatacgtacatccactaagagtcctgaagcaataagagaatttcccagaatgcaaaaactgcagtgaagcgtctgtgctaggcctacaggagtattcactccttaaacaactaggaagagtaggtaattcattaactcaactaacatttgttaaaggtctatatgtgccagacactgttctaggtgctgagcaaccatacacctgttttggtgagaaaattacccaactccattgggtgagaaagttacccaactcctttatgggatgaattctggcccctccgtttatatgttgaagttctaatccacagaacctcagaatgtgactgtatttggagatagagtctttacagaagcaattaagttaaaatgaggtcacaagggtgggccctaatccagtatggggaaatttggacactaacacacaaagagggaagatgatgcgaagccacagggagaagacctacaagccaaggagagaggccccacaaggaactaaccctgctgacaccttgatctcagacgtccagccttcaga

SEQ ID NO: 6231 - DNA, 195 bp, artificial
  synthetic oligonucleotide
gcagagcgaccaccccatcttcctgggagagctggttcaagatttttctgctgtggaccagctgtcttctttcctgaggaggcccctctcattttacttctctgcatgttgcttctagttggttttttgaagttctcttcttctgcagattgctgtccacgaggttgagaaccctgctttctggaactcattcaa

SEQ ID NO: 6232 - DNA, 1369 bp, artificial
  synthetic oligonucleotide
tattaaagcagaatttgcacatggttaaaatatcaaatactatagaatagcttctatcccctttcccctggtgctctacctttatctgttcctccttgaattctttgatttttctgagctttatctctgtatctctaaataatctgtttatcctgccatttatttatttatttgtttatttatttattttgagacagagtttcactcttgttgcccaggctggagtgcaatggtgcaatcttggctcaccgcaatctctgcctcctgggttcaagcgattctcctgcctcagcctcccgaatagctaagattacaggcatgcaccaccacgcccagctaattttgtatttttagttgaggcaaggtttttccatgttggtcaggctggtctcgaactcctgacctcaggtgattagcccgtctcagcctcccaaagtgctgggattacaggtggaagccactgcgcccagcctatcccactatttatttatcttttgttgttgttgttgttgttgttgttgttgtgatggaatttcactcttgtcacccaggctggagtgcaatggcaagatctcggctccctgcaacctccgcctgccgggatcaagcgattctcctgtctcagcctcccaagtagctggggttacaggctcctgacaccatgcccggctaatttttgtatatttagtagagacggggtttcaccatgttgtccaggctggtctcgaactcctgacctcaggcaatccgccagcgccagcctcccagagtgctgggattacaggtgtgaggaacagcgcctggcccatttttatatattatctgtccacttactggcatgacagatgagaatttagctcagttacacaacccctcccccatcacttcttcctctccaaatatggttagagcatatttttagttcttccattgattttctttgtatttctttactttgaaagttgtaagctttctggccaggcatggtggctcacgcctgtaatcccagcacttcgggaggctgaggcaggtggatcacctgaggtcaggagttcaagaccaacctgtccaacttagtgaaaccccgtctctagtaaaaatacaaaaatgagccaggcgtggtggcgggtgcctgtagtcccagctacttgggagactgaggcaggagaatcgcttgaacccgggaggttgaggttgcagtgagctgagacagcgccactgcactccagcctgggcaacaagagggaaactccgtctcaaaaaaaaaaaaaagaaaaagaaagaaagaaaggaagttgtaatctttccccaaatggctggtgatcctttattatcatatttaagaatgaggcactagaaaaacaaataa

SEQ ID NO: 6233 - DNA, 1361 bp, artificial
  synthetic oligonucleotide
agcaaatctgtttacagcaacagcactaacaccaagagcaaccctacaattattatttctctctctaaaatcttttaatagtccactgtaaactttcgcatgattctttagcattccattctagactcttcatggtgctgcctaatttttcagcctcaactcctgatttttcccttatcctcttggccgcaaccacactcaacttcttgaatttatcagaactcccatattcttagccttctgtgtgcttgcaggtatgttgctgcctctgcctggaatataaacctccctatactcactttccagctcctaccaatctatctttttttttattttttatttttttgagacggagtctcgctctcgtcaaccaggctggagtgcaatgacgtgatctcggctcactgcaacctctgcctcccgggttcaagcgattctcctgcctccacctcccgagcagctggcgcccgccaccatgcctggctaatttttgtatttttttgtatttttatttatttttttttattttgtaatttttttgtatttttagtagaaacggggtttcaccatgttggccaggccagtctcaaactcctgacctcaggtgacccaccagcctcagccttccaaagtgctgggattataggcgtgagccactgcgcctggcctatcttctaatctctaggatacttccctggtccctctaggctgacaaagatgcctcttctgtgtgctcccacagaaatttgggcataggtcatggcactcatcactctggattatagtatagaatttgtttatacaactctccaagaaagagtagcttaattacaaggatgatgtgaattttggacattttcagctattatttcttgacgtactttttttggctatgcctaatttctccatttctcctctccttctgtgacttgatgacataagtgttgtgtcttttgttacagtgccacagatccttgaggctctatttatttatttatttttcagtctattctctctctgttgttcagattgggtatgtcctttttttttttttttctttttttttgagacaggttctcactgtcacccaggctggagtgcaatggcccaatctcaactcactgcaacctctgcctcccgggttcaagcgattctcctgcggcagtctcctgagtagctgggattacaggtaggtgccaccatgcccggctaatttttgtatttttagtagagatggggtttcactatgttggccaggctagtcttgaactcctgacctcaggtgatctacccgccttggcctcccagagtgctgggtttataggtgtgagccaccctgcccagccaggtatttcctattg

SEQ ID NO: 6234 - DNA, 2000 bp, artificial
  synthetic oligonucleotide
catcacttgtcttgcttgccccactcccttactggtttctcctgaaggtgcttttttcataaaaagcttctatctaaatcctcatctcagcctctgctctggggaacctgacccaagacaggcttgattctttatacataaaaatataacaaacactaataagcaaggtgggtctttgcttagttgtctgccggaggaaaggagagctctgtctttacaaagtcaagggatgataaatgcataatcaatcttcatgctaccaacagagaatattcctgaaaaccccaagtgaacttgggtaattctttcactctctcattgcatttaccttcattacagcaattcttttatggtgttacagtattttgtgtgtccagtcttgtcatcttggcagattataagccactaaaaggtagtaacaaagcattttcttcctgaatcacaagtcttacacaaaatggtgacttatagcgcagaatgcatgcttacataatagatagaaacaccattcaaaaatgtttagaacttttccccattctagtaaatatctattaatatttcattgatggctggatgcggtggctcacacctgtaatcccagcactttgggaggccgaggcgggtggatcacctgaggtcgggagttcgagaccagcctgaccaacagggagaaaccccatctctactaaaaatataaaactagccaggagtggtggtgcatgcctgtattcccagctacttgggaggctgaggcaggagaatcacttgaacctggaagacggaggttgcagtgagccgagatcacgccattgcactccagcctcggcaacaagagtgaaactctgtctcagaatatatacatatatatatttcattgactatcaactggggttctggcaacaggaaccagaaggcacacccaaatggaattctgaagacaattcaataaagagaatatttgcaaaagtgaaggcagggaaatgagaaccagcaatggatggtgaagcaccttggaacctgtaagtgggaagctgctgttatccttaggtttgaaggggaaagtaagagggggaaatcgtaggaacccagtgacatctatagctgttggaaagagccacaactcctgccaagacaggagccaggactccagcagaactcaatcactgccaatctgcaacttggcagggtggaattcaggacaaataaatattctcgtctctctcctcctactttcagatctcttcccgagattggccaaacccaactaaaagccaggcagcaaggtaacctgggtgataccatctaaaggagttcgaatcagagtagagaaggctagagaatgatctggaagggcaaatggggagtaatctgaatactaaacaacactctaaatcccaccccatgtgatatggtttggatgtttgtcccctccaaatctcatgttgaaatgtgattctcagttttggaggtgaggcctgttgggaggtgatcagatcatgggggcggacgtctcacgaatgatttaacagcatcccttttgtgataagtgagttctctctcagtcagttcatgtgagatctggtcctataaaataacatgggacctcccccttctctctctcttgctcccactcttgccatgtgacatgctggctggctccccatcaccttcgaccatgattgtaggcttcctgaggccctcaccagaagtagattgccagcaccatgcttatacagcctgcagaaccacgagcgaattagacttcttttttttgtaagttacccagcctcaggtattcttttacagcaatgcaagaatggactcacataccatgtttggcacttggccacatgtaaaacaaaccatggatgatagctcctgttttaagtctttatttcttaatactctctgtttactatttccattcatttctgtttcttcctatctctctttcttgggttcctggctctgtacttctccctgcttcttcctctgacatt

SEQ ID NO: 6235 - DNA, 15322 bp, artificial
  synthetic oligonucleotide
cttgaatctggaatatcttctgaagtgtttttttttcttctcttttcttcttttattttttccttttcttttcctatctgtttattcattcaacagatatttaatgagtacctttttttttggtcaggtatgttctctatgctagggacatggcagtaaacaaaatagacaaaaattcctgccttcgtgcagcttacattgcagtcaggggagaaaaatagtttattagatgatgatgcatgctatagagataaattcagcagggaagagagtaggaattgtgtatgtggggcggggaggggagctttaactttgatgagttgacctcattgaggtgacatttcagcaaaaatttgaagaagtgatccatttagatatctggaagaagagtgttctaggcagagggaacagttagtgcaaaggccctgaggcaggattatgcctggcaagttcaaggaacagcagattaggcaatgtacctagtaatagcagaagtaagagagggagagagttgaagggaaagagttgtgttgtgtgtgtgtgcgtgtgtgcaaactttgttttggtggaaaggggtagagatggtataaggccttacatgcttttactctgagtgagatgggaagccacggttcattttgattttgacatggatctgtttgctaatgcaacccacaaaaaagattaacaggctgtaaatgctaataagataaacagaaatattaatacatcagtgatgtggggggaatatgaagctttgatttgaattcagtgcattatatctatttgaaacctgtaaaaataaaaggaaggaccctgatctactactttgtgataaatctatccatctctcaactctaccaaagatagaatggtatctgatggatattcatgactgactatctatgactcttctaaatgtaaagggatgtaggaggacaccaccagcatggttcctcctcaagagtttccataaatttcttcatccccctttactccctgctccattactagtctggtgatctaaaaactttgcctctcccctatacaaggcatgcagactccacaagagaaggggctttgtctattcatgatacgcaaggtatttcagaggcacgaagcatccttgaccagaggactttgttgggcgaatttagaaaataaaagggtaacttctcaaatataatagttgagaatccctaatccatggggagtcatattttaatgtaccttcaggatgccttctttcatcaataaatgactactgaacagtagtggtgtacagagggttgggtggtggaaagcaatatgatctggatgcaagcagtaatggagtgtactgtctgttgagaatataaaaataataaaatcaactacaacaatcctatttttattattgccatgagccagtaagtctaaactatatcagtaataatataatcctcctgcccaatattttaagtcctaaacaataactgaaattactgatgagtttttttattgtgataaaatataggaaggaggagccaagatggtcaactagacacagccaggaggaacatctcccagcgagacaccacgacatcaggaacactgacacacacgctgagcagatattcagagggaaggcattgagagtggacagaagttcgcagatgttggcctgaagggggaggaagctgggaaggctgcacattgctgctaagtaccagaattccttcctgggtcccagtgacccctggggaagggatgagttgaacaggtgggaaatggcttgcttttgccatggacgacttctggaattctagcagcagaaaaccccacaaaacacatggactcttgagctcacaggaagagctgcttagagaggtggcaggtgcaggactccagcctgagtggagcccagagcgtttggtgcaagaacatctgcagtggagcatggccaggaacacccctcccccaagtttctctgtactcctctaggtgactttagccttagggtgactgtcagacctgggcagagctgggcggtcttgcctgtgggacaaggccagtactatctgagtgccccactgtctgctggcctctcctgggaccccagtctggccacacccacttgcagctacatgcccaaccagagtgcttcccaggggccctcatcctagcttctttgctggaagaccatgactgaccattggagaacgccagcagaccagccccgactgacacacgccagcccacacacaggatccctgcacctcggcctgcccccagctctttgccagcacgcagtcacccatggcctcccaccaccactttgccagcatgtacctctctgcaccaccactgccagtgcaagcacaccccaatgtcccccggcctgctgacacacaggcaccccaccaaaccatcactgccagcacaaatgcacacacaaacactggcaaccccaccctgatcatgacacagctgccacccatgtgaacacccacacagatgccagcaaccccactcccaccagcaccccacccctgctgctgttactgctgcagcaagtgtgtgcaagaacaatgccctgcaccagctgaagtgcatgaaccctaccatgctaccatggctactggcacacacaagcaagcatggatcctgctgccaccacccagacaaagtgctttggctggcaccacccacaatgttgtggccagtggaccaggaacaccttggcccctccagcacagcaggttcctaacctcaaggggccagagaacaaagccaagaccctcaaaccagacccctagagttagagcatgcagataaggggtgctgaactgagacttggcctcctaaatcttctagaaatgaagtcagttagctgaacccaccttataccacaataaaatccccaaggacatcaaagaagataaaagcaaaaaaccccatccaaaggacagcagtttcaaagcctgaaggaacatcagcccacacagatgagaaagaaccgccaaaagaactctggcagctcaaaaatccagagtgtcttcttaccttcaaatggccacactagccccccagcaatggttcttaaccaggctgaaatgattgaaatgacagacagaattcagattattaaataggaaggaagatcatcaacattcagcagaaagttgaaacccagcccaaggaatctaaggaatacaataaaacaatacaggagctgaaagatgaaatggccattttaagaaagaaccaaattgatttgatagagccgaaaaacttacttcagaaatttcataatacaattccaagtgttaacagcagaatagaccaagctgaggaaagaatctcagagcccaaagaccagttctctgaattaactcagtcaggcaaaaattaggaaatataataataaagaatgaacaaaaccttggagaaatatgggattatgcagagagaccaaacctatgactcattgacatccctgaaagagagggagaggaagcaacttggaaaacatattctccaaagacgacatgaaagaaaaaatattaaaggcagctagagagaagggacaggctacctacagagggaattgtattgggctaacagcggacctctcagcagaaactctacaagctgctaggcgcggtggcttatgcctgtaatcccaacactttgggaggctgaggtgggtggatcacctgaggtcgggattttgagaccagcctgaccaacatggagaaaccctgtctctactaaaaatacaaaattaaccaagcatggaggcacatgcctgtaatcccagctactcgggaggctgaggcaggagaattgcttgaacctgggaggcagaggatgcggtgagctgagattgtgtcattgcactccagcctgggcaacaagagtgaaactccgtctcaaaaaaaaaaaaaagaagaagaagaagaaaccctacacaccagaagagactgaggacctatattcagcattcttaaagaaaagaaattccaaccaagaagtttatatccagccaaaataagcttcataaacaaaggagaaataagatccttttcagacgagcaaatactgaaggaatttgttaccacccgacctgccttacaagagaggtcctgaagggaatgctaactatggaaaggagagaccattaccagccaccacaaaaacacacttaagtacatagaccattgacactattaagcaaccacacaaacaagtctgcacaataaccagttaacaacgttatgacaggaacaaatccacatatatctgtattaattttgaatataaatgggctaaatgccccagttaaaaggcagagtggcaagttgaataaaggggcaagaccaaactgtaggctgtcttcaagagacccatctcacatgcaatgacacccacaggctcaaagtaaaggaattgagaaacatctaccaagcaaatggtaaacagaaaaaaggaggggttgctgttctaatttcagacaaaacagactttaaagcaacaattatcaaaaaagacaaagaatgcattatgtaatggtgaagggttcaattcaacatgaagacctaactatcctacatatatatgcacccatcacagaagcacccagattcataaagcgagttcttagagacctctgaagagacttagataaccacgtcataagagtgggtgatttcaatatcccactggccgtattagacagatcgttgaggcagaaaactaatgaagatatttgggacctgaactcaacacttaaccaaatagacctaacaaacatcttcagaactctccatcctaaaaccacagaatatacattcatctcatctgtacgtggcacatactctaaaatcaaccacacgatcagttatgaaacaatgctcagcaaacgcaaaaaaccaaaatcataccaaccacactctcagaccacagtgcaataaaaacagaaatcaattctaagaagattgctcaaaactatataattatttggaaattaaggaacctgctcctgaatgacttttgagcaaacaattaaattaagacagaaatcaagaaattatttgaaacaataacagaattcatcttcctctcaaatgcacagccctgaaaaagaatgatatcatgtactttgcagcacatgcatggatctggaggccattatcctaagtgaactaattaaggaagagaaaaccaaatactgaatgttcttgcttataagcgggggttaaacactgagtacacatgggcataaagaagggaacaacagacactggggcctacttgagagtggatagtgagaggagggtggggattgaaaaactacctgctagatactatgcttattacctgggtgacaaagtaatttgtacaccaaagccccgtgacacccaatgtacttatataacaaatctgcacatgtttccctggaccaaaaataaaagttaaaaaaaaataatgtttttcaaaaatatctataaaacatgaaactcaccatttgctttcagttcttttggatgtatatccaggagatgaattgctggatcatatggtaattctattttttaatttcttaaggaaccaccatactgttttctctagtggctgcaccattttacattcccaccaataatggacaagagttccaatttctctacatcctcagcaacacttgttatttgattttttaatagtagcctttctaatgggtgtgaggtggtattttgttatggttttgatttgcatttctcttataattagtgatgttgggaatatcttcaagtgctttttgtattcctatgtcttctttggagaaatatctattcaattcatttccctagttttaaattgggtttgatttttttgttctttagatgtaggagttttttagtatcttctggacattaacattttatcatatatattatttgcaaatattctctcatttcatgggttgccttttcattctgttgatagtgccctttagtgcacatatgtttttaatcttaatgtaattcaatttaatttttttgttgttgcctctgcttttggtgtcatattcaagaaatcattgccaaatctaatgtcattgaaggtattcccctacattttattttaagacttcagaagacttcagttttagctctaatgtttgggtctttgatacattttgagttaatttttgtgactggtataaggcaaaattctaacttcattcttttccatatgcatacacagttttcccaactgtcttttcaacaaactgttgggaaaactgtatatgcatatggaaaagaatgaagactattctttcccccttcaaatggtcgttgcggcattggcaaaaagcatttgattatatataagcttatttgggggctctctattctattttattgatctatatgtctgtctttatggcaatactccaccgttttgatttctgtaattttgctgtaagttttgaaatcaagaagtgtgaggccttaaacttcgttgttcttttccaagattattttgactgttcagggttccttgagattttatatgaattatagaatagatatttctatttctgtaaaaaaaatcattggtattttgataaggattatactgaatctgtagatcactttgagtagtattgacatcttaacattattaagtcttccaatccatgaacaggggatatcttttcattacatgtgtctttactttctttcagcaatattttgcagttttttggtgtagaagtctcttgccttttttgttacatttattcctaagtattttactcttcttgattctatcgtagatggaattgttttcttaattttctttcttttcagatttttcattgtttatgtgaagaaatacaactgatttttgtgtgttagttttgtatcctgcaactgtgctgaattattttatattagttccttttttttttttttttttttgagatggagtctcactctgtcacccaggctggaatgcagtggcgtgatctcggctcactgcaacctccgcctcccaggttcacaccattctcctgtctcagcctgtctgagtagctgggactacaggtgccccactactccagctaatttttgttgtatttttagtagagacggggtttcactgtggtctcaatctcctgacctcatgatcctcctgcctcagcctcccaaagtgctgggattacaagtgtgagccaccacgcctggtctgttccttttttttctaagacaggctctagctctgtcacccaggctggagggcagtggcatgatcacagctcactgcagcttcgacctccaggctcaggtgatcctcctgcctcagcctcccaagcagctgggaatacaggaacatgccaccatgcccagctaattttttatatttttgtggagatgggatattgccatgttgcccaggctggtttcaaactcctgggctcaagcaatttacccaccttgaccttccaaagtgctgggattacaagtgtgaaccacctcctataatagttctaacagagtttcgtgtgtgcatgtgaaatctttagggttttctacatatgagattatattgtctacaaacagataattttacttcctctaaaatttgaatgcttttttctttttggttttcttgttaaatttctctggctaaaacttccagtactatgttgaatagaattgatgaaagtgggtatctttgtgtcacttctattcttgggagaaaaagctttcagtgtttcactactgagtatgttgtcaaatgtgggctttttataaatgttctttattatgttgaagtagtttctcatattaccagtttgttgagtatttttattattaaatgatgttgagttttgtcaactgctttttctacatcaattcagatgatcatgaggtttttgttcttcattctgttaacgtggtgcattacattgattttcaactgggaaaccatccttgcattccaggaatgactcactcatggtatataattcctttacagttgaatttggtttgctcatattttgttgaggattttgcatcagtattaatcagggatattgtatataattttcctgtagagtctttgtctagctttggtatcagggtaatgctggcctcatagaagaagtttgatagtgttacttccttttcaatctttttggaagagttagaggaagattggtgttaattatcctttaaatgtttggtagaattcatcagtgaagccagctgttcctgagcttttctttgttgggaggactttgattaatgatttaatttccttactagtcatagatctgttcaaaatttccatttcttcatgattcagtcttggtagcttgcatgtttctagaaatttgtccatttcatctagtttgccaagttattggtatataaatgtttatatacatgtactcccttatgataatttttatttctttaaaatgaatagtaatatcccctctttcacttataattttagttatttgagtccactctcatttttcttagtcaatctaactgaaaatttgtcaatgttgatatttttgaagaaccaactcttaattttgttaatttctctgttgttttactattctttattttatttatctctgctcttatgtttattatttccttctttctgctatgtttgggtttaatgtgttcttcttttctagttctttaacatttaaagttaggctgtcgatttaagatttttcttcttttttaatgtccttatagctataaatttcccttttagtgctgctttcactgtatttcattttttaaatgttgacctttcactttcatttgtcttaagatattttaaaatttctcttgtcatttcgtccttgacccattggttatttaagaatatcttgtttaatttccacatatttgtgaattttccagttttccttttgctattgatttttttattttcattctattgtgattgtaaaagctactttgtatgacttctgtctttttaaatgcattaagactcttttgtggcctcacatgtagtctgtcctggagaatgttccatgtgaactttacaaaaaaaaaaagtgtattctgctattattgggtggagtgtcctgtatgtcttttagattcaattgttctatggtgttgttcaagttccctatttccttactgattttttcagctggttgctctctccattgttgaaagtggggctattggagtattgaagtttcctcctattattatacagatgcctgcttctcttttcaattctgcaatatttgaagtttgatgcatatatatttataattattgtatatttttggttaattaaccctttttcattatataatattctacatcttttttatgttttttacttttttttttttgagatggagtctcactctgtggcccaggctggagtgcagtggcatgatctcagcttactacaatctttgtctcctaggttcaagcaattctgtctgcctcagcctcctgagtagctgggattacaggtgcctgccaccacacccagctaatttttgtatttctagtaaagatggggttttgctatgttggccaggctggtcttgaactcctgacctcaggtgatccacccaccttggcctcccaaagtgctgggattacaggcatgagccaccattcccagcctaagttttttacttaaagtctattttgtctggtattagtttagtcacccccgctctcttctggttagtatttgcatggaatattatttttcatcttttcattttcaatctatgcatgtttttaagtttaatgaaagtttcatgtagataacatattgttggatgttgtttttctatccattcagccaatctatatctttcgatttgggagtttaatccatttacatttaaagcaattactgataggaaagagcttactattgctacttaattatttgttttctccatgtcctacagcttttttttttgttcctcatttcctcccttactgccctcctttgtgtgtagttgatgttttgtagtaatacactttgattccattttcatttacttatgtatattttatagatactttctttatggctaccttggagactacatgtaacatactaacattataacaatttaagctgataatttaacatcaattgcatacaaaaactgtactcatttacatctctttcttgtccactttatgttattgatgtcacaaattacatctttatatattgtttacccattaatgtagatttgtaattattttttattcttttacctctaaaatcttgtagaagaataaaaagcagaattaggtactaaaatgacaataatactggtttttatatttgtccatgtatttacctgtactttatattttcatatggctttcagttactgtctaccatcctttcatttcgacttaaaagatttcctttagtatgtcatgtaatggtaataaatgccttcagcttttgtttatctgagaatttcttaatttttctgtaatttttgaatgacagttttaccatatgtagaattcttggttgacaggctttttttttttccacttcatccccttaaatgtatcattctactgctttctgtcctacatggtttcttctgagaaattattttattaaggattccttgtacatcatgagttacttttctcactgctttcagggttctctctttgtcttttgacagtttgattataatgtgccttgctgtggatctctgagttcacggagcttcttatatttgtatatttatgcattgcctcaaatttggaaattatgctaggggcaggtggggcaaggacaagtaaaaatgttacgaaattttctaccatttgtaatttcggtttttaaaaaattgggtatttgcttggttgctgtagatctttgagtgatttccagagctcctataaagtcattttagtcagttcctagttgtttatttaatgattccataggaggacaagggcttagagcttcctactgtgccatgttgctgatgtcactcccatgatgagatttaataatatacatgtaagaatcaagttagcatattattaactttttaatttaaaattattatagattcacaagaatttttttaaaaagtacagagagttctgtattcctttcatccagcttccctcagtggtaacatcttacataatcatattgcaatatcaacaccagaaagttgacatttggcagttaaaaaatgacgtttatggctgggcacagtggctcatgcctataatcccagcactttgggaggctgaggtgggtggatcacgagatcaggagttcgagaccagcctggccaacatggtgaaaccccatctgtactaagaatacaaaaattagctgggtgtggtggcgcatgcctgtaatcccagctactcgggaggctgaagcaggagaatcgcttgaaaccagaaggcggaggttgtggtgagccgagacagcgccactgcactccagcctgggtgaaagagtgaaactccatctcaaaaaaataggaatgacattcacccagtactcatactcattcctacaggaatcctggtcttctcaaattttaaaacggtgtccatcttgcctcaaggttgtaacagaggccctgactgtgttaaattctaaaataaggtgccagaaaatttatggaagacttgcgcacaaggtgacaaaagttgatttgctcccctcagatcattatatgcacaggacatacaagattaacaaagagaaattgttgagttgatgaggactatttccttagagaacaagttgttgcaataccgtgatgtttcccatcttgttccttttcctttaagtcaagttagagcaatttaagaaaaccacctggatagctgtaccctctggaatttgggggcttcagggattcaactggaattggatttataagacttcctcgagggcaaagtgagaaaagatgctactgcagaagtgaactgcattctcatcgagttgatgggatgcaccagagtaagatttcttgagaatctggtccttaatcctgtcagactcaatgccctctttttataataaatattttaacatttctctttaatatcctgaaatgaaatatataaataatacctacacacaaaatttcaaaaacaaataaagatgtaaacaaatagaacagtaatatgaaggtgaaatgaataaaagcaatttataataaaataataaacatttcaatatacaaattccttggcatgactatactagatcacataatgaatgaaatgcttgaaactacttatagtgaacaagtctggattgaagtgagtaacaatatttaattgaatataatcagtatcttttctttatgtttaaccatttgaaataaggattaagtgtattcctatacatacatacagaaccaccataattatagcagctactgatgacgtcttacacaagtgtgccgtattggttatttatataccacacatggtgtgtctgttagtgaaatgatttttttgaaatgacgaacaactcttgggaaagttctgaacaaaacaatgtataatcgtcctttgatttatccagtgttttcaattttggaaaatttagtgtatagtaaatcaaggcaaaaatattttatatttatgtttttctttcatgtatacatgaatgtccagcgggtcatttgaaagccatgcaatatctgcaacaagtgttcatttgctggcagaagccttgtttctctggcctgtatatagccaataccattgaatctcatcccccaccattgcaacagccaaatgtgtcccatgaatttccaaatgcccccagtgagtgggcctcttctgttgaaaaccacaattttagattttagtggaccttttcataactgaaaaccatcaaacaagttatgagatctgtccaggatttcatcagggctgaggaagaaattgtttgacagaggagtagtagtaagaaagaataaaattgtttcctgcttgcactctatagagtttagtaggttttaacaaacgattaacaacgtattaacaatgatgctagcaacactagaacaatggtcagtaaacagcaagtaaaaggactttcaggtagaaataaactcagtatgtttaaggaatagtaagatggctggaatgactggagtgtaatgccagtatagaaagtaagagaaagagtgaaaagatgtgaggtcaaagagcaactagattatgtaaggccttggacaagagtttaacttttcttttaaatacaatgggagacagagctacgacatgaactgatttgtgtttataaaaaagcataaaagttacactgatctgaagattatggattgtaaggaaataagaatggctgcaggggaatatttaaaaggctatttcaatcttctaggcaagagctggggctagggtggtagcaatcaaaaactaaaacacatctaggaagtcagggtgattgtacttcctgatgaacgggtgtggatgggaaaaggagggaagccataatggctttgactgactaaaagaatgacgaagcccttgactggggtagggaaacacttgagaatataatttgataaaccattaaaaagacaactgttttccccttttattaaaacatgtcttattaggaggaagacaaacgtgtcatgtacatagttgaggactcccagttagaaaataaccgtcttgggaccaagcatggtggctcacgcctgtaatcccagcactttgggaggccaaggcgggctgatcacttgatgccaggagttcgagaccagcctggccaacatggcgaaaccccatctctactaaaaataaaaaaatcagccagctgtggtggcacatgcctgtaatcccagctacctgggaagctgaggcatgagaatggcttaaagctgggaggtggaggttgcagtgagtcaagatcatgccactgcactccaacctgggtgacagtgagagactctgtctcaaaaaaaaaaaaaaagaaaagaaaacagtcatctcagaatcttcaccatcaccatcattaatacctttaagcataaactgggctaaatctacctttaagcaatttccatctgagattcaaatctaaattttgcctctcccttgttcttaaaccaggatttcgacataatttcttcatctgtaaaactttcttaagaataactaatttcacaagatagtatgagaattaattattgaatggttacgtaagtctcagcaaatattaaaactgatatttcaagggctgctattaaaatggaaaagtgcttttttgctatctctggattcagcaggagaaaaattaacaatcatatgctcattctcattaaatctggggaacaattatggaactctatgtgccagacacaggtgttggggggaattgtgcgtgggtgggcataacgatgagccagatgggcatggctgctctcccaaataagcccccaagttgttgtccatacatggaaacaaaaactgaaagcaacctgaattagtactgaatttagacgaattgaggtgaacaaaagtgtcaaagtattatatctgtccaaattgttgcagctccttcaaggcgccattttattttctggcagaggccagatatcatttttctttttaaagttttaaagtgtcctgaggctcccagtttccaatgtggatgtgccccttttgggcactgctagaatgaacacacacattagttcaggctctgtgggacaaagttgaataagggaaagaaaggcccaaatcacaagataaggttacatttggtctgatggcaaaggaagaggcacagcatgagggcagttgggattcagtgttgggaaaggaggtaatgatgggtgacagaagcaagcagatgagggtaccagaaatcatttagtctattacactatttttcctagggctggctgttaggggagctggcagtggagttaactgccacttgggagaaacaggattttattgagtctctctaaggtgctacagcagtgaggttttctcctctattcctcttttccattgctttactagtcaccctttctgccctttgcctacttttctcagtggtgaagctggaggaatcaaacataaccaagagaaagcacccactggtggtactcactgattaaaatcttccctagtgagccattcggccttcacacctcacctcctcacacagggatttggagcctcaggaaatcctttgataaacagacttctttttgtctaaatgaaagcaacaa

SEQ ID NO: 6236 - DNA, 542 bp, artificial
  synthetic oligonucleotide
ttacctacagatttaccttttctggagctttgtatttctctgagtgaatcagagctaccatctagtgtcatttcctgtcagtgtgaaggattttattttttctagaaaaacacctatgtctatgagaaataaggttactttgggtttacaaaatactggataactaacccagaggcagatacaaggctaaaatggaaaggatacaaatattctatttgtatcccattaattcctggtacattcatattttgacatggtgtttctacatattttggaaaatgcaaccatgaggtggccaacaaatctttggattatccccctccaacctatgtgagagtaggttgcagattccttctttgaaaaaaaacgttaataggaaaatcttgcagtagagagcacttcgtcactttgatatggacatcaccactaccacctcaagctaagagagggtccacgagataactcagaataacagaggttgccttccatatggagagactgacatctgcttctgccccaggtgctgagctgtagaaacgtat

SEQ ID NO: 6237 - DNA, 1779 bp, artificial
  synthetic oligonucleotide
aaaacagaagaggcagtgaccttctccgggtggggtctatggccctttactgggtacattctgtacacacaggcccctcctttgcctgaagtcattgatgaagacttcattacggagggtttggggaaaggtgggggtctggctgggtaagccggcgtcccagccccgctacagccccgcccagatctggcagagccgtgggcgaacccaggcgggcagaaaggcggggcgggcggctgccaagccggccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctga

SEQ ID NO: 6238 - DNA, 2012 bp, artificial
  synthetic oligonucleotide
aactccaattcatgctataatatctgcttaatatttgaagccattgactaaagtttgaatatttagagcaaacaacataaatgtgaaaaatcatggacttatcccagaggagaagctatgactccccatggactggcatgctcttctccccataacacttttgctcttatgatcttgcttgtgctgttttaaaacataataagacacaacagtttcatgcaattttgagaactcacagaaagcttctggccagtgtttttcataaaaacatcttggccaggcacggtggctcatgcctgtaatcctagcactttgggaggccgaggcgggtggatcacaaggtcaggagttcgagaccagcctggccaatatggtgaaaccccatctctactaaaaatacaaaaattagccaggtgtggtgacagatgcctgtaatcccagctacttgggaggctgaggcaggagaatcgcttgaacccaggaggcggaggttgcagtgagctgagatcgcaccactgcactccagcctgagcaacagagcgagactccatctcaaaaaaaaaaaaaaaaatcttgattttcatcacacgtttataaagactcaactgcagtaaaagatgccgtcgtgattctttattaacttcctggatcccctcacagaatcctttatagacaaaattgtgctgaatttaagtctcttttgagtgaccagccttctgtgacacttgatgtagcctaaatcaaagtcaccagtgatgttagtggctcctgaacatcagcataaattgggcaactttaaaggaactgaaatttcttgtaggtttgatacagggaaattaatcaaattactctgaaacttttagagaacaaagttttatcatatccagaaaaaaattaagcatgctataaacatgctaatctttttaaagaatttgttcacgctggtagattatttggcttgtgtttcaattatttttaaaccttcattctagttattaaatgttaacttatttgtttagaaactggaggtgttaatcagcctaataaaagtaggttctttcaaatgatgctttattctctcttcttgttaaagataagagtgttctgcaaagcagggaatgtcagaatgagaaggagccttggacagtacctacccaatatgaggacactgggcccaaaggcagtgaaaattgctggatgccaccaaacccaataatgtacaaactagcacaagggttttctgacactcagtccaatgctcttcttatcaaccaagctatgtcaacatgtctcttttccctcaactagcaacaatcatcctggccttgtttgttctcccacctttgctttgtgcagcaaaattttaaacagaggggatttaaataaacaggtttctaaagataagagagcaaaagtcagcttcatcttctattatgacctgaaagatggaaatgtgttggtatcatttcccttttcccccatcttatccaatatgaagggctcaagctgccatttccaaacagccattaagtgtggtatttacattggatttcattctcagttgcgctgaatttcagaatgtttatgaaaaccccatgctttcttatgaagagttgagagcaaagagtgctgccattagggacacagaaaagatggtcatgtttaatgctccaggtagagaataattttccttaaggattagggtagattccaaaaacaacaataatttaatttctggagcacaggctacactctgcctttcactgtcagccttcacataccttagccttgtgctgtattaaaatgggctccccacaacctggatctcccaagaccgctatacagaaggcttccttctgataaaccctggtctataaggtaatggagtatacatcaattaatacagatctcttgcttatcctggaaattacccatgcaagatgtataatgctttttcatgtggactatgttgctaccccaacattaaatgaaaatgcttggactcaaattct

SEQ ID NO: 6239 - DNA, 1766 bp, artificial
  synthetic oligonucleotide
ttgaaataaactctcatttggtttactttttattcactgttgagcctaaattggcccatccatattttactgacatatttatgagactttaggctgaagaaagagtgaattttgttcaggaaaacaccaaattagagtttcacaaacttggcactgttgacattttggactggatagttgtttgttgttagggggctgtcctttgttgtaggggcaatttaagatgtttaccagcatccctggcctctacccactagatgccagtagcacccgcacacacacccccagcgtgacaaccaaaaatgtctgcaaattaccaaatttgctctccagttgagagccactccacatgataattcaatataactcatggtatatttatcaggtatctactaaatgagatactgcagggcttcaaaggtaagttaagccctgtgtttatcctagagaattttctaattaaatgtaaatctataaatggcttgtgtttttttttctctgctaccagaatttgaaagagaactaatagatttggctcacttttaaaaatttaagacactcacatatagcacctactattactattattgccaacactgtcctaagcattttataaatattaattcatttaattctaacatgcccatgaaaaactattattatcatcatcactatttacagatgaacaaactggggcaaagaaagtttgtgtaacttgcctaggtagggagtatgagagagagagtatttcacctttgtggctgtggaaacttggttgagctgaaagtgtgagcaaaaaaaacacttctagtcttcccagtggaactgtatcctgctcgtccggcactgattagaaaattgtactggatacagccagcattgccatcattcgtactcagggatctaaagggaaggctgaattgttaaaccattattcagcttcccaacctggctgtgcaaataaatatcaagcccatgacactgcaaagagagtaggtttcagaaggcagatttggagcattttgcttttactattggttgatagatcccagaattgaccatgctgtgtgaattcctgtggagtgggtctcattctgcagctcttggattctgtcttctctcctcacccccacctgactttaggtctttattttagccaaacaatttcagttgtcaggtttgcttaacatgacaaacatctctatttgttggggattgggctttcaggtccgaaatctgtgctatatgataagcagacgagagaagctgaagctgtcacacaacaaaatacaggaacagatcttcggtttgcaagtccagcttcttaaccaagaaattgatgcaggtaacctgtatatttaaaatgtcctaacaaatatgtagactctggttatatcctatcttaacaatttaaatttcatgccagtcattccacttaaaaatcttttaaaattcttgtcagatatctcatttgcttcagtctaatcttaatataacctggcccatttcactgtcagttcataaggcaagaaatcccagggtggggtaggaggagttgcaggtctagggcaggtaatctaggtcccaaacagatattcgaggccattagtggaagccatgaaattattctgtaattatcaaattcatttagaaattgacgggataggatctaacacgtttccagaaaacacttaattctagggttactcatcttaacaatagtctattaaaacaaatccttagccagaagtaagtttggagatctg

SEQ ID NO: 6240 - DNA, 3358 bp, artificial
  synthetic oligonucleotide
tgagaatggggttgtggagctgtgttgttgaggaatgtgttttccatatgatttgaaaatgaaatcgagcctttcctcttcccccaccaaaaacgtttttgcaagagttggccttcagccaccagggtcttctccactaggatggagaggagctttgttctttcctttttaacctgtttgggtttaaccgtcccagtctctctctgttcggcatttaacaacttttcttggttgaagtaagaggtaaactagctattcgtccaaactccaaagctcaggttcactgggccgtaagcctgtacccaccatccccgggcctgccaggggcggctttgcaggattcttccagccgcgggggacggggacggggacggggcggggtcccaggcccatgccatccacctgccaagccgccgggtcccgggaggcgtttcccctcccctcggcccgctgcctgaccttcgagccgcctgagaaatctccatcctggcgagtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacaggtaccccgggtgcagcgcgggcacctgaagccccgtccccgctccctgctgcccagccacccctttgtggtcacgggccgggcctaaatggaacatttggcacccccgtcccctccccaccggcttctactagggagcatggggttaaaagtcgctattgcaaaagtcgtgccactgctcttgagccttatctaagactgataggatgaaggcctttgtagtctgaacactgccccccacccccgcttttttttttttttttttttccgagacaaggtctcagtctgtcgcccaggctggagcgccatggcccaatctcagctcactgcaacctcctcctcccaggttcaagcgattctccggcctcagccttcctagtagctaggaccacaggctcgaaccactaagcccggctaattttttgtattttttgtagagacgggctttcaccatgttgcccaggctggtctcaaactcctgacctcaatgttcctcccacctcagcctcccaaagtgctggaattacaggcacgagccaccagcaccggcctgagcccatttttaatagccaaaaaacatttcaaatgctgctgcagatgcaggcagtttgtatttgggaccagtttgggctgaggtttttttgtttgtttttttttttgttttgttttggtttggtttggtttggtttctgtttttgttttgttttgttttgtttttttgtttttttggttttttttttgagacggagtcttactctgtcgctcaggctagaatgcagtggcgcaatctcggctcactgcaacctctgcctcccgggttcaaacgattctcctgcttcagcctcatgagtcgctgggattacaggcacccgccactgtgcccagccaatttttttgtatttttagtagagatggggtttcaccatgttggtcaggctggtcttgaactcctgacctcatgatccacccagctcggcctcccaaagtgctgagattacaggcatgagccaccatgcccggcctgtgtttcttttttaaaatgtagtttattgaaggaaatattagatcaaacattatttttcttttttccctctctattcatttgcccatcatgtgtaggaccacttacttcaaagcagatagctaccctgggagaaggatgaagatgcaggccatttttatttatttatttagagacaggttctcgctctgttgcccaggctggagtgcagtggcatgatcacggctcattgcagcctccacctcctgaactcaaatgatcctcccacctcaggctcccgagtagctaggaccacaggcatgtgccactacacccgctaattttttgttgttttgtagagtcagggtctcactatgttgcccacaccagtcccagactcctgggcccaagcaatcttcctgcctcagcctcctaaagagctgggattacaggcctgagcccctgtgcctgacaaatgcaggcagtgtggatcattcctggaaaccgcctactcagggcagaggtacagaaagaaaagattgctcttgaaagttgcctgtctttcctctcccacatgggattcttatctgattttttctccttttcagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactggtaagttggttgaagatgtttcatggtccctgttatcagctcttttcttttgcctatgtgtctctccctgtcacattgcatatcctgctctgatctgggggaagtgtatccagccttgccagttcttagccaggtgttttactgtatttgttctgtgcgatgacctttcactcacctctgttaccttcaatagatctcccctgcgaccatgtcttccattaagattgagtgtgttttgccagagaactgccggtgtggtgagtctccagtatgggaggaagtgtccaactctctgctctttgta

SEQ ID NO: 6241 - DNA, 1455 bp, artificial
  synthetic oligonucleotide
tttctggcaattttggtgaaaatacagatggaaccttctagacatcattgacatagtattctgtgccctagaccagatcgtatcaaaccagaccaaatggcaatgcacaacaaaattttactccaggcctctaagcaagtggttggcaataataaagttctgtcatgatttcactgaagacagaatttacatgctatgttgcagttaggcctctcagccaaatgttgcaaactcccaatttccagcccattgtttccaaaaatactttaaaatgtttctcagaagcatggtaatatcttttctggattccagggtttttgatagatctgtctgcattgtctggcagcttctttttttgttgtcgttgttgcttttcctaattacctccaagtatgcttaaatttatgccattaaagaaagctctgactcacttaaactggcaaaaccacaaaaagtatagctgctcttgtgttttggggtctagcggtttcttcattttaaagaagagagagagaaaaaaacctgtcaaggcgccagagtagtctttcttaactattgttaattatgccagaaagccaaatacattaaacaaactgagcagtttaattacttaaatatccagcaaaaatccaaatctgccattgaatagacaaaaagaaaaaaaaagattcaatttgtttgatgagattatatttgtatcaattttgtttcaaaactgcatttgatgagaaaaaattacagagaaaacccaattttcaaatggctcaatgtaagtgaaaattatcacatgtactaggattctcagttgaaagcaatagaaactaactctagcttgatttaaataggagataaatacactgcatgaacaggagtaagctaataaattgtaaaccaaagatagtgctagaatattaggatggcaaaagcacaatgaaattccagaggaaagagtgattgattctgggtagcatgagcattccactttatggaagtggtgtctgaaccaagtagtatctcttctttataatcattccaatatgtagcttatctcgctgttagattgacattcccttgggatttcctattttgtcagcatctagtgccattctttgtatacattaagatgattcaacatgtgtttattaaagaaaggttaagtactcttaattcaaaaatccacaaatccaaaatgctccaaaatctgaaactttgagtactgatgtgacactcacaggaaatgctcactggagcattttatatttcatatttttggattaggtatgatccaataagtataatgcaaatattcccaaatttgaaaaaagtaaaaatttgaaacattctggtcccaagtatttcagataaaggatactcaacctgtacctacaatatgataggcacagtgtattacatactagagatatagaaatgagcaaaaaacaaaaataaaaaaaa

SEQ ID NO: 6242 - DNA, 14311 bp, artificial
  synthetic oligonucleotide
tctggccacagcattgcatctcttgtctctctgtctccttctataatcttggtttccctcacgatgagccttgggaactgctgaagtcctcttccatttcctcaaggattgaagggctagcctcttttctggcagacttcatggtgttttactatttatctgctgccaactacttatgaaaacctatcactttcagaaatctctggaagataagcagacaacacgtatgtatttatgtatacttcaattcatagagaaatatatcaagctctcccaagaattatctcaccaaggtccaccaattttcatggatgcgtagagatgggtctgtagtttatagcttgacaagtatccagctaggaaatgaaacaccaaccttactttctttcagggagatcctattctcctggttcttccctccacttaactttgggaaggggtgtcccctaccctttcctacatagggagggaaaaaagtcttctcgttgtaaactggcagttttgacaataataataatttactatcctctcccttccccttaactccataaattgggcagggagtcagggcttggggcagtggctagtgctttcactgtcagttcttccaccttttgtaggtctttataaaagtttctaggggagatgccaagatggttgactagaagcaactagtgtgtgctgctctcacagagaggagctagagtgaacagtaaaccatagcgcttcaaatagattatccagggggacatattgggattcattaaggaagtaacacaacccacaggaagtagagaggagccaagggaagctcccaccatggggaaatggtgagcaagcaagatctcccagggatgtacacttctgccatagacctttgtgatcctggggataggagatcctccctggcccgtttcccctgggtctccagactgacatggagagtggtgtggtgtctaggcagagctgtcactcacactaatgtgtggccccaagtgtcctagacccctgagcaccctacgccagtttctgtagcttcaccaacaagagaggccacaatctctcatacactctcaggataggtgctgcatctatggtgctgagatgcagatgaacagctggccttgcctccattatacctcaccaggcaaagccaaatggcctgggaggactccagtgcagccatcccagccctgtatgagcagtcaggccagtcataactctgcatttctctaggatagagctcccagaggttactgactggcctgcagcttttgctgctgccacagctcccaccccttctgccttcagtctggggtgaagagcccaatatctatcacaggcctccagcacatcacagctgccttgtggaaaggtggccagactgtttccacgtgcgtaccggccccggctattcctcactgggcaggtcctcctaacttgggcccccagcatggctactctgctcccacctgatcacttcagtcagtggtgactctgcaattttctgggcagaaaaatccaagagacaacccagaggcttttctgccattgccactgcagtggtattgcccatattgcctttgggctggggaaagaataaggacaccgattgctttgttgaacctccatcatgcttcagccatatggagaggagcccagtctctcttctctgtgaccctaatgtggtttggatttgtgtccctgctgaaatctcatgttgaattgtaatttctattgttggagctggggcctggttggaggtaaatggatcataggggcaaatttccccctttggtactgttctcatgatagagttttcatgagatctggttgtttaaaagtgtgtggcacctcccccttctctttcttgctcctgctcctggccatgtgaagttccagctaccacttcaccttccaccataattgtgagtttcctgaggcctccccagccatgcttcctgtacagcctgcagaaccgtgaaccaattaaacctctttctttataaagtatccagtttcagttatttctttatagcagtgtgagaatggactaatacagaccctcttaccccttgcttttcatcaggcagggcccctggcatgggaaaagtgcagccatcctactcccagtagaactttgtattggcagtggctctgtgtctttccaggatgaacttcccagaagcaactgacagcccctttgtcactgccactacagtggtaccacccctgctgcccttggattagggaagggacaaacagcctgagtactttacttgcaccctcagcacacaacaaccacaaccaccatttggagaggaggccagtctctcttcattgtgagccccagatcccctgctcttcaccaggcatgtcccctggtttgggcccacagtgcagctgccccacctgaagctgaaaattcccattggcagtggccctgtatttctctggggtggagttccaagagacaactgacagcccatctgccactgcaactgcggcagtgccattcttgttgcctttgggctggcaaaaaacaaacaaacaaaaaaccacaaaggcactgatcactttgctggcacctccagtactccagtacactgcagtcactgtacagagaagaggacagatgatcttctcctttagctccccacccctccactcttcaccaggcagctgccccctccctccatcttgagcctgcaatgcagccaactcacacctggcttgttgttctgattggcggtggctctgtgtttctctggggtagagccccaaaacacaagtgaaaggcactatgccattgccactgccaagggtctccctcccatgctgcctcaaagctgaagaggaaacaaaaagcctgaattcccaccagggctgcactgtgcaacccaggaatgtcaagttgatatctgtggccagcacttgagtgggagagatgcccacactctcacagcaatgagaaggagcatggctgcaaacgtgaggaaatacagaggagccgtgtggccgagtaagagcctatctgccagccattatgcttaagtacaatctactggatgacaacccaaacttcaacaccaaaaatactttgctaatatacccctctgtgaaaccaaggacaagaattcagccacaaataaagatgctgcacaaagtctcagccttctgaaaacatgcagaaacaaagctgactatactcaaattacatataccacagttaaaggtacatcagcccacacggatgagaaagaaccagtgcaaaaattctggcaactctaaaagccagagcgtctccttgcatccaaaggaccatactagctccccagcaatagttgttaacaagaaaaaaataggccagacatcatggctggtaatcccagcactttgggaggccgaggcagatggatcgcaaaatcacaaagttaggagttcaagaccagcctggccaacatggtgaaaccctgtcttgactgaaaatataaaaattagccgggcatggtggttcatgcctgtaatcccagcttgaacctgggaggcagaagctgcaatgagccaagattgcaccactgttctccagcctgggtgacagagcaagattccatctcggaaaaaaaaaaaaaagaagacaaaataaaatgactgacatagaagtcagaatctggatggcaacaaagataattcagattcaggaggaagttgaaacctatttcaaggaatataaggaatccagtaaaactaatcaagagataaaagacaaaatagatattttaagaaagagcaaaaccaatctgctagagctgaaaaactcactacaagaatttcctagcacaagtagaaatatcaagagcagaataggccatgatgaggaatgaatctcagagcctgaagaccagttcttcaaattaaaaggcagatgaaattttaaaaaaattaaacaaataacaaaaccttgaataagtaagggattacgtaaagagttaaaacctacaactcataagcattccagagagggagagacagcaagcaacttggaaaatatttgaggatattgtctacaaaatttgtccaaccttgctagtgaggttgatattcaaattcagaaaattcagagaatccctgcaacatactatacaagataaccatccccaaagcaaatagtcattaaattctctatggtcaatgtgaaagaaaaaatacaaaaggaagctagagagaagggccagatcacctaaaaaagggatccccaacaggctaacggtggaacttttagcagaaaccctacaagccaaaagagactggggcctatagtcagcatcctcagggaaaagaaactgcaataatgaactttatatccacccaaactaagcttcataagtgaaggagaaataagatcctttttagacaagcaaatggtaagataatttattgctaacagacctgccttacaagaggtccttaaaggagtgctaaacatgggaaaaaaaatactgttactagacaccaaaaaaacacacttaagtacattgactattgatactataaagcatctggacaatcaagtctacataacagctacctaacaacacatgacaggatgaaatctgcacatataaatattaaccttgattgtaaacaggctaaatgccccacttaaaaggcacagagtagcaagttggataaagaaggaagacctaactgtatgctatctttgagagacccatctcacatgcaaggatacccatcagctcaaagtaaagggatggagaaagatctataaagcaaatggaaagcaaaaaataaaaaagaaggagttgatgttcttatttcagacaaaacagactttaaactaaactgatccaataggacaaagcataatattatatgataataaagggttcaatttaacaagaagacttcactatcctaaatatgtatgtactcaacactggagtaccaagattcataaaagaagttcttagaggcctatgaagagacttagataagcacaaaataatagtaggagagttcaacactctactgacattttttggacagactaccaatgcagaaaactaataaagatattcaggacctgaactcaacacttggccacatgaacctaacagatatctatagaaccctccaccaaacaagaacataatatacattattctcatccgtgtcaggcctctgagcccaagctaagccatatcctctgtgacctgcacagatacatccagatggcctgaaggaactgaagcatgataaaagaagtgaaaatggcctgttcctgccttaactgatgacattaccttgtgaaattccttttcctggctcatcctggctcaaaagctacccgactgagcaccttgtgacccccacccctgcccgctgagagcaaccccctttgactgcaattttcctttacctacccaaatcttataagacggccccacccctatcgccctttgctgactctctcttcaggctcagcccacctgcacccaagtgaaataaacagccttgttgctcacacaaagcctgtttggtggtctcttcacacggatgcgagtggcgctgagtctttctaatcttccttttctacagacccatctgacctctcccctcctccccaggctgctcctcgccaggccgagccaggtcccaattcttcctcagcctctgctcccccaccctataaaccttttatcacctcccctcctcacacccagtccagcttacagttttgttcaacgactagccctcccccacctgcccagcaatttcctcttaaaaaggtggctggagctaaaggcatagtcaaggttaatgctcctttttctttatccaacctctcccaaaatcagttagcgtttaggctctttttcatcgaatataaaaacccagacaagttcatggctcatttggcagcaactttgagacgctttacagccctagaccctgaaaggtcagaaggccatcttattctcaatatgcattttattacccaatctgctcccaacattaaataaagctccaaaaattaaattctggccctcaaaccccacaacaggacttaattaacctcgccttcaaggtatacaataatagattagagacagccaagtagcaatgtatttctgagttgcaattccttgcctccactgtgagacaaaccccagccacatctccagcacacaagaacttccaaacacctaaaccacagtggccaggcattcctccaggcccgcctcccccaggagcttgctacaagtgccggaaatctggccactgggccaaggaatgcccgcagcccgggattcctcctaagcaatgtcccatctgtgcaggaccccactgaaaatcggactgttcaactcacctggcagccactcccggagcccctggaactctggcccaaggctctctgactgactccttctcagatcttcttggcttagtggctgaagactgatgctgcccgattgcctcagaagccccctagaccatcacggatgctgatcttcaggtaactctcacagtggagggtaagtccatccctttcttaatcaatacagaggctacccactccacattaccttcttttcaagggcctgtttcccttgcgtccataactgttgtaggtattgacggccaggcttctaaacctcttaaaactccccaactctggtgccaacttagacaatactgttttaagcaatccttttaattatccccacctgcccagctccctgattaggtcgagacattttaattaaattatctgcttccctgactattcctgggctacagctgcacctcattgctgccttttcccccagttcaaagcctccttcacatcctctccttgtatctccccaccttaaaccacgagtataggacacctctactccctccttagtgatggatcatgcaccccttaccatctcattaaaacctaatcacccttaccctgctcaacaccaatatcccatcccacagcacgctttaaaaggattaaagcctgttatcactcacctgttacagcatggccttttaaagcctataaactctccttacaattcccccattttacctgtcctaaaaccagacaagccttacaggttagttcaggatctgcgccttatcaaccaaattgttttgcctatccaccccgtggtgccaaccccatagactctcctatcctaaatacctccctccacaaacctattattctgttctggatctcagacatgttttctttactattcctttgcacccttcacccaagcctctcttcactttcacttggactgaccgtgacacccatcaggctcagcaaattacctaggctgtactgcctcaagtcttcacagacagctgccattacttccgtcaagcccaaatttcttcctcatctgttacctatctcgatataattctcaggaaaacacacgtgctctccctgctgattgtgtccggctaatctcccaaaccccaatcccttctacaaaataacaactcctttccttcctaggcatagttagtgaggtcaaaattcatacacaagagccaggaccacaccctgtagcctttctgtccaaacaacttgaccttactgttttagcctagccctcatgtctgcatgcagtggctgccactgccttaataattttagaggccctcaaaatcacaaactatgctcaactcaccctctacagttctcataacttccaaaatctattttcttcctcacacctgacgcatatactttctgcccccctccactacctctcagcaagccgaactcagtgccttaactcgagccctcactcttgcaaaaggactacgcatcaatatttgtactgactaaatatgccttccatatcttgcaccaccatgctgttatataggctgaaagagatttcctcactatgcaaaggtcctccatcattaatgcctctttaataaaaatgcttctcaaagccgctagtcattcactgcaaaggccatcaaaaggcattagatcccatcgctcaggacaacacttatgctgataaggtagctaaaaaagcagccatcaaaaggcatcagatcccatcgctcaggacaatgcttatgctgataagatagctaaaaaaagcagctggtgttccaacttctatccctcaaggcagtttttcaccttctcatctggccactcccacctactcccccgctgaaacttccacctatcaatctcttcccacacaaggcaaatggtttaaaaggaaaatatctccttccagcctcacaggcccattctattctgtcgtcatttcataacctcttccatgtaggttacaagccgctagcctgcctcttagatcctctcatttcctttccatcgtggaaatctatcctcaaggaaatcacttctcagtgttccatctgctattctactactcctcaggcatttctcaggccccctcccttccctacacatcaagctcggggatttgcccccgcccagaactggcaaattgactttactcacctgcctcgagtcaggaaactaaaataccccttggtctgggtagacgctttcattcgataagtagaagcctttcccacagggtctgaggaggccaccgcggtcatttcttcccttctgtcagacataattccttggtttggccttcccacctctatacagtccgataacggactggcctttattggtcaaatcacccaagcagtttttcaggctcttggtattcagcgaaacctttatatcccttaccatcctcaatcttcaggaaaggtaggagagactaatggtcttttaaaaacacacctcacaaagctcagccaccaacttaaaaaggactggacaatacttttaccacttgcccttctcagaattcaggcctgtcctcagaatgctacaaggtacagcccatttgagctcttgtatagatgctcctttttattaggccccagtctcattccagacaccagaccaacttggactgagccccaaaaaccttgtcatccctactgtcttctgtctagtcatactcctattcactgttctcaactactcctaaatgctcgtgtttatactgctggtaaactgtttctccaagccatcacagctgatatctcctggtactatccccaaaccaccactcttaactccctcttaaagtaaataaataatctttgctggcagggctatgctgaacctccttaggcactctctaattggatgtcctaggcactctctaattggatgtcctaggtcctcccaattcttagtcctttaatacctgtttttctccttgtcttattccatttagtttttcaattcatacaaaaccgtatccaggccatcaccaataattctatatgacaaatgtttcttctaacaaccccacaatatcaccccttaccacaaaatcttccttcagcttaatctctcccactgtaggttcccacaccacccctaatcacgctggaagcagccctgagaaacatcgcccattatctctccacaccaacccccaaaatttttgccacccgaacactttaccactatgttgttttatttttcttattaatataagaagacaggaatgtcaggcctctgagtccaagctaagccatcatatcctctgtgacctgcaaatatacacccagatggcctgaaggaactgaagaatgacaaaagaagtgaaaatggcctgttcctgccttaactgatgacattaccttgtgaaattccttttcctggctcatcctggctcaaaagctccccaactgagcaccttgtgacccccaaccctgcccgctgagaacaaccccctttgactgtaattttcctttacctacccaaatcttataaaatggccccacccctatcgccctttgctgactctcttttcagactcagcccacctgcacccaggtgaaataaacagccttgttgctcacacaaagcctgtgtggtggtctcttcacatggactcgagtgaaaatctgcacatggaaaatattctaaaatcaaccacatgctcagccatgaagcaattttcaacaaatttaaaaaacccacacaatcatatcaactactctctcagactacagtgcaacaaaaccagaaatcaattttattaagaagatctctcaaaaccatacaattaaatggaaattaagcaatctgctcctgaatgacttttaggcaaacaatgaaattaaggcaaaaatcaataattgttttgaaattaataaaaacaatgataaaatatgccagaatctctggcacatatctaaaacagtgttaaggggaaagtttatagttctaaatgcccacatcaaaaagttagaaatatctcaaagaaataatctaacatcacatctagaggaactagaaaagcaagagcaaagcaactccaaacctagcagaagaaaagaaataaccaaaatcagagctgaatttaatgaaatgaagatgataaaaaacatacagatatcaacaaaagcaaaagttagttcttcaaaagaatgaataagattgatagattgttagctaaactaatatagaaaaaagagaaaagatccatataaacacaatcagaaatgacaaaggagacattaccaccaatcccacagaaatatgaaaagccctcagagactattattcatacctctatgcacacaaactagaaaacctagaataaatggataaattattagaaacatacaaccttccaagattgaaccaggaagaaattaaaaacctgaatagatccataatgagttctgaaattgaatctgtaataaaaagcctaccaaccagaaagaaaccctagatcaaacggactcacagctaaattcgactatatatataaaggagagctggtatcagtcttactgaaactattccaaaaagtcatggaggagggaatcctccctaaatcattctatgaggccagcatcattctgataccaaaacctagcagagacacaagaaaaaaatttcaggccaatatctctgataaacatggatgcaaaaatcctcaacaaaatactagcaaatcaaatccagcagcacgtgataaagcccattcaccaccatcaagtaggcttgatctctgggaggcaaggttggtttaacgtatgcaaatcaataatgtgattcatcacataaacagaactaaaacacaaaaccacatgatcattgcaatagatgcagaaaataattttaataaaatccaacatccttttctgttaaaaaccctcaatgaaccaggcatctaagaaacatacctcagaactgtaaaagtcctttatgacaaatctgtagccaacatcatattgaacaggcaaaagctggaagcattccccttgaaaaccagagcaaaacaaggatgcccactttcaccacccttattcagcatagtactggaagtcctaaccacaccaatcagataacagaaagaaacaaaggcatcacaataggattagaaaaagtcaaacaatccctgtttgcagacaatattattctatatttggaaatcaccatcgtctctgctcaaagtcttctggatatgataaacatcttcagcaaagtttcaggattcgaaatcaatatacacgtatcagtaacatttctatacaccaataacatccaagtggagagccaaatcaagaatgcaatcccattcacaaaagccacaaaaagaataaaatacctaagaatacagccaattagtgatgtgaaagatctctacaatgagaattacaaaacactgatgaaagacagcacacacaaatggaagaagagttcatgctcatggataggtacaatcaatatcatgaaaatgaccatgctacctaaagcaatttaaagattaaatgctattcctatcaaagtaccaatcatatttttcacagaattataaaaaaaaactattctaaaatttatttggaaccagaaaagagctcatatagccaaagcaatcctaagcaaaagacaaaaaaaaaaaaaaaatgacaacaacaaaaacacagtcacaagcatcaaactatctgacttcaaagtgtactacaaagttaccataattaaaacagcatagtactggaacaaaagcaaacacatagatcaatggaacagagtaaagaacccagaaataaagccaaacacctgcagccatctgatcttcaacaaatttgacaataacaagcaatgaagaaaggaccctctattcaataaatgctgctagaataactagctagccatatgcaaattactgaaattggacccctttcttttaccatatagaaaaattaactcaagatgaagtaaagacttatatgtaaatcctagcactgtaaaaaccctagaagaaaatgtaggaaatacaattctggacatcagccctggcaaaaacttgatgacaaggactccaaaagtaattgcaaagaaaacaaaaattaacaaatgaaacttaattaaactaaagagcatctagacagcaaaggaaactatctatagagtaaacagacagcctacagaatgggagaaaatatttgcaaactatgcaccagactaagatttaatatacagaatctataaggaacttaaataagtcaactagcaaaaaacaaaccaacctattaaacaatgggcaaagaacgtgagcagatacttctcaaaaggagtcatatatgcagccagcaagcatatgaaaaaatgctcaatatccctaatggaaatgcaaatcaaatggaaatgcaaatccaaaccacagtgagatgctatctcacaccagtcagaatgaccattattaaaaagtcaataaatagccgatgttggcaaggttgcagtgaaaagggaatgtttgtgcactgttggtgggaatgtaaattatttcagtcattgtggaaagcagcctggagatttctcaaataacttaaaacagaactacccttagacacagcaattccattcctgggtatatatccaaaggaaaataaattgttctaccataaagacacatgaatgcgtatgttaatcacagcacaattcacaatagcaaagaatcaacctagatgtccatcaacagtggactggatcaataaatgtggaatttatacactatggaatactacacagccataaaaaatgaaatcacgtcctttgcagcaacatgaatggaactggaggccattattctaaggaaattaatgaagaatcagaaaaccaaataccatatattctcacttataagtggaagctaaatattgagtacacatgaactcaaagaagggaacaatacacactggggcatacttaagggtacagagtgagaggagagtgtggattgtaaaacaatctataatttattatgcctattacctggatgacaaaattacgcatacatcaaacccctgtgacacacaatttgcccatctaacaaacttgtgtatgtactccttgaacctcaaataaaactcggaaggaaaaaaaataaataaaagtttctggacccagtcgttgttggctttcctaagaatgtatacttatttggagaatattatattcatttttgaagcctcattgccatttccaaggtaacatgaaaagtcccaccaaaccttgttatgtatataagatacctatgctaaaatttagtggaatttaagcaaactactcctcattttaaacatacttatccagacttgtataagctatacatattaatgtatttccttgaccaacctccaggcttgctagtttttcaacagagcaaacatcatatctgtaacttttctatatgcctctggtccagtctgtttttcccagtctatgaaaatttattgtttttacagtgtaatgcagagatcctcccccatgtatcacacatgattgataaattcacttataagacaaagtttcatggacttactcaggggtataaacaatttccaatgggctaataataatttcctctttttctttcactcaagacagcatattagatcataaagagtgagcaatattattaaataagatatcttaaaattgctcttatttactaaaaataattttcaaatgttgatactttttattagtactaaattatttgtgacatatgtcactactcatcacaacacacagttcagaaactgctggtctaaaccaagaaacttagtgctttacattctctggttttgtttctcaacaaaattgcaggttttcctacaggcaggatttgtagttgatatatatttggtctttcataaattgtatttt

SEQ ID NO: 6243 - DNA, 2397 bp, artificial
  synthetic oligonucleotide
acgagttgaaggaaggcatatgacagttgacagtttgggttagtgggagaatgagaaacaagcatattgaatttattattagtctgagttaccagctcaagttagaaacctagtttcacaaaatcctcaggtataaacttgataaaaagctttatttttagcacttctaagcttctgatttgagatctcacataatcttcaactatgacatacttttcctaatttatgcatgtttctgtgataatctgttcaaactcaagttgtgctttgcttaatttatagctgaatcagaaataaacagaaaaataagttctattaagaagctcaaataaattatttgcttaactaaaataatgcattacattttggtgacttaagtgttgaaagagatgattaaaaagtaattaaaggtttagtattttaagttgcaatattgagttacatgtattccaaattggactgactatgtagaagatccttctaaaatgaaataatttagttcaaggattgttgttttattcctgcaaaaaaacactgtttataccttgtagatcattagggtagactcaattagaaaaaggagagaaaaatcactttgaggtgacacacaaagggaaacaaaatgaattgcacaattctctagtaatgtccaaacaacttttcacttacaccatattttatttactcgtaattacaggttctattagaagtatagaggtgacatgcccctatatttcataactgggtaccagtgagactgtgccactataattatttttcttagtataataggattttgtgtggtgatatttcaatcatatttcttattaattggttacattaaaatattcacagtggtcttcagagacttaagaaagaagctctgtttattaaaccgtttaagtgtcagtagcatgaattcccctatctagaagctgggtcatttagttgtcttggtatcgaatattagctggaaaatgcatcagaaatcacagttttatttccgtctctgtcctaaggtccagtgtggtaaagagaagcattctggatcattttgagcctcttgtaactcatgtttagaaaaagaaattccctgtgccttgacatcatacataggcccagtaattgccacaaatttctaggaactatattaaactagttttaatagaaacttttaaaatatagccaaaacaaaaataataatattaattgtatgctattatctttttcaccatttcctctaaaatttaatatgccgtattggctttcaattttttataaaaacatcatttgggtaatagatgatctaggcactctcaatccttctttcatccaagagtagaagaggaaaatgaaattaaaatttgttaaatgcgaattaggtttaaaaatatggtcaggtttgaaaagttgtttctaaaatctggaaatatttttatctgtatattctttttaacagtttattaaagagaagtgtcataccaccttaaggtctaggtctgcagtattgacaatttgtggctatattaactatattaacaatttatcatctatggatagtattaataataaaataatataataggtgaaaagtcaggtataacactgaagaaaataatcttttttaacaaaaaatacctgttcacactcggctggtaaagcttgtttattgttgtagttaaacagttgtattttttttttcgtatttgtcattcataggacttaaacttctactagtcatagtaaagatggtatgtacattgcaacatctatacaaacatatttttccctatggtctagtgacttccagggttagtattaaagtaagtcacttacctatgaataaataacaagttctttatagactcatttttagtagaatgtattttgagagttgaaaaaaatgttattcctaggtatgatgttacagtatcataatatgaaaaatacttgaggcaaaactgtaacatgagtaaattaaatgtatacaatctgaaaacccatttttatccactgatccccacattctttattaaactttgccaattcttctggaatgttttattaataagtttaatattctgcccttgcttcaacgtataatttggcaaaacttctaatgaaaaatactatgccccaaaagtggaaagaaaaaaaaaggaaaatgataaaaggttaaaaggatgggggaggtgaattgtctagtgtgggagaattattccttgtgaaattgaaagttaactacaagtatttctcaaaagttcagagtcttcaaacaaaaccaatacattttgtattaacattgagtgaagaaccttgtgactctttggagaataataaacttaattgcaatagcttacactgtgagccacattagcattttaactccaagtctta

SEQ ID NO: 6244 - DNA, 942 bp, artificial
  synthetic oligonucleotide
gatattcattaatagtcaattttatcacatcaatcagaagctttgaaaaagttgagtgaaattactgttgagataaacaaaatataatcatataatggcatgtaatctcaggaatctcaggaatctcctttaggtacccctccccagccatgaatttatgtcactatattcttctcagataagtcccttggcttaacttcattgatcatggactgatgcaattagaatcacatatcccaagtgggcagcttccatgtgtcattttttggcctgcataacattcacaaccatatctatgttagtaaaataaatccattgaagtcactaagcaatttctattgccagcaaaggaatattgaggatcatcagaattatgttgataattgctttagcatgtccctttactcacaaatgaatatatacacaattttttaaaacaagcaaagttggaggagttactaccttatttctaatctattctaaagatagagtaatcatgaaaatgcagtatttgtgaaaacatagacatatagatcaacagaatagaacagattctagacataaccttacatctatttggtcaattgatttttgagaaatttgccaacataagtaatgtggaaaaaatatttttgaacaaatatgttggaacaatttgataggcatacatatgcaaaaaaattgaacctcaaccatgtctcacactctatataaaaattaatagaaaatgtgtcacagacccaaatataagaatgaaaattataaaaattttaggacaaaataggagataagcttagcaaccttggatttgacaaaaatttcttaaatacaaaaaagaacaaattaatgaagaaagtaataaaaaatcacagtttattaatattaaagcttttctttttaaaaggcactgctacaaatgtgaaaaggtgagccatgggcttg

SEQ ID NO: 6245 - DNA, 1393 bp, artificial
  synthetic oligonucleotide
aggatggttatgagtatttatatacactgaggtgtgattggggattaattgtctccatgcttctccaagatttccacgggcaagtatgaccctcaaaaagattattgcattttgttatgaggctcagttaagaatcttccaccctacatagcagataaaacattttaacaagaaaaaagtactttaagctcagttatagcctatataataatacgtatgtgcttatgacaatagggacggaaaaatgttcctatttctttatgcatcttaggttcattggctggcgccctgtaaattagactgacaaaagataaattaacaagagaaaaacagaagtctcaacagtggttagaacttgggtttatatactaccttaaaaagaatacattttgtagagaaactgacaagacaaaggaaaaagactttaagcttcttggagtcagcaaattgagggaaagtaaacattttcgggagctaatgtaagataagggcaagttagtaaaggttcattatataggttcctctgttgccctttgtgggctgataagggtctagagttgtctctggtgattaatttctgtccttcctcgtagagagaggagaggggccacctttacaaatttatgtcctgctttggagcatatagggggaggaaagagtcctattcttgtatcagctttttctctattaccttgagctcaaaataatccttattccagaatggcatattttgaggtggtatattctgctatccttcatgaccaacaacaaggacactcactatggaaataaaaacaaatgtttctatcagtctgagaagaaggaaaccaaaggatacagaagaatagctcagtttttataagttgtggaagagcagaggacctaaaatgtagaaagacagggactgctggctaagagatatggtctctaacatctctgacatttgatcatttacataaggtaaaatgcatttttccaaagctaacactgtgctgtcataagcacttggtactgctgaggatgactctgaatcctctacaaactcgaagggaaaaagtacctctaagaaagatgaatcagaagtagattgaactggtcagctgggagaatcacaggatcatagaggtgggaaggaattaagaaattagaccaaacctcccatccaatgcagaaccctccctacaacacctccaattggtgtgcattcagtttctgcttgattacttccagtgactagaactcctctgaagaaggagaatgtaaaaatattcttcctttggttgaacaagaatctgccattcataacttccattcacaacttccattcactgactgtttctaaccacagaagttataaaagatacacacataaccccactttgatctggcagtt

SEQ ID NO: 6246 - DNA, 596 bp, artificial
  synthetic oligonucleotide
taaaagatacatattctagaggaaaattacctaaaatttactgtgtgaccatagtcccagtagcctaaccaagctaggcctctgtttcctaatataaatattggaacaatggttgtactcactccatggaaaggtcacgagaattaagttcgtcaatacatgcaaaagacttagattatctgtctgacacatggtaagaatcatggaggtgttatccattattatccagaatcaatgcctcccaaataaatatcccagagcattagcttttataactgtacattctagcactgcttggactatgtactacagtcaaagcaatcatcacttaccatcttcacataaactgcatatcactcttgcctctgagtttaaagaacatttctccccctttatttcccagcccttgttttattctttctaccaaactccagctgtatctaagtacctgtaatcagatacgacatcaaggaatgatttgaaatttcctacatgccaccacctgtcttcctagccctgaagataccacaaaggcagaaaccctaatactaccattcagctgcaagtaagaagcacaaaattgattatcacaacca

SEQ ID NO: 6247 - DNA, 403 bp, artificial
  synthetic oligonucleotide
taacaaccctgaaaaatcagccagataaaaatcttcattctaattgaaataatttcaataaaatatttaatttttaaaagatttaggggacaaaatatgtcttaaaagcttagatttagtatgtcctttttgcagttgtaaaacataaagtatatattaggaggtttaagcatatccaaatgcacggctatgttatccttatgggaaatgtggggatttctttgttaattttggctatctgttagacatatttccttacagttatttaatatttccattcataataagacattaattctttaaaaatttatactcattgaagagagaaaagggatagtgttagtcaatgtcaatgtaattaaaacaaagctatcccaaagtgttttccactttcaagtattgt

SEQ ID NO: 6248 - DNA, 1511 bp, artificial
  synthetic oligonucleotide
tagtacctttagacagctggacctttgccaagccagatcccctgcccccatacacacaccaaaggggaagaaaaggaaccccttgaaacactattccaagcttctgtgaaaatcattttttctgcttctttgagttccagtttaggaccaatcattcttttttttaattcttaaattcacactgtctcaacttcttaattcattttttttcctaattttcaggacttctggttggaaaaattcacaagtatctggtatggaattcctctctttatgtgcttcatacatccttcttaattttgattcacaagctctagttttcatctatacttgccattgtttccatttttccttcctttctcatcatacagaaggcaagaagctgtatatcttggatggtctttccagacaagtctgtatgacattttcctctttctgtctggtactaactctctctctatcacacacacaacaaagaatgcataactttttgtgtgacccttagcttatattattattttttttagactcaggcacagaatccaatttaacctgtattattttatcttacttatttagctcttaatgtcatcaacaaaataagacaaagcctgttctttctgttcttatttcacttatactgtatctgtgtaaatactgaatgtttgttctaagttactaggttagctataaagaaagaatatatttggagatgtatgtaataattgcaggaatagtgagagaaagagagagtttgctaggatttaccttcatttggaacaggaattgcttcctcatactcttcactgaatagagccaagaactcagggccagaagtaaataaacaaagtcaaactacaactgagcctaccatgggaatgaactgctttgagggtgttctagaagatccataagaatgagttcagacaatagcaattccaaaataaaatccccttgtggagaagtcatggattaatgaactatactttccatgatcaaagaaaacagacttttcatgagaaaagtcagcctatgcttactcttccaatcaggttaagctaatagcacaacttatcctcccccatttctctccaaaatgtgccccaaaagggtgttgccatgtggacagaggtctgacttattcaagtgtgctccaggagcaaataactgaggcccaaagaaggaaagtacacggaggtagatttcagctcaacgtaagtaaattttgaaacatgaaagtttcctaaaaaccacacaggcttccccaggagatagtgtttgagcaggcaccaggtgaccttttcacaggaatgtcataaaaaatgacttaagaataaatgtggtatagaggaatctagtattttttctgacttctaatagtccatgattctattattttctaaatggtctctagcaagtaactttatctgaatatgttcttctctgctactgccagtccattcagtcatttctactgaacctacttctccctatagctcttaggctagcta

SEQ ID NO: 6249 - DNA, 702 bp, artificial
  synthetic oligonucleotide
agaacaagtgatggtaataaatgtagcatgcaattttgacaatgaggagttaatttttataggcaacagaagggtattgaatttctgagtgaaacatgaaatgaataaaggacactgaataaagatggtaaaatggcatcaataaacaatatggttttgtgggagaaaaaattgagtgggagtcctaaacgaatatattctgtatctctacatactatgatagatacttcaagagaatgactttctttctttttgcagagccccacatgaaaggtgtccaccaatgcctttcatctggtaggtttttatgcaaggcctaacagtaaagtctgtccttgggtagagtgattcaaaggttcttgtgttctagtggaggaggaggaagagccttaccatcactgcacataggaaaactcattgctgtgagatggctagactgaaatttccatgatagtagggacaatgtctgtcttattcacagttctattaacagcatctagcacaatgactcacagaaactaggcactaattaaatgcactgggtaactgattgaaagcaatagtattgtagaacttaacatagtcatctaaataaatattggccatatctatctaactactattataaaatttagtgctttgatttaccatacatatagccagacgtgggtgctaggtagaggagataaaggcagaatgaga

SEQ ID NO: 6250 - DNA, 7151 bp, artificial
  synthetic oligonucleotide
atgttttataagttaaagatttaaagtgcatattacttaaacattggaaaataccaaacaatggaatattattcagccataaaaaggaatgaagtactgacacatgctacagcatgaatgaacctgaaaacattatgctctgaaatagccagacacgaaatactacatattgtatttttccatttatatgaaatgtccagacaggtcaattccatggagacagaaagtagattaggggttgccaagtactgggacacttaggggaaatagagagtgactggcaatgggtttgagtttctttgtggtgggggggtggcgctgataaaatattctgaaattaaatagtggtgacagttgcacaacgttgtgagtatattaaaaccacactgaattatgcacttaaggtgaattccatagtatgtaagttatatttcaacagagctatgataaaaagtatatgtttggggagataatatgaacagtatgtaatattaacaatatatatattcaacatcaacacacattttagaagctgtctaggcaaaagcacttatggtgattaggacccaggcctcacagaaactcaacactaatgataagttttcttttcctttttgtgcttctctttttcttcttttttttattttattattattatactttaagttttagggtacatgtgcacaatgtgcaggttagttacatatgtatatatgtgccatgctgctgtgctgcacccattaactcgttatttagcattaggtacatctcctaatgctatacctctccccccccaccaccccacaacagtccccagagtgtgatgttccccttcctgtgtccatgtgttctcattgttcaattcccatctgtgagtgagaacatgcggtgtttggttttttgtccttccaatagtttactgagaatgatgatttccaatttcatccatgtccctacaaaggacatgaactcatcattttttatggctgcatagtactccatggtgtatatgtgccacattttcttaatccagtctatcattgttggacatttcggttagttccaagtctttgctattgtgaatagagccacaataaacatacgtgggcatgtgtctttacagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgttttttggctgcgtaagtgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgtttttagacatgaagtccttgcccatgcctatgtcctgaatggtaacgcctaggttttcttctagggtttttatggttttaagtctaatgtttaagtctttaatccatcttgaattaatttttgtataaggtgtaaggaagggatccagtttcagctttctacatatggctagacagttttcccagcaccatttagcaaacagggaatcctttccccattgcttgtttttctcaggtttgtcaaagatcagatagttgtagatatgcggcattatttctgagggctctgttctgttcattgatctatatctctgttttggtaccagtaccatgctgttttggttactgtagccttgtactatagtttgaagtcaggtagcatgatgcctccagctttgttcttttggcttaggattgacttggcgatgcgggctcttttttggttccatatgaactttaaagtagttttttccaattctgtgaggaaaggcattggtagcttgatggggatggcattgaatctataaattaccttgggcagtatggccattttcacaatattgattcttcctacccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcactcatgatttgcttctctgtttgtctgttattggtgtataacaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaacaggactggtgagagagggcatccctgtcttgtgccagttttcaaagggaatgcttccagtttttgcccattcagtatgatattggctgtgggtttgtcatagatagctcttattattttgagatatgtcccatcaacacctaatttattgagagtttttagcatgaagggttgttgaattttgtcaaaggctttttctgcatctattgaggtaatcatgtggtttttgtctttggttttgtttatatgctggattacatttattgatttgcatatattgaaccagccttgcatcccagggatgaagcccacttgatcatggtggataagctttttgatatgctgctggattcggtttgccagtattttcttgaggatttttgcatcaatgttcatcaaggatattggtctaaaattctcttctttggttgtgtctctgcccggctttggtatcaggatgatgctggcctcatcaaatgagttagggaggattccctcttttcctattgattggaatagtttcagaaggaatggtaccagttcctccttgtacctctggtagaattcggctgtgaatccatctggtcctggactctttttggttggtaagctattgattattgcctcaatttcacagcctgttattggtctattcagtgattcaacttcttcctggtttagtcttgggagggtgtatgtgtggaggaatttatccatttcttctagattttctagtttatttgcatagaggtgtttgtagtattctctgatggtagtttgtatttctgtgggatcggtggtgatatcccctttatcatttcttattgcgtttatttgattcttctctcttttcttctttattagtcttgctagcaggctatcaattttgttgatcctttcaaaaaaccagctcctggattcattaattttttgaagggttttttgtgtctctatttccttcagttctgctctgattttagttatttctttccttctgctagcttttgaatgtgtttgctcttgcttttctagttcttttaattgtgatgttagggtgtcaattttggatctttcctgctttctcttgtgggcatttagtctataaatttccctctacacactgctttgaatgtgtgccagagattctggtatgttgtgtctttgttctcattggtttcaaagaacatctgtatttctgccttcatttcgttatgtacccagtagtcattcaggaccaggttgttcagtttccatgtagttgagcggttttgagtgagtttcttaatcctgagttctagtttcattgcactgtggtctcagagacagttcgttataatttctgatcttttacatttactgaggagagctttacttccaagtatgtggtcaattttggaataggtgtggtatggtgctgaaaaaaaatgtatattctgttgatttggggtggagagttctgtagatgtctattaggtccgcttggtgcagagctgagttcaatttctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccactatgtaatggccttctttgtctcttttgatgtttgttggtttaaagtctgttttatcagagactaggattgcagcccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttagttggagcatttagtccatttacatttaaagttaatattgttatatgtgaatttgatcctgtcattatgatgttagctggttattttgctcgttagttgatgcagtttcttcctagcctcgatggtctttacaatttgacatgatcttgcagtggctggtaccggttgtgcctttccatgtttagtgcttccttcaggagctcttttaaggcaggcctggtggtgacaaaatctctcagcatttgcttgtctgtaaaggattttatttctccttcacttatgaaaccagtttggctggatatgaaattctgggttgaaaattcttttctttaagaatgttgaatattggcccccactgtcttctggcttgtagagtttctgccgagagatcagctgttaatctgatgggcttccctttgtcggtaacccaacctttctctctggctgcccttaacattttttccttcatttcaactttggtgaatctgacaattatgtgtcttggagttgctcttctcgaggagtatctttgtggcgttctctgtatttcctgaaactgaatgttggcctgccttgctagattggggaagttctcctggatgatatcctgcagagtgttttccaacttggttccattctccccatcactttcaggtacaccaatcagacatagatttgatcttttcacatagtcccatatttcttggaggctttgtttctttttattcttttttctctaaacttcccttctcacttcatttcattcatttcatcttccatcactgataccctttcttccagttgatcgcatcggctcctgaggcttctgcattcatcacgtagttctcaagccttggttttcagctccatccgctcctttaagcacttctctgtattggttattctagttatacattcttctaaattttttgcaaagttttcaacttctttgcctttggtttgaatttcctcctgtagctcagggtagtttgatcgtctgaagccttcttctcccaactcgtcaaagtcattctccatccagctttgttccgttgctggtgaggagctgcgttcctttggaggaggagaggtgctctgctttttacagtttccagattttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggactttgctagaggtccactccagaccctgtttgcctgggtaccagcagtggtggctgcagaacagcggattttcatgaaccgcaaatgctgtctgattgttcctctggaagttttgtctcagagtagtacccagccgtgtgaggtgtcagtctgcccctactggggggtgcctccgagttaggctgctcgggggtcaggggtcagggacccacttgaggaggcagtctgcccgttctcagatctccagctgcgtgctgggagaaccactgctctcttcaaagctgtcagacagggacatttaagcctgcagaggttactgctgtctttttgtttgtctgtgccctgcccccagaggaggagcctacagaggcaggcaggcctccttaagctgtggtgggctccacccagatcgagcttcccggctgctttgtttacctaagcaagcctgggcaatggtgggcacccctcccccagccttgctgctgccttgccgtttgatctcagactgctgtgctagcaatcagcaagactccctgtgagtaggaccctccgagccatgtgcgggatataatctcctggtgcgccattttttaagcccgtcggaaaagcacagtattggggtgggagtgacccgaatttccaggtgccgtctgtcacccctttctttgactaggaaagggaactccctgaccccttgtgcttcccgagtgaggcaatgccttgccctgcttcggctcgcacacggtacgctgcacccactgacctgcgcccactgtctggcactccctagtgagatgaacccggtacctcagatggaaatgcagaaatcacccgtcttctgcgtcgctcacgctgggagctatagaccagagctgttcctattcggccatcttggctctctccttctttttttctttagtgtcctaataaggattcttcttgcaatccctcaagaatgaaagaaattgagaggctcaagactcagacaggaagaaagaggactattatcttaaatctgttggtagactctggcattggccatttatttgctagcattagagttagaacagattaagagaaaagtatagagctgactgaaagttttggaacctcaactttttcatgctggagaaaacattgaaagacactactcatagtattattcatgataatgattgcatgtgtgattataattaaaatagcagctaatatttgaatactcactttgtgccaggtactatattaactgctttaagtacatt

SEQ ID NO: 6251 - DNA, 1259 bp, artificial
  synthetic oligonucleotide
ccttttagcaagagcttaatattagcctgtgctataagaatatataatccctgcaaatggccaatttcatattggggtgaatgtaataaaaagtaaatgttaaaaaaattaagtaaatgtgaagtatttggtattttcatacaaaaagacagtactgaggcgtctcgaagcaagatggactattaaaggtgcagagaagtaagagtcattgaaaaggggatgtgatcattgtagcagaaatgtaacagatctacaagctggacctggaaaacctatactaccatgggatgtgctggagaaggctgaggggcccttgaatgaatcagtatttaggaaggaaatggcatcctgggaaaaaaaatcctacgcacattccttccaattctcggcctccaattttaaactagcattgaaaacacacttgaggaagtattgtatttggagaattttgggagaatgaggactgccttagagctccattttaccatagcttataacatcagtatttttaaaatcttccactgtatttactctcctttaaaatacacagggtcttcccctccccctctcccaagtggtttggtaatagttgtttgcaatatccacaagtggcagctataatcagtgaaattgctggaacttttgctttgctgattcagcagatgtgcttaagatctataaaaatataatgatctcctgtaaatagtcagggctggcagttccaaaagaaataaaaataaaggtataatcattaatcattttcatatgcattacttggaagggggtggaaatcaactgataaattaccacaggcaaatgctatgctaacaaactaaaccagatacctgatatatttgaaagaaatgtttgaattgtcagtgactcagggatgctccctgataagaacaacgggtaccacatgaggcagcttccaagtgattcattgctgagacaactggcaatgcattatatttttgaggaaaataaaagtatttgctaaggatatgaattttcttagagtctaaagcttggtatacaaaaatcaaaagaatttgccaactttagcagttttaacaagatctaggaaaatacatatcaacatcttgactttataaaaatgttgatagctgtttatggaagatttttctgtgtccttgaaatttctttatttgcagactcaaaaaagaggatcagtttaaatatgtgagcccctgtgtcacaaatgctaatgataaaatcttcagcacttgtggtaaaaa

SEQ ID NO: 6252 - DNA, 1060 bp, artificial
  synthetic oligonucleotide
caataatgaaaaatggaaatgctttgtacatttctcacatttttttttcagcaattccatcatacttggctgtcacagattattaaacctctaacttgcttagagcaatgtagttcaggtcacttaggccacttaactagtaggttccttttcattttaagaaggtcccaatgatgccttttgtggaggctctggttaaatcttcctgcaaaatgaaagcccacctccatctgaaaatggctgtttgtaaagcccaatgcccacttcggctgtaattaatcactactgttagggaacaattacacaattgctaaggtagggactttgctgctgtccttgcctagatgtatgaatttagtatgcactacttccttacacacaaaaatatatgctcttataccagctatctctaaacccctgtctttcatgccaacagttacttccgttacctattttattttctggtttgtaacttggatttttaaactctgttcattgtgggattttattagtgtaccctagcaccattacttcaggcacactaatgttctgttaattagatttccccctgccttgtccttgtttataaaacctcccacagaagttgtttgtaaccattattcttaacaagagaattcaaaccaagaaattacatgattcaccacattttagaacattttctcgcctctaaaaaaatgccatcagatcttcattttgcaaattaattgtacctgtacttaatgttatagaaagagtaggaacatgaacataaagttggcatttagacattttcttctcgagaagaaatactatagaagaaaagttttgctagcctgatactttcacccatctggccttcggtgagcccaaacttgcagtctttcatgcaacccacgtcccttacacaatttctctcctttcctagctctcttattatgtcagaatgcaatctattttaccaagcttccatttattttgaaaaataatttcagtggtatacctttccagtcctccaaagcactacatgaagctctcttcagtgcccccaaacttctcacca

SEQ ID NO: 6253 - DNA, 528 bp, artificial
  synthetic oligonucleotide
aaggatgcaaaaaaaaaaaatgaacatgatatttaaggcaatattaagtgtttataaaaatgaagacatttctaaattgttaaacaattataataaatgtttcaacacaggttaaggaaccaacagtctaattactggaaattagcaatacaaagtgactatggtctcatctttaaataaaattgctttaaatacagttatctagaacaaaattcttttctattattgtgacagtaatattactataacttttttgtattgtgtattatccagtttggtcattttctttcaggtaaaggaattgatcacaatcaatacctgaagttctaagtactaaacttctgcattagaggataggccaacaatgtctcttgttaatgattagttccaaagaaatcatggcactttccttaatttggctcaggatgaccatgtgttgctaagatcagtgtaaagcaatgttaagagtctataagtacaagctttaagtgttactactaaattaaattctggacttgaggcattttg

SEQ ID NO: 6254 - DNA, 2193 bp, artificial
  synthetic oligonucleotide
tgtaacgcacactcatgtccccatgtaaccatgcagggcgctggggctaaggaaggtcaggaatcatgtctcatttgttttctacctttctcttttctacttttctatttctttttcttttttttttttttttttttgaaactgagtctcgctctgtcaccaggctggagtgcagtggcacgatcttggctcactgaaacctccaactccctgtctcaagcgattctcctgcctcagcctcccaagtagctgggattacaggcacatgtcaccacgcccagctcatttttgtatttttagtagagacagggtttcaccatgttggtcaggatggtctcgatctcctaaccttatcatccgcccgcctcggcctccttaagtgctggtattacaggcgtgagccaccatgcccggccttctcttgctcttaatacagatttctatacacattagcagttcaataaatgttcaacaactgcaaaaaaataagtgtctaatcacattaaataagttcttaactgaatttcttacccccacccccacaaaagactctcttgtgctaaagaagcataggttggtttaaataacaacagaaaaacaaaaactaaactgctctgaatggtaccagatgagagtactaacagacgagtcttggctcatttcaattacatgaccctgccatatctattttcctatgacatgagaaccacacagccagtcctctatttacagttattgcatgagtaaatcagtatatatttacatggtaactattatgagcaagctattgggaaagataaagtagtttatttacctccctaatctccaccacccacagcaacaacatactatgtgcaaggccctgatttaagcagtttactgcaaggtgtacaatctcatcgaaaaatcttggtgccagatgtgtttctgaatttagaaatgtccagacctttagacaggaaatatactttatataccatatgttatgtaatacaccattagggtctatggtgcaaccccataaacatattagtaattctatagcaaaacaaaataaagatcaacattaagtagaataaagactataaataccctatgtcagtttaagtcaggttttgccaccacatgagttttggcatctaagttaccaaataaaatctttttcagttttcagagctttagaaatttaaaaattgcaaacaaattgtgggcctaggccgggggaggtggttcatgcctgcaatcccagcactttgggagcccgaggtgggtggatcacctgaggtcaagagtttgaaaccagcctcgccaacatggtgaaaccctgtctccactaaaaataaaaagttaggccgggagcagtggctcacgcctgtaatcccaacactttgggaggccgaggcaggtggatcacgaggtcagaagatcgagaccatcctggctaacatggtgaaaccctgtctctactaaaaatacaaaaaactagcctggcgtggtggcacgcacctgtagtcccagctactcgggaggctgaggtaggagaaccgcttgaacccaggaggcggaggttgcagtgagccgggatcatgccactgcactccagcctgaacgatagagtgagagagcgagactccgtctaaaaaaaagaaaaagaaaaagagaaaagaaaaagtgggcctagctaattcatgtaatctttgcaagtaccataagaggcaagttctattaccccttttttacatatgagataactgaggtacagggaggtttactgactcacccagtgtctcacaactattaagtctcctagctggaattgaaacctaggtggcctagctccagagcttgagctcttaacaagtatgctctacaacctctctcagaaaccacttcggaacaccaaacacgtgaaaagtaaaacagtattaaatgatctaacatcaaaaaattaataggagaaacatcacaagacagtatttattcattattcaataactatttataaagtgcataccatgtgctgggtgctcagaatacaacaatgagcaaaccggatgaggtctaggtcgccttcatgaagccagaggcaagtggggagatggccaggcatcaaataagcataattatgacacaacagggcaagtgtgtgactgctgttcaccttcagagggggagatctagttcaatggggaa

SEQ ID NO: 6255 - DNA, 1330 bp, artificial
  synthetic oligonucleotide
tattgtctgtattctctggtagaatataagcactgtgatactccacaagagcaaagatcatgccttataaggtttatcattgtgcctaacacagggccttggcacacaagtacccagtagattttgtaaaatgaattagtaaatgaatgaatgatacataaaaacctgattgttatgaatatcagtaacttgagaaagccatttttataattttgagatattttctctagggctattcatttctctacagtctttccacattttctgaaataattcctggaaatttgttgtattatttcatagcaataaaaatacatcggtttcaatcagtggatttaagaaaaaaatattttcaagaggttttagtggtttatcaaacatcaataaaaatcaaacaatttgaaaattggtcagtctcatttcactactgcaagtcaaattacatgaagaagcataatttgaaatgtacataaaatgagaaagaagataatccaataagtaagtgcagttacatttagtaatatcagaaatatccagtctgctaacctctaggtgtaccagatggactatcaaacacatattgagtcatattgaagattcagagcaaaatgcttatggctaactcatccacctttattcttttcctggcaaatataaatagtcttactatgcaatcacattagcagcaatcttagcttagattttgtatcaataataagcatgaaaagaaaaaagtaagaaaatagtataaactcttttccttgaaaaagttgtaagtttttatgtattttgagaatagtttgctaagaaaattacagacttagaaagtgggcctattagaataagtaccctttccctactacattccattttttaataaacctcaagtaaactcaggaatttaccaaatcaattgggaaactacaaatcatctgcaagttatctaactaaattgataagcaataggccttacttttcttgtgaaaactactttcttcagaacatcaactgagccttatataatcacactacactttttgaagtgtgcttataaaaatggcagattgaaaaccttgggctttttaataattgaagctcttatttatctgttttttaaatacatcatttgatgttgcagcagaaactactctcatctcactgccataagacgtgctaccaggacagtgaaatttagccattatcttcattcacaacctggtttcttctgagattgctgccaattagtgcacactgtgtcaatggcaacacttggtcatacatcaggcaaacaactcttttaccgttaagtatgaggatattaataagaact

SEQ ID NO: 6256 - DNA, 224 bp, artificial
  synthetic oligonucleotide
gtttttcaggaagagccattcacaggctggaaggaaggaaagaggatgggatttgaaagatgcagccaggggccttcaattgtacctgtcatgttttatctctaaaaaaaaataataataagtaaaaaagaagagaagaaaacgaggcaaaaatgttagatttgaaagaagtgggtggtaaacacctaggtgttcctgatgttttcctctatgcttttctgcat

SEQ ID NO: 6257 - DNA, 1211 bp, artificial
  synthetic oligonucleotide
gaataatttttttgaaggatgaagttcatatgcctttattcatttctctttagatcacgccatatatactcaatgtgttgaaaaacaaaattatgcttagtccatattgttagaagtatacctccaaccttgctccaaaaagcttccgatctgtttcacagattcaccatttctagttgctttagaaattaccattacttattctctttatgtgtcaggcttgcagtgcagaaaatatgactttctactggtagactaattgcatttcaagatttgctttgtgggtattttttcaaagttcagcttcttggtggtatttactgaagtgttccagaaaccatcttacctacaataggcccaggactcatagttatgcactatgtaggaaatgaattttagatcttaattttgtatgtaaatctaccttgtatatgataggttatatattttcttttaataatttccccttatttataaggtaatacatattcgctgtagaaaatcattacacaaaggtacaaataaggcacaaacctcctattattattattttaatcagcaacaaaagatgctcgccgtaaatcctttgtgaatatttttccagaattctccatacacagaggtatacacatgtgcatagataaatgactgacatgaatgggattattctatacacagtattctgtaacatctgttttcatttaacactttatgagctcttttcatgtcaatgtatatagagacttaccccttaataacttatataaacatgttgctactgtctgctagtatccttttgtttgtctgtttgttttgctagtatcctttccttgaaaaaacatccactgaatattctatgcagtcctagtaaggaagataatcacagtagtctctcctgatttggcgagtggcaagcaatcagctgacccaggcctgaacaaatgagagttctgtatgctcctagctagatgggcctcctaaaaccaatcaacatcctctctgagatttaatatataaacactgacagagaaagtctcacttcctttgggactgagagttattaagacattataagctaaagttccttgcagccatcttcactaactacaagaaggaagttgtttgcagtaggaaaattgaagccaaaacacaaaaagaagcagatggacagaaagagagagcgtattgatatatcttgggccctggatcca

SEQ ID NO: 6258 - DNA, 1009 bp, artificial
  synthetic oligonucleotide
gagctggtagtttgggagaagagactgttaagtaaaatttgcaaacaatatttcactaaagcacatgataaaggaaagactgcaaactggtagctgtcagtgcaaatatagcccacagatacattttgtttggctcacttgtttttacaaattgattaaataaatcacaggaagccttgtggttgatgggacagttctgtatcttgatcatgtggtagttacagaaatgtacacacgtgaaaaaaattacattgaatcacacacaggcaaaggagtgcacgtaaagctaatgaaatataaataagctttacagattttcctggttgtgtcaatttcctagttttagtattgtattatagtcatgcaaaatgttaccattgaaggaaacatgtcctatataccataagacctccctgcacatattttgtaacttcctatcaatgtataattatttcaaaattttttaaaaagttaaacgccatgtttcagaaaaaaataattgacatagtaattgctgtacaattttcacacctcattattagattttatattctataagcctctcagcccccaacaaagctctacaatgagaattgaacaaaccactatataagcaaagaaacaaaatacacaaaatcttaactattaatttcaaaatccactggtctgagagaaaaaggacaatatgcatatttacagaatatattctactccctgaagattaaataataaacaccaaaaacttgaaaaggagtgggaggatcacatggataaaaataatctgagaccaagaaagaataagcttcaactaaccaagtgattttaatggccctcctcaggatgccacatagaaatggaatcagagccctgttatctttttttgttactatctgttaaaaacccataacagtgtgatctaactaggagttatgttctttttttcttcaaaactctgcttaatcccctgcctttcaaatgcactatcctgtgttgataacagctgtttcca

SEQ ID NO: 6259 - DNA, 2669 bp, artificial
  synthetic oligonucleotide
attcggccaaaatacacctcattatgggtctcatcatccacctagacatgattcttttttgggagaaggtgatagaataatgtccccctcccatgattccatatcgtgatccccaacacctgtgaatatgttaacttacatagcaaaaatgacttttcagttatgattaaatcaaggattttgagatggggagattattatgaattatctggtggacctaatctaatcacaagggtatttataagggaaaaggggaagtaagagggtcagagtcagatacgacaagggaagcagaggtctgagtagttccgcaacaagccaaggaatgtgggtagcctctagaagctggaaaagtcaaagacacagattctcccctagaatatccagaaggaatacatctctgcccacaccttgatttaagctcagtgtcacttctgacctccagaactgtaataaaataaaactgttaaatcactaaatttgtggtcatttttgacagcagcaacaggaaacgcctaaggactcttgttttccttcctcccagcctcactgaccctcataggcgcccaagtatcaatgtgtattcttccgattcacctcccatccctttgaaaaatatgtagaaagtttgtcgtgtgctttaaaaaatgcacgtatggtatcctccctcatgtttggaatgttccttttaaaatcaacattatgtattgccagctttcaaatatgccctttgtccttttcacaaagcacagtactgccagtgtccccaactccacccagtgaagtagggctggtattactaaccctggagtcagcgctagcaaacaagggctcagaggtcaagggctggaagccaggtctccagactcccaggccaaggctcttttccgcagatgactctgtcctggtgtccagcagggcacagcccctagcacctccgaggccccgcaagtgtgctggcagcggcgacgccggctccgccacgcggagggaggaggcccaggcagcgcccggagtgggcggcgacgtggtggaagaagttttgttcggtcagagaccggacgcgggagctgcgggtgggccaggtgtccagccttgggagccgtaggagccgccagagccgccagagccgccggcgccccgccccgcctcctccggccgctctcgccggctcaggttacctgaggccggtgggcggggcggcccttcccgtctgcgccggcccccagcctccagggcggcggagccgggaagtggaagagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccctcggggcccgaggggcggccggagggctgagggcggtgagggtcacggctgaaaggccccggaggtcaacgccgggcggagggccgaagctggggtgggtgctgggggctgccctcgcgaggccccgcgctcggcggctgcggcttcccgcgcgggatctctggggcccggtactggggccggttcgaggtgggacccgggagctgcggggttttcccgaactccgggtgcggcggaggtggcggcagcgaagtaagagggctgcgacttgtagtgggaagagcccaggaggctggcgtccaggcgtgcgggggcggggggcccgaaacatgcccacggcgtcagagggccgtgggtcagcgcccggaatgtcgcctgtgagcccgggaggaaatgaggcgccagagccggcggggaccacgaccgaagtccaggcgagctgagaacgcgccggggctctttgcccgaggccgcgccaatcctcactgtctaagggtggctcttgcgagtggaagttgaagggaacctctaaacatctcagtccttgttgaaaaaggacgtgacgctcatgacctcctctggcgtcgaagaaatcctttgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtca

SEQ ID NO: 6260 - DNA, 6907 bp, artificial
  synthetic oligonucleotide
cagttagctactagaggataaggactgtgtcacatcctattattgccctacaaatgccaactccattagcacatagtatatgctcgataaatatttgctgaactgatgaaaatcttgtaggtgggaaatctgaaataatttcttacaataagtaataagaaggagatacgggagttcgaaaccagcctgaccagcatggagaaatcttgtctctactaaaataatacaaaatcagctgggcgcggtggcacatgcttgtaatcccagctactcaggaggctgaggcaggagaatcacttgaatccagtaggcgcagtttgcagtgagccaagatcacgacattgcactccagcctgagcaacaggagcgaaactctgtctcaaaaaaaaaaaaaaagaaggagatgttctgtgctctttagctttctgatcatatgaaaaaaaaaattttataaacaaagagatatgagccctagcttccaatttggctgtatcaaattcattatgacctgtggcaagtcacttgccttctctagtgttcagtggcctcatttgtgaaaccagagctgatgtgtaagctaactttccttccttccttccttccttttctttcctttttttttttttttttttttttttgaaacagagtcttgctttgtcgcccaggctggagtgcaatggtgcgatcttggctcactgtaacctccacttcctgggttcaagcaattctcctgcctgagactcctcagtagctgggattacaggcacgcgccaccactcccgctaatttatttttttaattcttagtagagatgggggttcaccatgttggtcaggttggtcctgaactcctggcctcaagtgatccacccacctcggcctcccaaagttctgggattacaggcgtgagccaccatgcccggctaaactttcttttagttgtgggttttggctactctgtatagcaaggagcggtcttgctttccatatcaataccattaatgtccatggttcctttttttccccctgtaaggactgcagatttatgggtcaccccagtttataaaatgagaatatcagatacagaacaaatgtgtgctttggccaagcttccaggcatagagtgtgtgcatgtgtatgtgtgtgcggggttgcttacaccttactacaggtctctggcttcgaatggactctttcgtcccagagttgctcagcaggcctttccaagtacaggactgtcaaccatttgttgtttgtgtgcccagtctctgctttgtgaatgaccacagtgcatggcattccaactgtttcctcttgtccctctgcacactcctagggccagaatgtccactggcatgttcagtaagatctgttcaagcactgtcctgcttatgtcactggaggagatataagacaccagtccttgccctctgaagcttctagcctacatgggaagccagtacaaggatgtgtgtatgtggggaaagatgcactatcataagtgagggagagcctgggagttatgtgctgcttttttttttttttttttttgacagagtctctcactctgtcgcccagactggagtgcagtggcgtgatcttggctcactgcaacctctgcttcctggcttcaaaccgttctcctgcctcagacttccaagtagctgggattacaggcgtgcaccatgatgccctgctattttttttttttttttgtatttttagtagagacggggtttcgccgtgatcaacccacctcagcctccctaggtgctgggattacaggcatgagccatcacacccggctgctgctttgatgtgtctccagtatctagaacagtccttggtatgtggaagatgcccaacaaatatatgaaaatgtgtgaaaattgctatggttttcaaacttgatattgtaagggacagcttttcttcaaagaaatcatacctggaggctcagttatgtgaaacagatggatacaatactgccctgcttgaggggagctagggtcaaagcctgtctgcttgtctcctctgagccccaaagagattcttgagagtccagttggaaaactactagttgaaaatgaggggcagctcaatccttgctctctcttcttggttaaccttagccacaaggtgatcctagcaaaataaatggaggtttaaagaaccttacactccaaagggaatatttgcacctgaaaaagatggtgttaatctcccccttcccctcattccaggggggctccaattagtaagagcagagggaaggaaattctgagtaggagacttctgaattggttcaacaatgtctatcaatgtaatggtaatatttgtttaacttaaacaaacaaagaaagaaaaccactgtgataatgtttttcagcattcaatagaaacccacttggtgttgtcctacaggcagtcttgattacaatgtaaaactccctgtggagtctggtcagtgagtagctggtactgccatttacaccagagtacctcgcattatccagactgctattcacattcctgaccaagttcacggtcaacctcctgcactggcagccaagagggcctgcctggagagagcttctcttctccatgcctgcaggactgtgactctctacctgacctggccctctcttagccttcctaccataacagggcaagggaggggaatcaacccaggggatattcccttgtcaaggtcatccacggagcaaagcacatcccagatttgcatctaggaaacaattttgggtaacagacatatatatatatattttagatatgtcaaaggggtaaagctcttgaattaagatggtttcatcattatctatctcatgaatctctaccttccccaacgactgtccttcctcacagatgcctgaaggggcaggcagataattagtgctggggacctcatttgatagtaggggaaactgagaggtgaaaagagctcccttcagttagatagcaactcaccaggaactccagtttctcccctactgcttggtatggccacctcctccacctcttagccagtcctccgacttctacatcttaaaaatctagctcaggggccaggcgcggtggctcacacctgtaattccagcactttgggaggctgaggcgggcggatcacctgaggtcaggagttcgagaccagcctgaccaacatggagaaaccccgtctctactaaaaatacaaaaaaattagccagctgtggtggcacgtgcctgtaatcccagctacttgggaggctgaggcaggagaatcacttgaacctgggaggcggaggttgtggtgagctgagatcgttccattgcactccagcctgggcaacaatagccaaactccatctcaaaaaaaaaaaaaaaatctagctcaggtctgaccccgactaaatggacaatcttccattgatttcccatcccctcaaccccggttcaagccaccatccacagcatttggactagtcatttgtacttaagtaactgagttagtatcatgaaatttggtcttaggatcaaagccactcaaggttagagctggagggaaccttggagattaagagaaactaaggtttggagaacctacctaaggtttcatagcaaatatgtgacaaatccaaggcttcaagccaagttttccaatgtgtccctcgtgctttcctgactacatctggagtttctctatttcttcttctccttctccttcttcttcattttttttttttttcgtgtgtgtgtcttttttcccctatgtgatgcttcctttctgccctgtgaccctctccctctgtcctgtcttattagaaagaggctctagagctggctgcatagtacctgttctctgggaccttggtgttgatctaagactggtttaactacctaaagagaagcagagacccgagggggcctgccataacccaactctgaaacatgacttaatcccaagtaagatcagctctaacatttgttcagaagcaaaaatgatggattctaaagtttgacttccccaaggtcatctggctaagaggtggctgcagcagggggcaacaataggtcttcaggcccctggggcggcaacctggcactgcccaagagcccgcaggctctgaaggccaactgagccagcggcaagcctagtccctgcctccctgcttggagcagtgcgactataccgttttctgtctgctcatttgtgagcttggttcccgtcctaaatgtgggggttcaaggcagacaaagagtgtgcagttggccaccccgctcgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgc

SEQ ID NO: 6261 - DNA, 773 bp, artificial
  synthetic oligonucleotide
aggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtg

SEQ ID NO: 6262 - DNA, 1005 bp, artificial
  synthetic oligonucleotide
gcatctgctagaaggaagcaaaccatgacaagcaggaaatcatggggaccaggctctggccctctgttccactgcttttgagagacagatggctttgacaaccagaatagagtcgagcagagcagagagcagatacccaccctccccccgcaccaccacggaccatacttctaggtcctaccaatgggatccaaatctgaggccaggctttctgctatttttcccaggtctctgcaggaaactgacagacagtggtgacattttctatgtgtggacccagggaagagactctgatagatgcagggcagtgttgctgctgaaacacaaacaggcctctcaggagagtctgtgtgactctctcactcagacttccaatgaggcgccctcggatatcagatttcccagtgtcagaaaactccaacaagagatagtcgcaagccttccttgggagtccattcctagattcaccatctgtcttagtgcattttgtcttgctacagtaaactacctgagactgagtaatttatcaacaatagaaatttattcaaaaaaaaaaaatttattcctcatagttctggaggctgggaggtccaagatcaaggcaccagcattctggtctggtgaggaccttcttgccgcatcctcacacagcagaaggacaagctagcccaacactgcatgatgtctctttaaaaagggtcttcggccaggtgtggtggctcacgcctgtaatcccagcactttgggaggccaaggcaggtggatcacgaggtcaggagttcaagaccagcctggccaagatggtgaaacctcatctctactaaaaatacaaaaattagccgggcgtggtggcgggcgcctgtaatcccagctactcgggaggctgaggcagagaattgcttgaacctgggaggcggaggttgtggttagccgagccaagatcgcaccactgcactgcagcctggccgacagagcgagactccatctcaaaaaaaaagggccttc

SEQ ID NO: 6263 - DNA, 5287 bp, artificial
  synthetic oligonucleotide
tggaatttggggcttgtatgtgatttgcagttgataagccaggcttgaatgccagttcctgtgtaccagaacaaaggctatggtgtcgcacagacctgctctgccacttcctgctgggtgaccttgagcaagtagcctaacctctctgcaaactggggacagtaatgattcccagcacttgaggtcactgggaggattaaaagagttaacatatataacgcaacaagcacagtgcctggcacatagtaaatgttcaaaaccaaattacaaatgcataaactgttctgaaggaaagctctagatatttaggacttgttccaaatacgtgagggccaaggaagaaaagcttccgataccttctatcactgctgccacaggtggccccgagggagtgggctgatttggcctgagcctccatcccccttggcctagactgctggaacagtcttccgacttcctgcctctgcacctcccaaatcacctttttaacacaacctccatcatggctgtgtctctccccggctcaacaatcttctatggctccccgttgctcactgactgagctccttaagatgctgggggtgtggaggcaagaaccactatttactaagggaagggaagagcaaagagtacgctggtattaggagtgaaaaagaaaaaatatccttttttaaaaagcccctaagctttgaatttgtagaaagcggggccctggggagagagcagggatgcatctctaaagagaacagggcgctcctgcggcgccggctcagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcagaacaaatggccagagctgtgcacagaagaagctacttccacttggatctgaggagaaacatacagttcacctctgtcctgagctctttgatggtctggcctcaggcaccagcctcatcctagaagagttgtcatataggggccttgggttgggggtaaaaggcaaaagtttccaaatttacatttctgatatttccacggtcagtcatgtaatttaccttgatttgtggcctctaatgagacacacccacgggcacttttttttttccaagatggggctttcctcagtagcatttatttatttatttttgaaatggagtctcactctgtcacccagactggagtgcagtggcgcaatcttgactcatcgcaacctctgcctcccgggttcaagcaattctcctgcctcagcctcccaaatagctacaggcacccgccaccacgcccggctgattttttttttttttttttttttttggtatttttagtagagacggggtttcactatgttggctgggctggtctcgaactcctgacctagtgatccgcctgcctcagcctcccaaagtgctgggattacaggcatgagccaccacgcccagccagcagcatttatttattattactgttttttgagacagagtctcactctgtcgcccaggctggagtgcaatggcgtgatctaggctcactgcaacctctgcctcctgggttcaagcgattctcctacctcagcctcccaagtagctgggattacagacgtgcaccaccacgcctggctaatttttgtatttgtagtaatgatggggtttcgccatgttggtcaggctggtctcgaactcctaacctcaagtgttcccctgcctcagcctcccaaagtgctgggattacagacacgagccaccacacctgctcagcagcatttaaaaaattaagtttaaggctgggtgtggtggctcacagctgtaatcccagcactttgggaggttgaggcaggaggatcccttgggcccaggagttctagaccagcctgggcaatatagggagaccctgtctctacaaaaatatacaaaaattagccagttgtagtggtgcaggcctgtagtcccagctactagagaagctgaggtgggaggattgcttgagcctgggaggtggaggctgcagtgagtaaagcattccactgcactccagcctgggtgacagagtgggaccctatctcaataaatatatatatttcacttacgtaaaattctttttaaaaagttaagtttaatgcataaattgtagcttgcaaaattgctcccattcagaaatggcatgaattaaatagactacaggagggttgactgagcctgaaaggccaggaaagcagttgctggctacagacccatgctgccttggagaacagtgcattttaaaaatagcactgtatccctgaaggcttgggtagcccttgcaatggactgtcgcgttccccagccctctcatcccagtccgtgaacaccagccagaaacagtcaccactaacaaacagcccagaaacgccaccctgagcccatccatccaggtttccatctctgcctggtgggcctgtttgcttctgtgctcaaaactttcctactttcctttattttttatttttgagatggcgtctcactcttacccagtctggagtaccgtggcaacgatcatagctcattgcagcctcaaacacctgggctctggtgaacctcctgcctcagcctcccaagtagctgggactacaggcacatgttgccatgctcagctattttttttgtgtgtgtgtctgtacagacagggtctcgctatgttgcttaagctggtctcgaactcctgggttcaagtcatcctcccacctcagcctcccaaagtgctggaattacagatataagactctgtgcctggcccacactgccttcctttagtaacccatga

SEQ ID NO: 6264 - DNA, 1181 bp, artificial
  synthetic oligonucleotide
ttttaaaaaatctctttgtaggctgggcgcagtggctcacgcctgtaatcccagcactttgggaggctgaggcaagcggatcacgaggtcaggagctcgagaccagcctggccaacatggtgaaaccgccgtctctactaaaaatacaaaaattagccgggcatggtggcaggcacctgtaatcccagctactcgggaggctgaggcaggagaatcgcttgaacccaggaggcggaggttgcagtgagctgagaccgcaccattgcactccagcctgggcgacagagcaagactccatctcaaaaaaaaaaatctctttgtaatgttaatatctggcatgcaatctgccactgagtttagttgagaaaaaataattcaaaataatgtgtattatttaacaatgaacccttctattaataggaaaattatattccaggaattattttagattatgctaaaacctactagcaacatgttttaatctttagatatgttctatgtttttaaaacttaaggggtagaagaacataaatcacaagaaagaaaaatgtgagatatatttaaagttcttcacttaaacattttcacaatagattcaggatttaaacacatattataacattttaaaaatatattttttaaccacttactctggttcaggattctttggagaaagtccccatacttcaggagctcccaattctccaattctctctctctcacttaatctcctagcagataaagacatgtaaattataactcaatggctgagttgtttcctaaatatataatcaaattcaataggagtctagttaagccttttttccctttatattttaaacatggataaaaacttggtttaaatgtaaactcatcacttaaggtctgatgttctgatgatactatcaaatggtacagactatagaaatgatggcctgggagactgtcaagtgcatccattctgctgaatgcatgacacagctcttaactgctcatttcatcatctgtaatatgtgacagaaacagcttcacatttgtaagtaacttcatttgtttacagatttatgaaaggtgaagagaagtctcttttgatatggtcaaaccttcagttttcagaaatcgaggaattaatgaagaaaataaaaatgatgcattagacgtagaaaacaactgaagttctg

SEQ ID NO: 6265 - DNA, 1224 bp, artificial
  synthetic oligonucleotide
tttgaaaggaagttgactatttagagaaggcagcacagaagaaacatgagagtaagattaaatgggtataggaaagtctctgaagagaagacagtcaggggtagaggatatagagaaaatggacaagccagcaagagaaggaagaagaggaaatggggaatggagtgaagacttagtcagggatggggcaaaagagatgggccaaaatagtggtctggttatattttaaatcaataaatctgattttacaataaatttgggccctgtttctatttgtgtgcacgtataggagtgtgtgtttgtgtgtgtgtgtgtgtatgtgtatttctgttagaattctggggcttacgttgtgagacgcccgccctgcccccccattattgatcagtagcattccgagctccagtaacacaaaaggttactaggtagcacagcaaatggtgaaagcaatcttgcctggacaaaactgagtctattctgagacaatgattgtggactttggaaagaatgctactttttttccctctccagtttactctaaaccagcgataccaattaggagaaaatggaaagatatattcactttttaaaaattcatctcaaatcctcatatctttggtcaacaagcacttcttcaaacatttctttaagatctttttcaccaagcacctcttgtcagggttcctttcaggatcccacaactttggaaatggtggttcctagctgattccattgaagactgccagctcacagccctcggctcctgtcctcactctctgcaaacggctttcatcagccagcacccccgggcctccctgcagaccccggggactctactcagggagaggcacatcacaagtcaccaaccacacttggatgtaggccaaggattgtacttaggctcacctgaatgatgttcctggactttttacaccatggtcttattttaatagagtgatctaggcaatgattcctccttggtatccttatctgtgcccccactggttctctaatctcatgaatcaaagatcttctccccagatctttgctttcattttttttctgccctggtccttgatagagttcccgggattcacatttgataatgctcggtacttcccttgctctccttccgtactgtcaaagaagctcccaacaggtggaaacaacttgcttttaattttttaattaaatcaactaaacaaaggaggtaatatatgttaa

SEQ ID NO: 6266 - DNA, 1831 bp, artificial
  synthetic oligonucleotide
attcttctgattctcagtccagtgctcttcttagcgggcccagagttgcctctccacataaatatacagagatacaaaggaggaaatctgagcaaacactagacactcaaacagaattgaaaactatcagagcagagccagaatttctgtagacagcaagctactgcgacctacctgtgccttctatacttacaataactccggggtaataacctcctacagtcacattctgggtcctggtggttgcagcaaggcccactgtgagaattaacacggacacaataagcaaagtcacggtgacatagatggagtttcgtttcctccgattgaatgctcctgaaagcacagagagaaattaaaattgctcatttcagctggggaaaggattgacttaaagaaaaaaacactaagaaggttttcctttcctattcctaccggtaactgaagttatctttggtggtgacgggtggggggttgtggggaagggatagagcattattttttgtagtcatcaggtgccacttttataataaaatatgtatttccaatttgaaaataaacaacagaagaaatttcaccagttacgtaaaaacaaaacgaatttttgtgctcctggcactctgtaagagatgtgtcacaactacttagtagagtggttttttagaccaaattagaaggcatatgataaatgggaagtgtgtgtgtgggggagggggtattaaatgaaaacattttaaagccaatatccaactaaaaagatttttttcataagctagagatatgaaatttcattttcagtgtaaatatcacagccaagccaagttactgggatttttttttcatttatttctgacatttgccacctcatgtataaactttaaaatggtgtattggcaagatttgtcacataacaaatgtgtgtaataaagtgagtgtttggaggccattagtccacaaagatatgtatcgggggagttaggtggggaggattataacttatacacatttaggcttatgtgagggtgacataaacataaatgatgagaaacccattctcccactcagggcttatcagacatgatagtgcaaaccaatatttttttgaaaacaggattattaagtcagacagaaaaatggtatctaggctcactttttaatttatttttttttaaaggaaccgagcactgtctcacactctgcagggatttctcaggcatagggagagggccttcaacaggaaataaccaggggagagttactacctaggagttctcaaaaaaaaaaaaataagcaaatgagaagagtctagctctctagtggaggtttggagcatgaggaggatgaagcagtgaggagccctgatggagtcgcccacccacgtggcttgactgtcatttatggccctaaagagatcacttgagtctgtccataagaccctgtcattctgggagacctcactgcagcctcaggaagcagttgttgagagaagccatgcagactgctccatggggagggaggggagaggggatagagggaggggagaggggatggaggaagggggacgaggtcaaggaaacgaagcgagacccaggaggcaaggtggtggtgagacgggaggggttgtggctggccttgcagtccactgcagatatcccctcctgtatggaagaaaagcactgggagtatcacccgggcttaaccccaccatccatcctgtcttccccagtactgtccctgctgaagtctccaagggaggtgggaggggcaggcggtctcccctgacgtcagcttcgaaaatgagggatgtgactcatcagggtcatttctaata

SEQ ID NO: 6267 - DNA, 3037 bp, artificial
  synthetic oligonucleotide
gtgtgtctgcgtgttttaaattttattgttttggttgcggttgtgtcttgacaataaagggagtcccctcagaaatgctgcccttggaggctgaaacactaacctacctacccactgtcctcttccccccacgcaagggaaggtggtgttgccagagctaagtgggagtagctcctaagtagcctagacgctgattcaggcccggactgtgcgggaccagggccagggaactccggggagactcccctgtccaaactgtggaaacccagcgttagcactggactcaggaatttgccagtgccgtcggtctgcggacttcaaaaagtggaatgcgtggcgccggctccgcttctatctgggatttatgattcctttcccgcagtgtggagactgggctgggcgaagcccactcagctgtttgttgcgcagacctttcgagaaacacaagatcgctgagggcccctgggagcccaagaaagaaagctcttcatcttgttccccaacccacagagcagtgcgccaagtagcgactctttaagccctgggccaccaaccagcccactccccgaaggcagacgggcccggggcgctgtggcttgatttgcaggtggttaggtggttgtcgtccgcagcgggaatggacgctgcggaaccccagcactcttccactctgccctccctcgcgaagcgcaacagcttggcgtcggggagccagggctgcgttgttggcgccacagctggccaaggtaagcagtgcattcccacctctctgtctctctctctctcgctctcgctgtcgctctctctcgctctcgcgctctctctctctccctctccctctgtatgtgtgtgcgcgtggtgtgtgtgttggagaaagagtgcgcgcgcgcgagctgggagtaagggggagtctggtactgctgggctcgggattcggaccaagtccttggcctcatttgtaccccgttgtaaataactacgcccttaaaaatgaaaaagcaaattcttatactgaatatgcaaaaccattgaggatacggatctttccaccatccaggagataacactttctggggcccctccggtgaacgagttttgttgacactgagtcttctgcgggcagtagggagattatatagggggttcgatcttctccctgccccctccactcgagatgttcccgcaaattcatcggagaagacctgagcagactgatggcaggaactgcgggacagagggattttgcagaatgtaaagtatgttggaaagagagaattcgatttgattgaagtgtatccgaggcgaattttaaaagattaggtgggatcatgattttacaatcccctcccgctctccagggctccaaattaatttctccgcccagtgaaatcacagggcttgggaaggtgcctaacagctgagggggactgggtttgtttttttttgtaactaccaaaaagcagcttcgaggggcagccaagttggtgcccgaaggtagctgtcccccagtttctataaggaaaggagtcgaagggtgcccctccccctccattccgccctgcgaggaaaagcgcgacttcagaagatgcgcgggctcgcgctggatgtttctttctcgcgctctcactcctgcccctgactcccttttcacactcatgcacattccgtgcatttggagcagagtaacaatcaaattcaaagaatgttgatcccgccgctgcagagggcagggctgggctgtcttgagtgattcctcaggaattcccctcccctcatccccccctttcttctcacccccgcccatcccccagagttgcgcaacccgccccccccccccaatcagcgaggtgcaagtcaggcccccacccaactgcatctctaaatttcagggcagcttcaagagagttgggagggggcgaggaccctgcttctaattgtcgttagtcgtgagctcttagaagtgaccaggactttgcaaagagggagtgtcgaatggaaagcgaaggcgcaggttgcagggaagtgttttgatcctcagattgctgggatttaccaccgactgcaagtctgtagacacacgcacacaaacaggcacacacccgcactccggggcagagatactccgacgcaagcttggcgctccgatctccgcacgtcgctcccgctgcagccaggccgctcccctgggactctggtccaccacccagacgctggggcgcgaagaccaccccatccatgccccgtttcccgctctccggcttttggggcagctggggcgttcacagtccagaggccagggcactcaacccctgctgccgccgcccgaaggaagggccgctagacttacccatggaatcgggcagggacatgtcgctggaccgctgctgagtcagggactgatgcatggtgaaaactgcccggttgccccagtccccgaagctgcttcaagcgcccccggctctgggcgccccgcagagcatcctactccgcggttgcctctctcggtccttccgagagctgagagacactgcctctggttgcgagctgcagcccaagtgccgcctccccctcccttccactcttctccctccctcctcttctgcctccctctgctctgggaggcagcagcattggcggtccgtgcagccgcgtgcgcttgcgcaagaccccccccctcctccctccccctcagtctccccatcctagttatccacctcccagccttccaagccagacagggagcagttttagccccttggggccagggctgcgcagagaaagagggggaggcttcagtatgaagccaaccaaccttctctatagttggacagggtcttgggtaattatcctgttctaggatttataactggggagggggtcagagtcagaggttcagagctgaggaacacacacacacacacacacacacacacacacacttgagcaggtctggtcttagtgcttccagaatgacataatggagctggagatgatccagagaagggccactctataatcaaagggatggtgtgtgtgg

SEQ ID NO: 6268 - DNA, 1628 bp, artificial
  synthetic oligonucleotide
ttaaggttagtctttgttttccacagaatttcacatcttcctaatttgaaggcataaaacagcaacagagaaccataatgcatgaatcaatgaatacactagggacatggtgatgtttaagaaggctaggtaactttttttgaatttcagaataaatgtaacagaggttaataaccacaaatgttaaggttagagtgagatcagtctatgagaagcataattaacattttatactgcaaactatttactactgaaggaaaacatctacacagaaaaattcaccatatgtattacttttaaatcgggggaaagggagaggagatgagtagctttaagcccacaggaactgggttggggatcttttggggaacctcactgtttagatgctatgatttacctgccagagataacagttggtagggatagtagaatgggattcagttaagctgtttccttcctttaattaatgacagagctcagtatatccttctcccttatccccatcaaaaaacattcattaaacacctaattagatgtgacattgttgaaagcgggggtgcatgtgtccagctgcttggttcaggcttgcactgaagaggatttctgtgttcagtggttcttaggaatcaataaatttgctaccagttcaaactgctccacagagcctttaaaaatgtttacactctgtgacccagtaatcccacttctgggaatcagtcctaaggaaagagaaatctggactaagatttacgtgcaacaatgtccgtggcaatgttattcgtaagttaaaaaaaaccctgaaatgacaaaaattaggagaacgattagctagatgataccacaaccaaatgattccatatgttatatagctattaaaattgtatttcaaatatttaagaacacagaaatatatacaataatgagtgcaaaagtaggctaagcactgcatgtatagtttgatcccattttgtttaaaattgtacatatatacagagaaaaatgactagaaagaaactcaaatatccactgtagttatctctgagtagtgaaattacaggagattgctttcttttttatacttttctatatctttcaaatacattcaatgagcatgtattattaaaaagcacaaactacttcaaattctattttacaaatgaattaaacaggcgaatgtttaataaattgcactgtgtctgtcctgcagtgtgagcctagggctgcccaggacccacctactttggtttggtcggtctctctctctctctctctctctctctcacacacacacagacacacaaacacacacacacacacacacacacacacacacacacacacacacacacacagctcttctgtcagtctttcttgcctgaatgctagtttcaggcaacaagtcacctctctcaagggaatttgtacttctttttcattgtatgattgaggcttgttggtgctggcaggtgggcaagtactttttctggtctggctttgtcgatgcccctaaaattacaccggtagggggctgtctactctgtggattgcctggaaggagcagctttctgggtaactgatctgtctaggaagatagaagaaactctgcctaggtgggaggagaggaggaa

SEQ ID NO: 6269 - DNA, 565 bp, artificial
  synthetic oligonucleotide
tttactgcctccctcttaaaatattcatacataataaagtaatttaaccaaaccatacagaagtatgatttacactgtgcttttctccaggcagaaaatggaggtttgggtatttatatgcatatgttgggaggaaggagagtggatacgatgtatggaggcaaagggcaaggaaaaataaatggaaacactacttcacaaagttcttcagttgcaatctagaagggaagaagggttgacagcgggatccaaaagttttaagcagaatatagtaagctttcagtctgacaactcactccgcaaaatgtacttccttgcagacccctatatgaccataactcaacaagaaatagatagcacacttgacaaaaaaaggataattggaagaagatttatttacaaagggattacttacagaagcatagatatagggaaccaccaataacacagtaacccagcctagtaagagctgaactcttaccatctcttgaccataaggtataggagcaggaaatggttactagaactcagaaggaatgagttgtgtacaactggctgccttgag

SEQ ID NO: 6270 - DNA, 1429 bp, artificial
  synthetic oligonucleotide
attaaaaatatcaactagagcatattcacatagggaatgggagagtgcaggaggcacacaaacaaagtatatagagtttttgttttcagtgcaggataaatgaaccttcttaacaagttaaggctctgagggaaaaaaactttctaaaccataaccttaataaaccataacccatacaggtgttccaaatcaacaccttttttaaaaaaagctggaggtcttacttcatccttcagtataaatgtcaagtctgagataatcagtatattccaaactctagaacaacaacaacaaaaaaagaaatctccttgttaaaatatagtagctattaacagtaatgaagaagacagccaaacttttgctattaaatacaatatcatgaagccatttctttcttaactaacagaaaaatacagatttaaataatgctgatcaggaggtggggaaaggaagtcttatcatgaaccaaatttcgtgtctgccaccaatgaaaatgaatccactatgttcttgaatttatttcctgaagcaagttaaattctttaacacctttgattttgcaaataacatcaaagtagtaaaatataagtaactgtaacatataaaattacacatcagcaaaaatgctttcataattggatccaggggcttaaaatcattatttacttaaaaaattctaagccacaatttttcttttaattatactttaacaaaggaagaaaaaaaacagaaaaaaattggtcctaatatattttgtcttaaataagtgtactcatgcccaagttagctaggaactcactgaagttagtctgcatatcttaaacaatctattgcacagcatgtcctggcttttagccaatggaaacgtaacttctaattgaaaaaaacaaacaaacactagatttaactgattacacagactgataaccagtacgacttttccttcttccaatcatataagagataaagacaacaattataaggaagcccaaggccacacccactgcaacaggaataagaaagttgaggtcagagtcagcagaacattcttcagctgttagaaaagaacagacagcaaggaaaggaaattagcaaagaatgcaattaagtagtaaaaagcatgcaagaaacatgcattttgaaagtgtacatagcttagttttttatagcattacctctattttcttatttgctcaatatctcattatcactttatctaaaatcacacgaaattcctcagtacgaaaagcagaaggtaagggaagaatgggaagggtccaaaatagagaattgcgcttgcctaatatgggaagactttaggtttgattatctaatgacactgggttaaggagccatcatctacacttaaaaccactgcctgtgtatttccctactctctttctcttcgtcacacctataattaaagtat

SEQ ID NO: 6271 - DNA, 1171 bp, artificial
  synthetic oligonucleotide
gggacatgctcaggctggagaacagaatctgtcttagcagggtagctaaggtaggtcttcaaacctttcttcttcaaaccttcttccttctgccctctgtacaatgaacacagggtagagtgaagaagatattttctagagctctggagagcaaagtaaaaaggatagtttgtcattaaaaggagccagggttcagtttagtaggaagggagagtttttaacaatgaaatcttaaaaagtagtaactcataattattcgttctgagacaccggaagtgtggtttaaagagaagctgaattgagcatttgtccagaaaatatgagtttcagtatcagaagacaagttagatacgatggcctctaaacactctaccaacttgaattccacagctttctgaaatttcttgtgcctcagtagtagttagagaagaaagtttacagtaaattaaaatacatggctgggcgcagtggctcacgcttctaatcccagcactttgggaggtcgaggtgggaggatcacctgaggccaggagttcgaaactatcctggccaacatggtgaaaccccatctctactaaaaatacaaaacttagccgggcatggtggcacacacctgtaatcccagctactcaggaggctgaagcaggagaatcacttgaacccgggaggcagaggctgcagtgagccaagttcacaccattgcactccagcctgggcaacaagaacaaaattccatctcaaaaaaaaaaaaagaaagaaagaaaaaaaggccgggtgcggtggctcatgcctgtaatcccagcactttgggaggccaaggtgggcggatcacgaggtcaggaggttgagaccgtcctggctactatggtgaaaccctgtctctactaaaaatacaaaaaattagctgggcgtagtggcgggtgcctgtagtcccagctactagggaggctgaggcgggagaatggcgtgaacccgggaggcggagcttgcagtgagctgagatggcgccactgcactccagcctgggtgacagagcgagactccatctcaaaaaaaaaaaaaaaaagaaaatacaaaaggcattcaacagtgatattatgaaaggaaaggcacattcaatgccatcaaactttctttcacaaatacttcagaagaaagcctttgacttttt

SEQ ID NO: 6272 - DNA, 556 bp, artificial
  synthetic oligonucleotide
caggttcccctcctatctctttatttttggtaatttatttgttgaagaaactggatggtttatttagtagagtttttgacatcctggattttgctgaaagctttcccatagtgtttaacatttttctctgtcctctttatttcctataaagtagtggttggctgttgatgcttattcaggttcaggttcttttttaatagcctcaattattgaacacttggatcaactcataaccaataattgaaaaaaggccctctaatgcatttaatcaattctactattgtaattactacccaacaactcattaatatacagaaacatggaaaaactatcatccacccattcttcatgcagcagtttgccactcttgaacaacagggctcatgtcactgaatctgagtagttacttttcacaccatcttgagtgaggggatgacttaagctcacatgcaatatataaatatttccttgcaataaagtaacaagttaaggcaaaacattttgcataatttactactaaacaccataaaaactgccttaacttaagctctttttc

SEQ ID NO: 6273 - DNA, 360 bp, artificial
  synthetic oligonucleotide
aaaggtttcaggggaagcaaagtcagaaaccagagtgcagagggacctcatgggaattgtacttggcttcatggcagcttcagggacctcagcagggttctaagacttttcaccctagagttctgtcattaaaatggctcagctctacttccccctcactactgactgccttaagtgttttcctctgcccaggttagcttttggatagttcctaattcctatttaatttgttgttcctgctcccttataattttggtttgcatggcctatcaagccttcaggtttctatcttttcccttatatttctgactttttcatattcctctctaggtattctttcagcttcagctcctacttctt

SEQ ID NO: 6274 - DNA, 1806 bp, artificial
  synthetic oligonucleotide
tactggcatgtaaaaaataaatcagcagcagtatgatcagttttgagaatgcagaaataaaatcagaaatttttgatgcaacccaaagctctcctagaatgcagaggaaaagaacaaggagataaaaataacaagaaaatcaataataaatataatgggccagtgaatgtagaaccaacatattgaaaggagtaaactagcttgctttaggtagacagcaagggaagggtcccagaagagccccccagcccatgggtcagtgcctcatccccacataacataaaaagcagcctgggaaaataattcaagctgcaggcaccgataagggaactaggacagggtgttgtgcctgaagacatgcccatggctgcacagatagaacaacctcctgcccgtttggataaaacttacacagaacctccagctcactcagataagggaacaaggcctggcatccaaatgccaggacaaaggtcctttgtatagtcagcaggttcccaggaaaagtttcttctccttttgtgggcatgggcacggtgggctctggtgggtttaggtgggcactctactttcctttattagaactataagtccaggctgggcgcggtggctcacgcctgtaatcccagccctgtgggaggctgagctgggcagatcacgaggtcaggagttcgagaccagcctggccaatatggtgaaactccgtctctactaaaaaatatacaaaaattagctgggtgtggtggcgcgtgcctgtagtcccagctgctcaggaggctgaggcaggagaatcacttgaacccagtaggcagaggttgcagtgagccaagattgcgccactgcactccagcctgggcagcagagtgagacaccgtttcaaaacaaaacaaaaacagaaacaaaaaccgaaagaaactgtaagtccagcttctatgaatcatcacctcagctccggattggttccaggccaaggtcccgggccaaactttcacgtcagcttgtgataggccctggggcaagctaagcagcatctgtgaatcatcatttcggcttctgattggtcccctgccaaagtcccgggccaggctgagtcacgggttcgccaagacagcccacagactaagcacatttcttctcttttccggtccataaaatccccagaatgggccccacagtgagtattcctgttcaggactctcctctctactgacagagagctttcttctttcacttattaagctttcgctctaagctcacttttgtgtccgcgctccttaatcgtcttggaggtaggacaaagaggcgttatctcagacagacaatgacggactatttcaatatggcttatctatatatctgaaagacaagaataaatgcaatagaagcaataatagaagaaaacatctataaaattaagaaacagctgaatctgcagatcaaaaggtatcagtgaaactagtaagatatgactgatatctatataatcctgatgaatgttctgaatttcaaggataaagaaaaaacttctataagtatctagtcaaagaaagagacaacaaaaaccaaaaactgggtacctctaaagaaaaaaatgggatatccttagaattttccatagtgttaaatgtcagaagacaaatagtggaacatttacatttttgatgggaaaatgttttgaccaaggagttctctaccctgacagtgcaacataaagatattttcagaaacgcaagagctcagagaatataccctctatagaacccttgggaaatgaggtggggagatgcaaaataaattctcaaagca

SEQ ID NO: 6275 - DNA, 2002 bp, artificial
  synthetic oligonucleotide
acaccagccctgctgatactctacgcatgttttaagagctgcttcttcagataggaagggtcagaactatctcctttgtcagaaagtgagcctttgttttggtttgttagtgtcattacagtcggtcctctatatccatgggttctgcatccatggattcaaccaactacagatcgaaatatctgaggaaaaaaaatttaaaattacacaacaataaaaataaagaaagaaacaacgcagtataacaactatatagcatttacattatattagatattaaaagtaatctagagatgatttaaattatatgggaggatgtacatagggtataggcaaatcgtatgacattttatataagggacttgagcatctgtggattttggtatgaggtgggtggagggtgaaagtcgtggtcctggaaccaatcttcatgaatactgagggatgactaacttgaacctcagtgtccagaagaaattttgttatttgctttagatttcctggcttggaagaggaagtatcttctctttgaattcagggccctttgaggatgttcatttcagtctttacttacctatttgactttacaggccaataggtccaagcctggagcagttttgcaactggcagaaatgctggggatatgggttttcttcatatttatggccattgagaaattttatcaaatgtatgatatacatattatgtatgtgtatatattattttgaaataataacgattcctcctgtatgtcactgtgtaatagaaggttacaatatatatgtttctgttttaagtttcagcaaaaaggagtgaaggagagaagagagaagagaaaaaagtgctttatagaaatgtacactagtatttgtgggttttaagattcttaatattcttgttagaaagtaaaatggcttcccacagtatggatcctttcagctcttagtctttcaggagtagctatatttaaattatattttcatgtggcaagcatttcatttttgcaaccgtgtttgttccttttactattgcacgtagaatattttttcttggctgggtgcggtggctcatggctgtaatcccagcactttgggaggctgaggtgggtggatcacgaggtcaggagatcgagaccatcctggctaacacggtgaaaccccatctctactaaaaatacaaaaaattagccaggtgtggttgcacatgactgtggtcccagctacttgggaggctgaggcaggaaaatcgcttgaacctgggaggcagaggttgcagtgagccgagatcgcgccactgcactccagcctggacgacagagtgagactccatctaaaaaagaaaaaaaaatgttctaagttaaatctctccctttgccatgaattgtttatctctgtgtgaagcaaaccagtctgttacagatcatactggtgactgttccagtttccctcctaaaaactgggattagtcagtgcccttatagaaatcaacatctgagaacctgaagttgatgctggatgtggaatctatatgagagagggaattaacatatatcaacccttaaacatccccttccccaacccattcccaataaaatatcaaccctttccaaatgcagattttcaaatcttgatgtgattaatggaaataggcagtctgctttacagcatgttcctctggtggagggaggctgactcgtgtcagttcaacaataaaaatagggagcactaatatccacagagtttttacagaacgtgcccccatgttgtcacccttttcttccctctgttgcttttaaatcaaccgatgtgctctctcctggcccttcccagaaattgtttttgcgttgaataggcagatggtgggttgagctttgagagaccaaaaaggtcacatttgtacttcagcaattttctctagctttgtagtgcagatgacggtttatgagttaatatctagtaaaccttcacttactgcagtcggatcttaatttttagtgtagttt

SEQ ID NO: 6276 - DNA, 2827 bp, artificial
  synthetic oligonucleotide
tgattctaaaataagcaaatttagactgtttctttcaccagcagttttcaatgtagcccctactccatgttgtggaatccctgtttcctttttcaattcttggcaagcctaactctcctgggctatggcaagggctgtgagagcaattcaagcagtggaatgcaaaaacagagtaataattcaccttttcccaacaataggcctctgttatgggttgacttccaagcaataacactagagtggattaatttgacaatgtatatataaatctgcatgttttattaactaattactaagtgtttcttttttccctccattccagatctgattttcctgctggcctttatccttctcctatacctaacagatttatctccactcaagacattttattcaacgaagaaattctccaatcagctacataagcagtatgagcttggcagctgtagtatagacttttactgaattcccgttttcaaagtggcacccttgcctccattaatttccaatatccctgagtccagatataatattcctgagttcagagcctttctgaagcaacatattcaatatgtgacctctagtctcagggctgtttgttggagaaaaggatctgtaggactaactgtaaaatatatgcactttcaaccaaccctcttgtttatcagcctttacacacaccaccagttttgaggtattatgtctctcagactcctgaaactttctaaggctctatagatctgatggctttatttcttgttgccacccctctcacacactccactgaaatctttgccttctctaatccatccccccaccccccgcccgtcttctgaagttaatgtctaaatgcctgtttctttattgctattttagtcaggtttcaggagagagtgaacaaagataaatgtttgtattatattaacatatttatccagaagaattcaaacacgttgtatctatatcctgaagataactttatcagatacgtttcatttaagaattagacatgcatataattttgtaatctctccagtggctcactgagctaaatgaatataaagatgatctgtgacatctatcatctcattcatatttagggttgattaattaacctagtgagctatgttgttatccactttttttttcataatagcaacaagtgagtgcatttatgctctaaacaaaaaatatgcccagacagaggagagtccttcttcagccaagtattcataaatatacagggctttgcttaagcttccaatgacctcaatatctcacaggcaaattatttttttattggctagtatactctgaatcttgatctgtacttgcatttaagttttaaagtaacaactgaaaaaaaaacaatctaggggcttacgtttaaatattatatctatacgtatcaattttctttacaaaaatctatcctgtgagattttacataattttcaaacagtttaagtcactagtcaaaattataacagtcacaggaaagtagatcagataggaaaaactgttaaactcacttgaatgttttcaacaagattgactattctgtttttagaaaaactgttttgcacttctcttcactatttgacatcatcctttctttcaaatcttatctcttaactattgctcctcaagaatgctacactccagcgaatgttatcaatatttttctctatctgtattttaccatcctgatttcatattttcttcccattatttattaggatattcatctaccaacaaccttcacgaaattaaaatctttcccttctctaaggtccaattaaattgccactaaatggccacatagcattcatccatcctgaaacgatcccaacttatcctgaaattccaggataccatttttataccattttcatagctcctaccttgtattacatctatttatatgcctgctttatattattagtttaaataactaaagcaggttgttaaaaaaaacttggactatgcagtcagataaatccaggtttgaattaaagctctgccattcactatctgcatgactctgggtaaatcactgatttcattatgagcaccaaattcaagatttgtaaaagtgaaataataataacggtcttgtaggcttcctttaatgattaaatgtgattgcataatcttaatacatactacaacattatgaataataataaatggtggttgtaaatttgttattgtttcttctaggctctaaaaggctacatatggaaccatgtctgttttatttttaatttctcccatatcacctagaaaaaaggtatacatatagtttgcctaatgactgaatcaatccccttaaaagtgtttttaatctgtaaatgtgattgggaacttttagaatatatcgaggatattttaaccatgatagcctctggcccagaaataacaatcataaatgaagtgctccatgacttaacatttacttccaggatttgtttccatcttataatactatgtatttccaggaaaactcaaaagatacactttcatgtgttcaagttatttgtgatatatatatacatgaaatcctaagtcaatgtggccctaccaaaaggagggaaaaaataaaaacttgtactttccttttaaaaaatcaatttgttctctacttcagccatagatacaaaaaataatttttgttgaaaaaatagagatatggagcatattaatactttcagacactatcagcagaaggccagagcatgtgctatgattccgttggctggaagtttgcactttatagccctgccagagaacaaccatgcaatgattagtattcaaccatagaagg

SEQ ID NO: 6277 - DNA, 6800 bp, artificial
  synthetic oligonucleotide
aaaacatcttcagataaatgaaaattgaaacatgagataccaaaacattcagaatgcagtgaaagcaattataagagcaacattaacaatgatggacacttaaatggagaagtaaaatctcaaaaaaacaacaacttaactttacactttaagaaagtagaaagagaacaaatttcagcacaaagtaagcagaaggaagggaataataaagatcataaataaataaataaaaattagaaataaataaaatagacatgagaaatacaatagaaaagattaataaagctaagagttagttttaaaaaatataaacaaaatttaaaaaattttagctagacaaggaaaatagaaagaagactcaaataaataaaactataaatgaaaaaggagtcattatagctgatatgacagaaatacaaagaatcatagacaactactatgaacagttatatgccaacaaattaagtaacctggaataaatggttaaatttcttgaaacatacaccctgccaagactgaatcataaagaaattgaaaaactgaaaagaccaataatgaataaccgcaaaaagcctatgacttgatggctttattactggattctaccaaacaattaaggaagaattaatgctaatacttctcaaactcttgaaaagtagaagagggggagctctttttatttcaaagcataaggcaagcattaccttcgtatcaaagctagacaaagacattacaagaaatgaaaattctagaccaatatccctgatgaacatagattaaaaaaatctaccacaacatactagcaaacagaattctacagcacattaaagggatcattcactgtactcaagtgggatttatccctaagatgcagggatggttgatcatacgcaaattagtaattatgatatatcactttaacagaatgaaggataaaaatcatgactacatgagtagacgcggaaaaagaatttgacaaaattcaacatcattttatgataaaaactttcaacacttttgatatagaaaaaaatgttactgaacacaacaaaggccacagacgacaaccccacagataacatcatactcaatgatgaaaatttgaaaacttctcctctaaaatcaggaggaagacaaggatagccattcttgccatttctgttgaatatagtattggaagtcctagccagaggatttaggcaagcaaaagaaataaaatgcatacaaattggaaagaaatatgtacagttgtctctgtttgaagatgaggtgatcttacacgtagaaaaccctaaagatgccattaaaacactgttagaactaataaattcagtaaaggtgtaggatacaaaattaagataaaaaatcaatgatgtttgtgtacactattagggttctctagagggacaggactaacaggatagatgtatataaaaaggggagtttattaaagagtattgactcacatggtcacaaggtaaggtcccacattgaccatctgcaagctgaggagcaagatggccagtacaagtcccaaagctgaagagcttggagtcaaatgtttgagggcaagaagcatccagcatgagagaaagatgtaggctgggagactaagccagtctagtcttttcatgctcttctgcctgcttttattctggctctgctggcagctcattagactgtgcacctgcagattaagggtgggtctgtctttctcattccacttactcaaatgttaatctcctttggcaacaccttcacagacacacccaggaacaacactttgcatttttaatgcaaccaagttgacactcaatattaatcatcacaagtccaacccttgtcaacttgaatccatacacatctcttgaaatcatatatagtattcaaatgaagacaataataaggtcataattacacctaacataaaacaactatcctttgtacaaccagaaatgcataaattcccaacccaaatactattacataaagttaaccacacttaaatgctgatatgaagtcaataaatcttatatgcatgataaaaaaggaaataaaatgaagacattttcttagtacaggtgtatacatggacaaacatgttcttaacaaaaaggaggaaatactcatgacaattacagtccgcgtttctgcacctggtcatgtggtcatagctggaattgatgactaccttcttctaccactcattctgtactccctttgcattcagcaaacacctcagcaggttgtgcttttttatctagtggagttacccaaaccttcattattaaagggtctggtccatttgtagtcctgcctggattagactgttgtagtttcccattgatcttaaccacagggcatggtaatactaagagacactctaagggatctcatgtatcccactcatactcatccttacctccattgtggagtagtagactgatttcctcttgatagtctgggccagtcaccccagccaacactgtaactcccttcttagcctgttaacttaaaggtaggaggagccaaaggtggccagggggcagtcttaacttcctgtttactggaatcattatgtctcctggtggcagtgttcttccctctggaactaagacctccaggcctgcagaatgaaatgtcgtgggaataggaagcaaaaattttgctagtgggtcactagggataatggtgagtggtgccacttccacttccaccccttgattcctaaacccatgaatcctggctatgcgagaaacagtaccatatattgaatgctgattcagagcatacacagccttcaggagagctttgccccagtcctgcaaagtattgtcacctagttgtcattgtaattgtgacttcaaaagtccattccacccttctaccaacccagctgcttcaggataatgggaaacataacaatgaactatctgaaaaataaattaagaaaacaatcccatttacaatagtgtcaaaataaagtaggaataaatttaaccaaggagttgaaagatctatgcagtgaaaactataaaatattgatgaaagaaattacaaaacatgcaaataaatggaaaaatatcccatatttataaattgatattgttaacatattcatactattcaaagcaatttacagattaaatgcaatcactatcataattccaatgagatattttacaaaactagaaaaaaatcctaaaattcatatggaaccacaaaataccccaaatagtgaaagtaattttaagcaaaaagaacaaagctggaggcatcacactctctgatctcaaaatctactgtaaggctatattatggtaatcgaaacagcatggtgccagcataaaagcagacattcaaaccaatggaaaaatagaaacctgggcaacacagagagatcctagctctatgaaaaagaaaaaaaaaaaaaacaaacgctgggcatggtggtacatgcctgtggttccagctactctggaggctgaggtgggaggatgatttaagtgcaggagtttgagcctatcgtgaccggtgattgcaccacttcattccagcctgggtgacagagaaagaccaggtttccagaaaaaaaagaaagaaaggaaaagaaaggaaaggataggaaaggaaaggaaaaaagaaaagaaaagagagattccagaaataaattaaaataaattttatggtcaactgatcttttaaaaaggtgctaataatataaaatggggaaaggaccgtcataaatgctgctaggaaaattagatacccacatgtagcagaattaaattggatccttgtctcacaccatatataaaaatcatctcaaaatggattaaagacttaaacacaaggccttaaaatgtaaaactaccagagaaaagcatctagtcaaactttttgacactggtcttagcaaatatttttcttcagatatggcaccgaaagcataggcaaccgaagcaaaaatagatgtatgaaattgcatcaaactaaaaagtttctgcacagcaaaccataacagagtgaatatataagctacagaataggagaaaatattttcaaactatacatctgataaaggattgatattcaaaatatgtagtgaactcaatgaactttatggcaagaaaacagacagcctgattttaaaatgggtaaaggacatgaataaacatgtttcaaaagaagacataaaaaatggtcaacagatatattaaaaaatgctcaacattgctgatcataggagaaatgaaaattaaaacctgatatcagcttacacctattagaatagctgtcaatgaaaagacaaaacataacaagtgctagtgagaatctgtagaaattagaatccttgcacactgttggttggaatgtagattagtatagccattgtggaaaacagtatggaagttcctcaagaaattaaaaatagaactaccatatgatccagcaatcctgcttcttggtatatatccaaagaaaatgaagtcactatgtcaaagagatatcttcattgcaacattattcataacggccaagatatggaatcaacctaagtgttcactgatggtgaatgaattaaaaaaaattgtggccaggcgcggtggctcacgcctgtaattccagcactttgggaggccaaggcgggcagatcatgaggtcaggagttcgagaccagcctgctcaacattgtgaaatcccgtctctaccaaaaaatacaaaaataagccaggcatggtggcggacgccagtaatcccagctactggggaggctgaggcacaagaattgcgtgaacccaggagatggaggttgcagtgaaccgagattacaccactgcactccagcctgggtgacagagcaagactctgtctcaaaataaataaataaataaatacatgtacatgcatgtgtatgtgtaaaataggatactatgcaattctaaaaaagaggatatcctgttatttgtgacagcatggatgaacctagaggacattatgcttagtgtaataagccggcacagaaggacaaatactgtatgatctcacttatatgtggaatccaaaagtgaactcatagaagcaaaaagtagaatggtggttactaggggctgtcgtggggggaatagggagttattggttgaagggtacaatatttcagttaaataagagggatacattttgcagagaactatcatatactgtaatgactactgttaataataatatattgtgtatttgaaaattgctaagaatgtaggtcttaaatgtgcttattacaaaaacataataagcatgtgaaagggttgttaattcactctaatcactttcctatatattatatataatatgtatatattatgtacctatgtatattatatgtatatattatatataatcaaaacatcatgtactctgtaagtatatgaatatttatttttcaattatacttcaataaagctggaaaaatatactctttgcataaaagtttgcaaacttttttactcatcaattctagtagttctgtggagccctgggattctgtgagggtatctcaaaggccacctcacaggctattagatgttattataagctcctcacctattcccatgcaagttctttgaatctttaaagtaaaagtaaataaaaaatccaagcaccttgtttttcttttaacagcagaatttgtccaaaaatatttaaatcactgacttaggctttagtttgtttttatttattttattttgtgaaatatgctccagaagagccttgatctttcttcatttttatgagactgatatactgaatatttatctctaagaaaacattcagttactaatttccaaaaggtttctcaaaacagacttcccaatttgggtagtataaatcatggtttgcttttttccctgaagctttccttctgaaatggaaaatgggatacttaatattgagaatgaaggaaatggttttgctaagaaagatcacctgcctctgtaatactcaaatatgtttcaaatttaactaatcctactctatttaccacggaaagttgtttgctggagcaattttgccagccaagtgtgaaaaacatttattatttaaaaaaataattacatatataaatttataattaaataaattatattaaaaacagagaatactcaaaactcataatgtgctaattatcgcgggatatctttactgctatctatattctcgaggttatgtacctctcttgcatctgtgtggttgaaatactgtataatggtgctatagtttggatgtttgaccctccaaacctcatgttgaaatttgatttccaatattgcaagtgaggcctaaagggaggtgtttgggtcacggtggcagatccttcatgaatggcttgatgtccctgctgtagtgagtcctcactttattagttctctcaagaactgattgttaaaaacaccctggcatctccctcccctctgtctcaattcctctgtctcaccacgtgatctctggctcacgcctgctcctttgttctttctgtcatgaattgaagcagtctgaggcccttaccagctggagatgctggagccatgctttatgctacatggttatatagcctgcagaaccatgagccaaataaatctcttttctttataaattacccagcctcagtatttctttatagcaacacaaacagcctaagacaaatggtatgctgctgtgcatttattctcaaatccttgttccatgacattaggttgatagcttgaaaacagaaattggcaaatgctacaaattacaactat

SEQ ID NO: 6278 - DNA, 863 bp, artificial
  synthetic oligonucleotide
gggctgtcctacaagtcatctaagtgaacaaaagccattataaggatcacaggccattatgagtccaccatgtaaccaaaaccccaaaatctgatgaagggtaaggaattccttgccattcataagatttttacaaggaatgatgatttcacaaagagtaaacccatagcatagaggaaatcatcttgtcctgaaagtttaccttctccaggccagctcttcaccctagtcttccagtgaagttcaatgacaactgtatgtccattcacatacttttctacaatcttagagaaaaaatacctgtttcacattttattcccactaaactcctgttggtggctatttattgtaactgcaaaaaatggtagtatacattaatcaataatagggtgagttcaggattctaatcattcttaacttgatgaaaataaaattatgtacttacagttaatgagctaatgagtattctgtcagacactgagcttatcttttatgcttttgttgtaggcataaattaattccagacataaagatatgactatcagaattagccttattcaaagatagcagaagtagtgaagtgagggggtgtgctgaagctgtgataggtggcataaaaaggcaagctttgagtttcagtttcagatcatacaaagagcttggaatttgtcactcctgtccttaaaacaatcaaagtatgaacaaacaaaaccaatgacatttcttggacccatgtgacagcttaagtcacagagcaaatcactaccaccaaatctggaaagacagtcacatccagagaaacatagcccccaaaacttgcttacctgttacagaagccacagaaattcttaatctggtaggga

SEQ ID NO: 6279 - DNA, 573 bp, artificial
  synthetic oligonucleotide
agctagaatctgatagagtcagagtttgaattgaggcattcttaatctcaattatactgtctttcaaatgctactatttaatttttacatttagatttttaatccatctgcaactccttggtgataccatgaaaggcttgtgtttggtttgttttgtttctttggtggttactcaattgtcccaatatcatttgctgaataagcattcttaaagtatactttaagaagtagtaaatttgtacatagtatcgaactgctttcttggctattattttgtatgattaatctgactatacctttactgataaccaccatcataaaattacaataccattgttaaacaatgcaggatctcaactcagattttttcaacttcatctaaaatattgtgctttttcttactataaagtagtccttcacttttatattaatgcagaacaatgcttctattcataagggcttacagcacaaagagttccactgcttactgtgagttaagtgatgttgcaatatcaaacgtgtactggacacttactcttttctaggtactgtgctatgtgttaggaacacaaa

SEQ ID NO: 6280 - DNA, 4391 bp, artificial
  synthetic oligonucleotide
ggataaaacccatgccttctacagtaactgtaaagtaaaagtgaaaaacgtgagagataaagaggattctttttcctcattgcgggagaaaggggctagggagaggagtctatagcccaggaggttcatccgcagcatgctatggagaaggccaccgtcactgaaatccggtctgtactgtaggacttcataggttctttgctcgccttagagcagaggggaagaagagtcagaaagaattgataacctctgaggtcatcagtcaggggcctaggctgctaagtccagaggcaacaccaagggatcaatgcagctaggtacagttttctccagcctcaactttcaatccccacccccagaccagctcattcccacacctccctcctccttggtcagtgagcctgagcgtccttttcattaaccttttagttactacctctacgcacatactttttcctatgccctccaaagaagtcagccccatactgcccatcactgctcagcaccgcccaccccatgcccccgcaagccggcctcagcactagtttaaggggagggacacgcctcccaaagctgcggggatgggggtgggggttgctcactcgccctcggatctctgctgtaaaagcggagcggcagagaccgggcatgcgcagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacata

SEQ ID NO: 6281 - DNA, 2642 bp, artificial
  synthetic oligonucleotide
ctggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactgggga

SEQ ID NO: 6282 - DNA, 4081 bp, artificial
  synthetic oligonucleotide
ctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttca

SEQ ID NO: 6283 - DNA, 678 bp, artificial
  synthetic oligonucleotide
ttcatgtactcagtcccactatgggccagttggctttccatagaaatggattgcacccttggcttcagtgccaatctcaccccgacctcagccagatcaccttgcactcaagaaggacaagtcatattacagctacatatgtgtgaacattcctatcatgagaacaattcaatctttgtttaggggtgtaatgaggtttgccatcacttgaacaagatttaactggaaaaaaaaggttctaacttgaatttggggctctggtatgagtccacatagagcacatttacggtgttttagagcaatgatgagctgctataacaaacaatactaaaaatacaatgattttattttccttgtaataaacatttttaaaaaccactttgttgaggtataattggcatgtaaaaaactgtacttatttaatgtatacaactcgataagtttggagataagtatacacctgtgaaaccaccacgaccatcaaggccatattcctatccattatctcatgaagtttcctcctgcccctttatcgtgtgtgtgtgtgtgagaatgtgtgtgtaggaacgcttaatatctactctcaaaaaattttaagtatacaatattgttagctataggcactatgtgtatagtagatcttgggaactatttatcttgcgtaactaaaattttgta

SEQ ID NO: 6284 - DNA, 322 bp, artificial
  synthetic oligonucleotide
gaaaaatcactgcaaaacccatgagacaggaatatgcttggtatgtgttcctggaataactcaaggccaagaatttgattctttgttctttctggttctttgtgttcttttctccctggggtaataagcttcagtttattctctatctcataaatagggtcatacaatacatgctgttctgcaacttgcattttccgttaatgataaatcatgaacatcctttcatgtcactacatttaagatctgcctcatggtttataagaattgcatagtatttcataatataaatgcactagggatttattcgggaaaaaaaatcaat

SEQ ID NO: 6285 - DNA, 2189 bp, artificial
  synthetic oligonucleotide
tctttttcttaggaattattaaattagcatagttgtcaaaatttgtcccagttattattgttgaatagcaaattacctcaaaacttaggacatagccaggatcatggtgtctggtacctcagccaggaaggctcaaaggctggtggctgaaatcatacggaggcatcttcacttacatatctgatgctggctgtcatttgggacctcagctgtactgtctgccagaacaccaacgtgtgacttctccatgtcagcataacactaggctccaagagcaagtgtcccgaaagaccagaagtggaaggtgccaatttcttaaggcctgggcccaaaaactagcatagcgtaatttctgccatattctattggccaagcaatcacagagattctaggggagaggacataattcttaacctcttaatgtgaggaacgtcaaagaattttggggccatatttttaaattgccacataactcatcagctttcatttatgatcaagtgcttagtgtttaaaacttgattgtcctatgaattttagtatcttttgtccagtagtataaaggcataaccttatatttctaacttgtacaattttacactggttagttatatagtcccaacatcacagttgatggggaaatctcttttattaccctgggccagttaaagtagttagggctgatggtttataagttaaaagaaacttttctgttttttaaaaacaaaatgttatcaaattgaaagatgatgttttctcatatcactaaatttttgaaagtttttatcatctgaactagtagttaatagttataggtgtgtgctgggccatcaaatctctctctctctttttttttagacctcatggaaacacatgaatgggtatttatattacagaaatctctcttttttttttagacctcatggaaacacatatgaattggtatttatatcacattttacaaatagattattaaaccagatacgtcaatttttacaggaagaatcaatgctctcattcaggtttttggggagaatcatagaaattggggcattaataagttaacagaaggaagtatgaatactgataggttggccaagtcaatgcaattttgaagacagtattggagcctgaatgcagtagaacttaaaggctgatgtaattatattgcaaaatgtggagtttatgtttaatctattattagagtattagctattcatgcattttctttccactcttattccttaaaaccttacacacatttgcaaatatgtataatcttttttttttttttttttgatggagttttgctctttttgcccaggctggagtgcaatggtgtgatgttggctcaccgcaacctccccctcccttgttcaagcgattctcctgcctcagcctcccaagtagctgggattacaggcatgcgccaccacacctggctaattttgtatttttagtagagacagggtttctccatgttggtcaggctggtctcgaactcccaacctcaggtgatctgcccacctcggcctcccaaagtgctgggattacaggtgtgagccactgcgcctggcctttttttttttttttcttttgagatggagtcttgctctgttgctgaggctggagtgcagtggtgtgatctgagctcactgcaacctccacctcccaggttgaagcaattctcttgcctcagcctcccaagtagctgggattacaagcgcccgccaccgcacctggctaatttttgtatttttagtaaagatgggatttcaccatctttgccaggctcgaactcctgacctcgtgatccgcctgtctcagcctcccaaagtgctgggattataggcgtgagccactacgcctggcctcatatgtataatcttctaatgaaatagttttcttctaaattcacaatcaaaaagtgctatcaatttttttctcccaggtcagtgattttaaaaattactattaattcagtaacaattgtacacaaatttgacttattaattatggcaacatttacagacatttgaaaaaagtagcttttgcaggtgtgaaaccttttttctttttagtccaatgcttaattaatatttgtatagatttgtggcccccttgcagttgcctcttactacctgctcagtggtctgcatcccataggttgggaaccagtctcctattgcttc

SEQ ID NO: 6286 - DNA, 2425 bp, artificial
  synthetic oligonucleotide
tctatgtacaatttctaccattcccaccttgccctctcctacctcataatctgctttcagatagcttttagaactattttgacaaactaattcacactaacatgtttactaataaggccaaggggccgggctcagtggctcatgcctgtaatcccaatactttggaaggccaaggtgggaggattgtttgagcccaagagcttgagaccagcttgggcaacacagtgagaccccatctttacaaaaactaaaaaaattagctgggcatgaagatgcatacctgcggtcccagctactcaggagggcgaggtgggaggattgcttgagcccaggaggttgaggctgcagtgagctgtgttcacaatactgcactccagcctgggtgacagagccgagaccctgtctcaaaaaaaaaaaaaaaaaaaaaaaaagtagaatctgcttcaattggtcttaagtgtggcctgagattctgcactgctaacaaatgctgtcagtgcttcaggtctgcaaaccatactttgagtagcaagactttatagtacctaatgacctgttgcactcataagtctatagtttaactgcacactgaagtttatggttttcttgataattaatctaacagtatgtatcatcttagtttgttaaataaaacatggaggtagtgattgtgatgaggggtaaaggaatattttcaagcaggtgcgatgaaatgcatttattcaacaatttattacatcagaagttggtgctaaagcgaataagacactccctgtccttaaggaattcatattctagtgcaccttgactatcactttgaaatgaaaagtatggaaggtagtagctgagagtttgggtgacagacactgtgctaggtatgatttattttgatcctctcagcaaccgtgtgagaaaggtaatgggaatttccactttcataccatagcaagctgagactgaagagatcatttagtgactttgctcagttatacagttagcaagtgtccgagtagtaatttgatgccagttccttttgatttaataatctcatgctgtcttctactgttgtgcttcccaaaactaaaatccccatttggatgagaacaccaacaaaagtaattaagaaatcgaaatggttaactgtgatcaaaattaatatgggcagttaggatcaccattttttaatgtatttgtctaatgtcaggagaacttttaacattcgttttcttagttacatactagatttgcaaaaaggtgttcttcagattactaaaataatgaaacagcaatattaactatgtgtatctatttttgacatttaacatttagagaaaaataggggcctaatagtcattttttatttatagtgattttatagcattctcatgtatattgaatgttacaactgaggggcttttatttattcttaatttgataatagtttagctgcttctgctacaaaaattaggaaaattagcacatgtacttataactgtagttttatagcattaccacatgatggcagcagtcacataactgaatgctcagtaatctttaaaggcttaggtgtctttagaagtctttgaccatgtaattttttttttaaagttaacagtttattttttaaatatacactaaactatactccatactgtcttaaccataacttaagaaatggaataatggaaaattttgaatgtcaaattctgtttgcctttatacaataccccacatctgttcttactgaagcccataataccggagtcatctaaacagtagcaaaattgggatttaaattctttaatgtccagttctgagattctccaattctaagggaagtaactcaaagcaccctaatgtagacacttcagtttgttactaaataaattgtaaaaatatctttttaaacacttaatttttaaacatgattttctaaataaatcataaaaaatatctttttaaacacttaatttttaaacaagattttctaaataaatcgtaaaaatatctttttaaacatgattttcacattatccaggagtggtaatataaaaactctgaacatattttgtgttgcatatacataaaattctagatttatggtgtagctggttttatatttggacacaaaattggtttataccattttgataacagttgttttctgccagaattgccaaaatacactgaagtttgatattaaatatgtttaagtatttattaatgttaacatcagaaacaggcagagtttgtgttggcacagaaaagaaagtgtcactactctcattctcttgtgttgagattctcttattagaattatttatagtataaaattggtaaagaagggctccatgtaatggagctaatttaatgttctagtaagagaatctacttataacctagtctgtacaaaacaaaaagaatc

SEQ ID NO: 6287 - DNA, 1589 bp, artificial
  synthetic oligonucleotide
cagaagcatgcccatttcctttgggaagattctttttttgaccctggataaattctggtaggaatattgatcaagataccctgccctctcctagtgtaggagtagtgatgtggacccaagctaggtcaattagaagcttcctcttgaatttgatctatgaatggagtaataaaaagaccgcataaagtgttaagcagttcttgctctacatcttctggagctccctggtttctgctttggtttctgaggagttggtttttccagtctcttcttaaacctgttcgctgccctgtagccttcaaataaattccctcttttcctaagttagccagagttgggttttgtcacaaccaaaaaactccaactcatataagggtggttcattaaatcatttggcaaatatttattaagtacttactatttgccaagggctgtactagtcaccggggagggctttccaagtgtttaatgcgctgatctcttttgtcaataagaaagaaaactgggagttaactctctgccttcattataagtgccaagaaaaaaaagagactctaggagactcccagtgctccacaggagaataattaactatcattaaataaagtttaatagaaacaataaaaacactaacgttaacattatgatgattttgtctagttgaattaattcagagctttaataatttccaactttgtaacaagtttctttagaggtcatagttattgttatactcctgagtaaatttgggtaaatccttgttgctcaccactcaggcacacattacatagtgttgcctatgtgagaagcagctctatcaaaaaccaatgccaattatttgaggcatttgcatttgggacttattaatagccatgggtgaaaaagatattcacttggtacttacggcctttaaaagatgaagcagtagtttgaaggaaccagtggtttgggagaattaaatactgattcctattgtaccccgttgacatacacagtttaagctctgatcttgtcttaaattattggaattgtggaaactgctccattaataacaattttagtaactttgggggcttagtaattggtttcaacatgacctttctcttgaaacatttagactctcctttcagattccagacatagaactagtgtagattctttggcataattgatttggagttcaaatgtaaaagcactcttttctcttacagaagcatctgaattcatatctcatgtatctcctgatcagcagccaaatgtctctttgaactgaactttggtttcaattgcctgtgaaagaacacgattcttctcatcttcctccaagcattcttcttactgcaattttatttgcccttgaaagagcctgtctttgcaattggcccttgcacgggtgtccctttaaaattgggtttccagatccataaaaattctaatttaaaatactattggttatgacttcctattcttggtaaaagaaaacaaatactcttggtgatttgaaactaagatattttcatctttgggacaaattttgtagcatttaaatttattcattgtgtggagaaaaaagttattttgaaaaattg

SEQ ID NO: 6288 - DNA, 1162 bp, artificial
  synthetic oligonucleotide
actaaaccctgactcccaggtaagatgcaacccttactgaaatagcactatgtcagcaaaacatggtctcattggctcattatcaggtgaggtcaggacattatttctggtagcttctgaaagccacagcctgttagaaaaaaaaaatcttcttcctgagggtttaatacagcttgctctcagttctcaggagcgctctcgctcgatccctctctcttttcttgggcctccttttaaaatgctaattaaatttacttgatctccactccgcgctccccccgctaattttggagatcaagaaagggagcttgatgtgtataatagatgtgcttgtctttccacctgagctacctttgtatttcattcccttttattacaggaaattgtgtcggggccctaaacactaacatacataacattgattgtattctgcataacaaattggattaggataattaccacacagatgttaaaaaatcctgaatgcaaatcaatgcaattagtcatgacttaatatactataattcacacattggaatgtcttattgtgattatactattttagaactaaatgcattaacaaaaaaaattcttttgctctgtgctgcacgtgctctgaacaagaaattgttttatgctaatctggaattccaccactcagaattcttattaactaatcagatccttcaatttctcttgccctcttttatatagagaaagccgcttctttagcaagacaatttcatgcgcaattcaacttgaatgccaccattatgaacaaaggaatttgcacacggatgcttttgacaaacatggctttagaaaactgagccttggtggtggggggaaagccctccccactgatggccagaccccaaaacaaagcagatagagtgtaagcaattggaatgggtccaagttagtaggcaaaaagcagacctgtcacaagggcagtaggctcagagctgccagaaagggttgtgcagcttgtacccagctgagagggtgagtgggggctgaactccagcctggaattcatgctccaagctgtgcaccaaaagcaatgctgtctctgaccccaggaaagggctccttttcctaattcacacaaaagtgcctgtgggtacaaggcaggagttcggtcacagagaaaaaataacag

SEQ ID NO: 6289 - DNA, 1251 bp, artificial
  synthetic oligonucleotide
gcctcctggcaattttagaactaaagatggctattctaaaccattcttctaagcctgcaattctaaaactccccttttctattagaaagcccaacactccatcaaagaagaagaatgattaaaggaaataaaacataaggcaatgtactttctgattacatctcaacaattgatgtctggctttcatgcaaggtactaaagtgcccgtgtactgaaatgaccatttctgtttaaagctgaagcaatcaaaacaaaaatgggcaaaccccttttgtattgccctggaaaaatagatcattttgaagggtgtttttgttgtttcaagaatctgtttaaccttccattacacagaaccagggcataccatctagcaaccatgatttaacaccaattcttttgcaaaatgttgctttgaaaatattttgtttatgttcctagaaatcttgatcaattactgctgcctcctttccagtttcttctgccacacatgctcattttgaaaagggaatccaatgatcctaggacaacacacattatttatgtgaaggccaacttcctgctaaggattgggtatcttgtttacagttaacgaaaccccactgaatggggcttactgcacattttctcttcaaagttttccttttctttgccaaaaagccaagcccattgtataataaggtaagcacacttttaaacataccagtcataccctcttgctactttgttcagaacttcttttgatgcttataaatatgtctgaaataaaaaatctccttgaaagccagtgggtggtgctttatgctgatttcaaggaagaaaccatttttcagatttatgaacaacaaagagacacaacacatatttctcttagtacttgactgagaggatataaacacaaactgggaggtatgccagtgtgatcaatggacatttacttctcctcccagtaaaaccatttgtcggcaaactactggcctattttggaggataagttaaaagaaattctttaccaattttgagacagatgacaatacccacttagtgccctagattgttctttttaataattttaaacactcgactgccaggaaaccctaggggatatgtttggtaaaagatacaccaaacaaatagcttagttctgtaacagatatgcacaactttcttataattttaaagaactgagttttcttaaaatgaatgaatataccctctttataatcactaagaagatgaacttaaaaggaataa

SEQ ID NO: 6290 - DNA, 1075 bp, artificial
  synthetic oligonucleotide
ctgcaatttttgttggggaaactaaactatgaggatttttctcattgttttgtatgattaatattagaaataacagtaagaaaaaaaagtaaggttatattggcaagtgtaggcagtgccagctcaagctgtttgtttaagggctgaaaaaaattttggtgtacaccaaaaatttcactaaaatcaagcaatgattcaactaataacagtaaacattattacaaacaaaagtttgtgtactgtgtgttgtttcaccaagtatttggatcattttcattttactgatttcaactccttccatttctcagtagtaaatattctactagaaagtaggactactataagtcactgttaactttatatcagtagaacacacgtgcacacatgcatgcacatgcacacatatatacatgcatgcacacacatatttttggtgtctatttctctaaaagtaattagaagaacatattagttgatgaggtatcatatctgttttattgcatatggttaaattaaataccatctctaaccaatctttacaagtaccttgctatgataaagatttggctttactgtgggataagtatcacgttttctatgcttgaagtataatagtatctcctcattttaacacagaaaacctataacataatacttgtccctcagcctcagctttacaatgatgcttcaatgtatcttagtagttttaatactatcttaaatctgaacaattaaactgaagagattcaaaatgatacaaaatgtcagctagctttaactgaacaaatagcaacatacaagcagcataacaacagcgacacactccagcctatataaaaccttgagaggattctcaaattcttgatggataagaacaaaaatcccaaggaatctagcatgtgaagatcaaaagttgtaatgactttgagcttaatgtttcatggatcttgactgtcacatggttttggatttcctttataaaggaactggttaactgttctttggtaggtctgaataacctgacaagacagaaaaatccatgcctgacttacaacttttgaattcgataaaataa

SEQ ID NO: 6291 - DNA, 1299 bp, artificial
  synthetic oligonucleotide
caagtgtatgtgtgcttgttctttgtagggttctatagtagaaatagaacacatggtctctacatactggaccctctagaacttgagttctgtgaagacaggaaatgggtttggagtttttcactattgtatgtgcagcatctaaacatagtgcctgtcacatagtattttgtaaatagctatagaatggatcagtggaagaccttacatagaaaattgacttcatgtgaatgtacagtagagaactacagcaattcaaagaagaaaaaaaatgaaggaaactacctgcccaagatgtgcctatctgaagaagggagactacaaacatatattaagagtcctctccccttttgcctcttggtgctaaggaaagaaaagcatctaacaagggtaagtgatctttagaaagatgaagaatccactgagattccccaggatatgaaattccactgttattaagatccttatagtcttaggctgtttttataattttaaaatttcttgttggcggtatcagttttgagtgctggtactactgatggtgttaattaagtttccttcttttaagtaaaacttaaggtgcttggtatcttgccatatgccctaaaaggcaatcctgaataggtatcactaaagaggaatgacaaagttggcttcagacaaaaggatcaaatggatttctaattgtccctccctaactttcatacctgactagactgaacagtgccaagtatgaggaaaatgatatatgtgtaataaaggtagactttccggagaaagtttatttttgaggtaactggagctgaagcagagggaaattgagaattgactagatataacacaaagaggaaagggggcagggaagaggtaatatttctgaccctcctgccagtaatatcaagcagcaaatgatcaagtaaaggttggcaggctagcctccgccttggaggttgccttgttgtaactctaatacctttgacatatcctgtctctcaaatcaatgaatgactgcattaggcccttctagttcagcttggactagttccagaaacctaggggtttccatcctgctgccctatgatttttactttaaattcctcggagacttgaattaagtttttcttcctgttatgataatgctgtttcttttttgtttttttcccagaaaggaaactagttcaccagttagtttttcccctgagttcttttagagtctataagaaatactgagattccgggacaaagagaccatctttaaaacttcaccagaagaggcaagaagctgtcagtgaaatgaaa

SEQ ID NO: 6292 - DNA, 3828 bp, artificial
  synthetic oligonucleotide
tttctataatatcttgcaataaaaggattatatagaagatactttggaaagactgatttgtcccaaagattaaatggataatatttgtaaagcacatatatagtaagagctcaataaatgcaacagtattattattataattaccataatcatcactataatcattaagaagggattagaaagaataagtttaagaggtctactatgcatcatggtgacgacacttaataacaatatattatataattgaaaattgctaagagtaaattttaagtgttcgcatgaaaaaacaaaataagtgtgtgattgtattagtccattctcacactgctatacttgagattgggtaattcataaacaaaagaggttgaattagctcacggttctgcaagctgtacaggaagaatagtggcttctgcttctggggaggcctcgggaaacttacaatcatggcagaaggcaaagggggaggaaggtgtctcacatggtggaagcaggagcaagagagagggaggggagaaaggctgcacacttttaaacaagcagatctcatgagaactcactatcacaagagcagcatcaaggggatcatgctaaaccattcatgagaaatccaaccccatgattagagaagctccatcaaccaggccccacttcaaacactggggactgcaattctacatgagatttggtggggacgcagatccaacccatatcagtgagggaatacctatgttcaacagcttgatttaaccattccacaatgtatatatatgtcaaaatatcatgttgtataccataaatatatacaattttttacttgtcaattaaaaaataaaatttaaaaagcctaccagagtgtcggtgatctgagtgagaaaaggcatgtctaatacacccctaggagtaggggtctacaaactctatagccagaggatttcctttgccagattagggcgagctactccaacggaggtagaagcttcagcagacaacctaccacataattccattgaatgtatgtatttattaaaatagaatttttagagccaccaaaaggttctttgataactaagattttttttgaaactcctcaggttggaattccacaggcaagcactcttattgtattgcactttctgattggttttaatgttctcatacgatcttgtttttagcacaggtatcttcccgtgtatgagttttgtctctttccctctccacttatctaagaaacaacagccaccataaaacttgacagatgtcaggtggactgctgctgaatgcctgactcatacaactggatgatcttccttttggtcctgattcagtttcccagcaatctagaaatgatttgcctttgttcttgtatatctcctgccaaggtgcacatagtttgcttagatatatggtccttttaaaatcatctttaaacttttatctattacctgctccttatggtagagttaatcattccttgggagctgaatttcagaatggtggtggatcctattgctttctaccagaagtcttaagggactgtgtgagttgctttcccatgaagcagtgttttagagggagatgcaataacccaaaaggaaaattcctcacacaaataaaaatgtatttatacaccaatcctgctgatactgaatagtaggatgtgggataaatctgtaagaaagtttgtctgtatctagcctggtggcaaacattatagattttacttgctgcataggactattgactaggattagattctcctctctaactacccatcgttaagatggatattctgaaaaaggtagacattaatcatttcttcactattttgatccttggtatagctgttccagagctatgtttgcatttacattttgatttactatgtaaggaggctgagaggtggtgatggattgagaggctttcacacactatgggcattccattgactcccaaggaccatttcaaccctgccctcatgtgccttaagtgaggggcagctcccattatggatgaattgctgctaattaaaatggatatatacactctgtcctactgtcatagtatgtggtttgataagaatgatgggcagagaaaaacaaacaaaaaaattctggccaagttaatgtggtgactagcaaaaataaatttagaaaaggccatttggattttatcagagtcaagtctatatatgaaaagcttattgctaagtaaaacctcagatttaatatgacctcgtgggaaaatgtgaatttggccgttgcatcccctaaaaaggccaggctccgtggcagttacacaaggtatggatttggagaatgaggtcatggcagctcagatgccaactgacagcttggtgatcccgagccacctctgtccatgtcccttatacagcacacatgattttttaaacacacaagctaaataaagcatcagaggaagacttcatggtgggagaactattcaaagactattctaaatgataaactctaatccttaccagtttgtttatagttattatctccataggtcttctggctggctggacccagagtgtgtctaactcattttatgacattaaaattctgctctctccaagttacaaacctattactttattagacattttatctaaagcatatgctggcttccttcttgagaaaccgaaagcctgagtttccccagcctatattctatataagaaacaggttatcgttaggtatttaattattccactgtcatttcatatttgtattctttatcatcttgtgtagagctctgagtattaacaacttgatgttcctcttgtcttaggaaatataaatatatttattcctttatatttcctggatacgattttattgtcataaactagaagtagatttaaaatggttacccttgctgtcttattattgccaaaaaggattgttagtcagttacattaagactcaaataatcatttttggtagaccttctccatctttaatccactttgtcaataatttcatactgcaagttaacttgtttagttaccttggcgttggaatagaatcagtttaatttggaatatatatgtagttacattttccaggctaaacttgatactgccatatgctaaagcactgctgcccaagagaaatataatgtgagccttaagtgcaagccacatatattatttaaagttttctagtagccacattaaaaagtaaaacaaaattatttagtaaaaattattaaaattaatttaaataatatattttatttagcccaatatatccaaaatatcatttcataatgtaatcaatataaaaattaataaggagatattttaattaatcttccatacaagtcttgaagaggagctaaaggagaagtgtctcattggtttcaatgaaaagaaaagttttattttaattgagctatgagtttgtctatcttgaggacactgtgaattacataattgatcatttttccctcttgtgttggctaagagggagttagaaagctacagtacaattagacattacttagctatgcacatgacttccttaaataaagattacatttctcacttcctttacagctaggtgttttcacatgactaagttatcgatcaataaaatgtaagtgaatgtttctggcagtagcttcagtgaggtcttcttaaaagaaagtagagaagtccctttgcctcgtcatttcttcatttcgcctatagtgaggatgtaatagctagagcactggctcccaccgtgtactataagggtaagggctccatcctagaaatagtacagtggtgagctggaagaagctttctttctgaag

SEQ ID NO: 6293 - DNA, 787 bp, artificial
  synthetic oligonucleotide
taaaaacttacacatgaatgttcatagaatcattattcacaatagcccaaaagtgaaaatccacaaaagatctatcaactaatgaatggataaacaaaatttggtatacctatattatggaatattattcagccataaaaatgaagtattgatacattgctgtatattatatgattctatatgaaatgtagaaataggcaaatctatagagacagtagattagtggttgccaggggttggaaggaggtggggatatggagtgacagccaatgcctatgaggtttctttctgatgtgatgaaaatgttctagaattaaatattggtgattgctacacaactctgaatagggtaaagatctctgaattgcgcactttaaattagtgcacaattatattatgctatataaactatatctcaataaagctgtcacaaaaatacagttagatagtgtgaattggcatagcatatacacaaaaaccatcatgtactgtcacaagagttttgatgtatttccaagtggttttagaatgttacctgctacctagaagctgaactatcccctggccagtattttagaatgtgtgattggtagtacacatcagggatgcccattttctatatttcatacaatgttagatactgttatatgtcagttatcattatcacatcattcttaactttggatggtggcaggatggctgattatagctcagttaatccagttccctctcctttattttagaatataagtccccagaggatagaacattcacatctgtctaaatt

SEQ ID NO: 6294 - DNA, 455 bp, artificial
  synthetic oligonucleotide
gcagtataaagacagcttccttagtttctagtggattcccatccagatttatgctatgtgtttagagccacactgtttaggtgagtcccccaaacccaagaatagacattatgagccaattggctagaataagggtaaaattagtaatgaacaaacagggcaatattaagtcatattcacatgttgattcaacaaatacttttttgagtgcttactttaaaccaggcactgtttttttttttttttctgagtttacagcagcaaaaacataaaaaaacctctaccctcccagaacttacatgagagggtagtgggttaagacaggcaaataaaaaatacacgatataaaatataagatagaatacaacgttaagggaacaaaccaaaaaacaaaaaacaacaaataaacaagataacgttgggtagttataagtgctatgaaggtaaaaataggt

SEQ ID NO: 6295 - DNA, 870 bp, artificial
  synthetic oligonucleotide
taatagtcatttgttcagggaaacacaatgatgtgtacactgctgaaattgttaaatgaaaaatacatgtttttggtttcaaaggaaaatagcatggtatatattaatatgaaaagtttgaaatttgcagctgtgttcttgttttacagctgctaattttggcaaacaattttgaaacataaaactgcttgtccactagataacaatacttccatgccttgcttcctctgtaagacagaaacttgatctccaaacatagttctttcaagcaaacaagaaagtatatcccctctatacatggggctgtaatttcattaggacaatcaatatgagcaggtgacataatagtaatgtaaagagcaaaatattatttgcagtataatagatttgtttcccactttattttcagaaggaatatacacatacaaagctacgttaaagaaattttaaatttctatttatgttaaatttaaaatttaaaacattggaaggagccctttaagcagcaagtattggctattttaaaaagtggccaagaaagcaggtgaattggattcattaatctatgacatcattttccttttattttgaaaaattatgttaaattaaaaaatttaatagcacattatcaaagtacaaacgggacaaaagagcatgcaggaaaaaaaaatctccctccaatccctgtcccacagccacttacttcctctccacaaatgcaatcaaaattattcatttattgtgaatattttcagagaaattctatgataatgtaagcatgcaagcatatagcttcattaaaaatcacacataaagtgtagcacagtggacatcatcattttcaaacttcaggttgtgatctattagtta

SEQ ID NO: 6296 - DNA, 754 bp, artificial
  synthetic oligonucleotide
tgccttcctctgaattgttctcaatgtgcatagatttccttccttttctcactcttactctttaaattcgacctgtcttatgcgttataggatgagttccaattcttttctgaagactctcccaatctagtgctctaactgatctctcctttttctaacatcctaaaatactcaccctccctcgaatgtggcatttgattaaatatagccttgtcactattttagttactttaagtatgtcagccctgtaaagagtctgaggggattgtttatgcctgttctaatatatcctccttgcttctaacttggttctaggcatatggttaaggcataataaatatttgctgactgctaactgatgctggtgttgcctagtagcctgggcctatacacactgtcagttctgtcaacagaggctgcgaaaattctaccagagattatgtctgcacaaaaataagcctctggcataaattgcgatagctgccactagagaattcacctgcaggaaagggacctcaggcatattacctggtgctcccagagactcttatgccaggttttccactgtcaaaatacagctaaaccatgtgctaatgtagtgatgtgagtctctccaataatttactgtaaatttatacttgcttagttttctgacatggctttagcatcctaatttcccataagctatgcctcagaattactatggattacaaatttgtggaaaaattgggcatactctgagagtcaaaaatta

SEQ ID NO: 6297 - DNA, 9784 bp, artificial
  synthetic oligonucleotide
tatattactctgaatttagaatacatacataatgccaactattcaattagagaaaggtccccatatttccatttcctcatcaatttccaccggtatagaaatgattcttctccaattcaataagttaatagtagagtacaaagctttatggatttctctgaagaagcttgattaagaattttattttcaagatataagatgttagccacctctaacataaagcctcaaggggaaagagtttgtgggctgctttataacttttagaagcctcaacctcatggctatgggtttttttttctttttaccaaatttgaaaggggccgttccacctcagtgaccagctactagttaaatggcaactgaacccaagcactgtgctccagtaacttgtgtgcttttaaacatgcttcaggcatggggatagaatatccttgtcacaaaaccaagataataagacatcaacaactggaatgatgtgtctaaatacatctgcacaatgaaaacttctctttccatccagtaagcatgccttgagtgggtcgggccattgtgacatgcatcagggttctcaggtcattaacacagtacacacacacgttctcaggtcctaactccatctactcaacctgtgtaaacaatcatctaacgatggagaaagatgttaagttaatcaataatagaattcctgtttactgttttctattatagaattaagactttatggaatgtatgacaccacaatactaatgagtaatgacggaaatagagttttcatattgcacttcagtcttgtgttgtagatcaacacaacaggtgattctcaaatctgaacaagcatcaaaatcatctggcagccttgttacaacacaggttactggaacccactccgagcatttctgattcagtaagcatgagatagagcctgtggattttcattttgacaagttccaagtaatgttgttgctatgggtccacagaacacgctttgggaattactatgtcagggcacggtcataatgaaccctaggtttcaagttcaaatcttattttagccagcagatattacacaaaggaaaattctgaggtaaccaccctaaccagacatgacagttcaacaaatgtctgcccttggttacagggaggacaagatgacaaaataatcatgcttctttgcaatcccatacactgttctataaaatcaacgtctgtattagtaattgcaactttacatacaaacagcataatacttttttgaatttttaaaactttttactttgaataatttcaaacatacatagaaatagaatagcagaataaacacacatatacctatcaactatattgtttaattattaatattttgttaaatttgcttcatttatattttagctaatgtattttaaagtaactccaagacatcatcatatttctcctctaaatagttctgtatataaaaagagcaaaacattttctatgtttttttcttttttaattacttttgctttcaaaatactttaatttctattatttttcaacatctactaagtaattagggcaagtaatcttacatgcttttacacaagaacgtttaataatcaaatattgaaacgactggctcaggatactagagcaagttagtgacagaacagaaaccatgactcattaattcactcactcacttactgacttaattactcagcaaatatgtgccttttggtctcctgcctcttgaccttatcctctttccagaaaactaaatttctattcaaaattcagtctgaaagaaattagaccagcattatcaaaagtgtgctccacataatactaattcttcaggatgctaaaagatgtatacatacacacacacacacacacacacacacacacacacacacacaaataattctatggccaaatcagtttgggaaatcatggattaaataaacagctttctttattgaagagcttttcagagcctctaataaactattatgcattggaattctgcaagagacacaaccttaagtgtgcagtatttccccagtgtattaaacaatcttttgacctgacttggttgtgtgtgtgtgtgtgtgtgtgtgtgtgtgtgtgtgtattttgtttgtttaaggaacatctctatgaaacatattttgatcaatgttccactagtagagtctagggtttgtttgctctacatgttcaagaaaactttcaaggaaaaataatgcaatattccaatgatagaaactaagggggaggggccaagatggctgaatggaaacagctccagcagctcccagtgagaccaatgcagaggcgggtgatttctgcatttccaactgaggtacccagtttatctcattgcgacttgttagacagtgggtgcgacccatggagagcgagcagaagcaggatgggacgtcgcttcacctgggaagtgcacggagccagggggcctccttcccccagccaagggaagctattaagtgactgtgccacctacccagggtactacacttttcccacggatttttgcaatctgcagatcaagagattcccttgtgagcctataccactagagccccaggttttgagcacaaaactgggtggcttttcaggcaggcactaggctgcaggagttttctcatactccagcagctcctggaactccagtgagacaggagaaccgcccactcccctggaaagggggctgaaaccagggagccaagcggtcttgctcagtgggtctgactcccacggagcttagcaagctgagaaccactggactgagattctcactgccagcagagcagtctgaagttggcctggggcaatcgagtttggtagggagaggggtgaccaccattattgtagctttagtaggtggttttcccctgacagtgctaaggagactgggaggtttggactgggtggaattcaccacagtgcagcaaagcagctgtggccagactgcttctctagattccccctcattaggcagggcatctctgcaggaaatccagcagctccagtgaggggcttacagacagaactctcacctacctgggacagagcacctgtggggagggaagcctgcagtcacaggttcagcagacttaatctttcctgcctgactctgaagagtgcggctgatcctgacaagggggattctcccagcacagtgctaagggacaaacagcctcctcaagtgggtccctggccccatgcctcctgattgagagagacttcccaacaggggtcaacagacacttcatacaggagaactctggttggcatcaggctggtgcccctctgaaacaaagcttccaaaggtaagagcagaccacaatctttgctattctgtagcctccactggtaatagccagacgaacagggtctcgagtggacacccagcaaattgtagcagacctgcagaaggggggcttgactgttagaagaaaaactaacaaacaggaagtaaaaacagcaacaatgtcaacacaaaagaacctccccccaacaaaaaaacccatccaaaggtcatcagcctcaaagatcaaaggtagatacatccacaaagatgaggaaaaaccagtgtaaaaatgctgaaatttccaaaagccagaatgcctcttctcctccaaatgattgcaacacccctccagcaaaggtgtagaactggacagagaatgagatggataaatcgaaagaagtaggcttcagaaggtgggtaataacaaactccactgagctaaaggagaatgttctaacccaatgcaaagaagctaaaaaccttaataaaaagttacagagctgctaactagaaaaaccagtttagagaggaatataaatgacctgatggagctgaaaaatgcagcacaagaacttcgtgaagcacacacaagtatcaatagccggactgatcaagtggaagaaaggatatcagagtttgaagactatcttgctgaaataaggcacgcagacaacattagagaaaaaagaataaaaaggaacgagaaaaaaaaaaaacctctgagaaacatggactatgtaaaaagaccgaacctacaattgattggagtatctgaaacagactgggagaatggaaccaagttggaaaacacacttcaggatattgtccaggagaacttccccaacctagcaagacaggccaacattcaaattcaggaaatacagagaacaccactaagatactccaagagaagatcaaccccaagacacgtaatcttcagattttccaaggttgaaatgaaggggaaaaaatgttaaaggcagccagagagaaaagccaggtcacctataaagggaagcccatcagaataacagcagacctctcagcagaaaccctacaagccagaagagagtgggggccaatattcaacattcttaaagaattttcaatccagaatttgatatccagccagactaagcttcataagtgaaggagaaataaaatactttccagacaagcaaatgctaagggatttcatcaccaccaggcctgccttgcaagagctcctgaaggaagcactaaatacagaaaggaaaaaccagtaccagccactgcaaaaacacaccaaaatataaagaccaatgatgttgtgaagaaactgcatcaactagtgtgcaaaataaccagctagcatcatgatgacaagaacaaattcatatataacaatattaaccttaaatttaaatggactaaattccccaattaaaagacacagactggcaaataggataaagagtcaagacccattggtgtgctgtattcaggagaccaatctcacatgcaaagacacatataggcttaaaataaagggatggagaaaaatttacccagcaaatggaaagcaaaaaagagcaggggttgcaatcctagtctctaataaaacaaatgttaaacgaaaaaaaaaatcaaaaagacaaaaaagggcattatataatcataaagggatcaattcaagaagaagagctaactatcctaaatatatatgcacccaatacaggagtacccagattaataaaacaagtttttagagacctacaaagagacttagactcctacacaataacagtgaaggactttaacactccgttgtcaatattagacatatcaacaagacagaaaattaacaaggatattcaggacttgaacttagctgtggatcaagtggacctaatagacatgttcagaattcttcaccccaaatcaacaaaatatacattcttctcagtgccacatggcacttattggaaaaccaaccacgtaattggaagtaaaacactcctcagcaagtgcaaaagaactgaaatcataagaaacagtctctcagaccacagtgcaaacaaattagaactcaggatccagaaactcactaatacaacacaactcactggaaattgaacaaccggctcctgaatgactcctgggtaaataacaaaattaaggcagaaatcaagaagttctttgaaaccaatgagaacaaaaagacaatgtaccagaatctctaggacacagctaacgcagtgttaagagggaaagttatagcactaaaggcccacatcagaaagctagaaagatctgaagtcgacaccctaacatcacaattaaaagagctagagaagcaagagaaaacagatccaaaagctagtagaagacaagaaataactaagatcagtgcagaactgaaggagacagagacacaaaaaacccttcaaaaaatcaataaatccaggagctgttttttttttttttccggaaaaaaaaaaatagaccactagctagactaataaataaggaaagagagaagagtcagatagacacaataaaaaatgataaaggggatttcaccactgcccccacagaaatacaaactaccattagagaatactaaaaacaactctacacaaataaactacaaaagctagaataaatggataaattcctggatacacataccctcccaagactaaacaaggaagaagttgaatccctgaatagaccaatatcaagttctgaaattgaggcagtaattaatagcctgtcaatcaaaaaattcccaggagatggattcacggccaagttctaccagaggtacaaagaggagctggtaccattccttctgaaactattccaaaccattgaaaaggagagacacctccctaactcattgtatgaggccagcatcatcctgataccaaaaccagacagagatacaacaaaaaaagaaaacttcaggccaatatccctgatgaacattgatttgaaaatcctcaataaaatactggcaaactgaatccagcagcacatcaaaaagcttatccaacactatcaagtcagcttcatccctgggttgcaaggctggttcaacatatacaaatcaatcaatgtaatccatcacataaacagaactaatgacaaaaaccacatgattatctcaatagatgcagaaaaggccttcaataaaattcaacatcccttcatgttaaaaactctcaataaactgggtattgatggaacatatctcaaaataataagagccattcatgacaaacccatagccaatttcatactgaatgggcaaaagctggaggcattccctttaaaaactggcacaagacaaggatgccctcttgcaccagtcctattcaacacagtaatggaagttctggctagggcaatcaggcaagagaaagaaatgaagggtattcaaataggaagcgaggaagtcaaattgtttgcaaatgacatgattctatattttaaaaaccccatcatctcagcttcaaaactccataagctgataagcaacttcagcaaagtctcaaaatataaaaccaatgtgcaaaaatcacaagcattcctatacaccaacaatagacaagcagagagccaaatcatgagtgaactcccattcacaactgctacaaagaaaatataatacctaggaatacagctaacaagggacatgaaggatctcttcatggagaactacaaactactgctcaaggaaataagagaggacacaaacaaatagaaaaacattccattctcagggataggaagaatcaatatcttgaaaatggccatactgcccaaagtaatttttagattcagtgctattcccatcaaactaccattgacattcttcacagaattagaaaaaaaaaaaaacaggccgggcgcagtggctcaagcctgtaatcacagcactttgggaggccgagacgggcggatcatgaggtcaggagatcgagaccatcctggctaacacgatgaaacactgtctctactaaaaatacaaaaaattagctgggcgcggtggcgggtgcctgtagtcccagctactcaggaggctgaggcaggagaatggcatgaacctgggaggtggagcttgcagggagccgagatcgcgccactgcactccaggctgggcaacagagcaagactccgtctaaaaaaaaaaaaaaaaacattttaaattacatgtggaaccgaaaaagaggccatatagccaagacaatcctaagcaaaaagaacaaagctgcaggtatcacactacctaacttcaaattatactacaaggttacagttaccaaaacagcatggtactggtacccaaacagacatataggccaatggaacagaacagatacctcagaaataacaccacacatctacaaccatctgatcttctacaaacctgacaaaaacaagcaattgggaaaggattccccattcaataaatggtgctaggaaaactggctagccaaatgcagaaaactgaaactggaccccttccttaccccttatacaaagattaactcgagatggatttaagagttaaatgtaaaacccaaaaccataaaaaccctagaagaaaacgtaggtaataccaatcaggacatgggcatgggcaaagacttcatgacaaaaacaccaaaagctagtgcaacaaaagccaaaattgacaaatggatctaattaaactagagagcttctgcacagcaaaagaaactatcatcagagtgaacaggaaacctacagaatgggagaaaatttttgcaatctacctatctgacaaaggtctaatatccagaatctacaacaaatttgtaaacaaatttgccagaagaaacaaacaaccccatcaaaaagtgggcaaaggatatgagcagacacttctcaaaagaagacatttatgttgccaacaacagacatatgaaaaaaagctcatcatcactggtcactagagaaatgcaaattaaaaccacaaccagataacatctcatgccagtcagaatggcaattattaaaaagtcaagaaacaacagatgctcgtgaggctgtggagaaataggaatgcttttacactgttgattggaatgtaaattagtttaaccaccgtggaagacagcgtggcgattcctcagggatctagaaccaggaatatcatttgacccagcaatccaattactgggtatatacccaaaagaatataaattattctactacaaagacacatgcacacgtatgtttattgcagcactatttacaatagcaaagacatggaaccaacccaaatgcccacctatgatagactggaaaaaaatgtggtacatatacaccatggaatactatgcagccaataaaaagaatgagatcatgtcctttgcagggacatggatgaaactggaagccatcatcctcagcaaactaacacaggaacagaaaacgaaacaccacatgttctcactcataagtgggagttgaacaatgacaacacatggacacagctagaggaacagcacacaccagggcctgtcgtggggtgggagccatggggaaggagagcattaggagaaatacctaatgcatgtggggcttaaaacctacatgacggattgataggtacagcaaaccaccatggcacatgtatacctatgtaaaacacttgctcattctgcacatgtatcctggaatttaaagtaaagtaaaataagaaaacttaaaaaaagaaacaagaacagattcttacccactttcaaacactaaaatgagactacacgcttagaagcgaattgactccttagaactttaaagtactgaagtagacattcaagttaaatatatttagcatcgtactttagaataaaagcattatataattgtaataatttaatcaaaccaccatacccagagacagttctatagtttctaataactaaagtgtttcatttaatatataccttaataatttctatatccagttggaaatgacttagatattcataggatagcataataataatatttgtaaaaaaaactcactccaaatcaaatgcgcactacatttaatgtgaattagcttttgttatacttaaaatcaatttaaatgaaggctaatggaaggaaacatgaaaacgctgatatagcacaataccaagaatgtatgtatataatattaaaacaattcaagggtattacttgaggtaattcagtatctagtcggttgagtaacagggcattctaactttctgtaaatatatacacaagtatacaaggttgtcaactatctgatttacaagtgaaaataatcaaccagatgtttttaaagtgcctaaaagttgggcattatgcttaggtaacagcagtgtttcacttttcctatgaatggttttgccatcagaaaaacagagctccaaaatgttcaatagctacagttctatctagtgttggctgaggaagaagctttatgaa

SEQ ID NO: 6298 - DNA, 3254 bp, artificial
  synthetic oligonucleotide
tcagaagacttcggactaggaagatgaactgggctatttcagccaaaaaatataatagagcagacatttgccatgttctcctcaaacacgttaagagtagcaattgattctcacagtacattgttacctggcttgttaattataatcatagaacaagagtctaaaattcaaggaagctgtctgcgacacttactcgtcacaaacgcgatcaattaaacgctaatctaacagtacctattagagtgcactgggatgtttcgtttccttttggtctttaaaaccaaatggctactaatttcctttctgtagcactgagaacttctctttgtatttctttgggccacctcaaaaacacctccaggttggtatcccaggaaaacaacggttaagttcaggacgtttactgaccaattgcttcatattggagatgtagagcttttctacccctattagcatatcgccagtagcagtgatgcagatctgctcaacccgaagctgccgacggcgagtacgagctgcaaaccagcccccgcccccgcccctactctcccagtggcgacacagacgtggaaacatctactagtggagtgagatcctctgtctccgcaattgtaaacaactgactgcatcgggttcactgaaatgtttaaatacactcctgactgcaaacacatccactcaccaagtagcgctaacaatctccccttctccgcctctaggcaaagcatcctgaaactaaattggcaatcctcctgttatggagtggaagaaagtgaggttacatttccccaagcctgcctagcgggtgcttggcgctcgcagatatgctggccgttgctgaatctcggggaccaagtctctggatgaaatgcggaaacacacaaacccgcacattggagcgcatggttaaagtcaacaccgacggctcctggagcaccgcctgggttgtaatgactatctcttttgacaaagattgacaaaggtatagggaggacgcatcgggtggggccctcgacggcggcgtaggttaggaggtcctgcagttcccccgggaacccgggctccctgagtgaggctcaaatagaaattcagaagcaaacaggtactaaagtgcgtcctagcccttgggcatattctctgcggagacagcaggacctggaccccagtggcagagccccaggcgaacgctccagggtgggagggatgccagagaagcgcccctttctttctttttagaccgagcctcccatcctcaccccaagcacccaggtccacttgttagagtgactgggctctgcgcgagagccgaggcgaggaggctccctctcagaactgaaggagttggttggtaaaagtgccgcctgggaagcccagcgagccctcgaagggcagcgtccccagggcccgctggaagcttgaactgcgaacaaggccgacctcccttctgccccagatggtccagagccccatggccggcggagaccgggagaagaaggatgcggaggctctgccacctcgggcaggagtcccagagcggactcaaccggccgctaacagccaggagccgccatccgccgcctgcagcctcggggcgaagttcgcctgtagtccttggggtagaaggttgggggtggcgggcgggagcgagaaggaatggggtgggagccaggagaaacgcacctacctattccaagcgcaagtttcggcggcgtccccaggtgctgttcccccgccccctcgccaggtgctcggctccgccgggcgctgccagtgcccgggacttagggcgtctcggccgactcctgcgggaaacgactgtaaatccacattactgttcgagctgccgctcgggcccccgcattgctctcctccggctgctggcagcggtgctctaaaccggcggccgccggaggcaggaaccgaacctagctactattgcaccagcggacgaccgctgccagaagggtgcttgcgcccagggtcctatgtgtgtgcgagagagtgtgaatacgtgtgtgtgtgtgagtgaaagagagtgttcgtgtgtgagagagcagaaggggtgagctcagcccccggggcactcggaggtgaactccgggctgagccgaagctcgccgcgctcccgggtgctgggcgtctgctcggctgatggctgggctgatgttgccgtggccgccgccgccgcgctctaaggctggtcgcggtggtgcaaaaaatgtttctccgctactcgagaccaaaaaacctgccctgtctactgagcatgcccggtttgacagcttcacagccgaggtttttttttttttctccttttccccaagactccaggttttagccgcagctgagatgggaggtggagggaggtggggggaggaggagagggagaggaggaggaggagaaagaggagaagggcttaaggagcaagtatcgggcagaggaagggaagtcgcaatgagaaagatcagggtgttatagggtggagaggggaaggagaaagctggatatggaagcagaggaaggaaatatggatcaacaaaatttagatttcctactacagtggatagatgcctggccaggtgactcactcgatgttttttttttttttttttttttaattactttctcctgagggtgaggggtggggtggggggttcggatgagtatttgtcaaccccaggatcagcctgggacagtgttacctagtcatgacatacacaaacatcgcgtgcacacacacgcgcgcgcacacgagcgcacacacaggagcacaatcactgcttctatgttcaaagcctcaggactgacttagaatgcgaagtcttttgccagtataactttggcaaaaaaaaaaaaaaaagggcggggggagagaaattgtttggtttccttttcttattctcctctcccccgccttccagaaaagccaaaagcccgtgaatgcggtgcataagcgacccacaagctctcgtgcgtctgtcggtgagagtgcaccgccgactgcgtcctgctgacagtgtgaccccagagcgccaaggccggccggccacatgcagcctactggcggcgcatcagatcagcagtaacgacgtccacctgaaggtggttgggggaagaggggagcgctaagggatcctgccctgcctggccgcccaggttcctgggctccctaaacggctccgcccctcacccagcctggcaccagggcacgtactcgggcgaacccagcgcgctgccccaagccctggatccc

SEQ ID NO: 6299 - DNA, 340 bp, artificial
  synthetic oligonucleotide
ttaacaaagacacacacacacacatgcactcatacacctttttatgtttattcccaaaactaatgtaattacataaattcaattcagcaagtgattatggaacatctactatattccaggaactgtgccagcattgggaataggcaaagaaattgagacttaaagaagctaagaaatgttcaaagatgtgtgaacaatttgctaatcaacaagtatatactgtgtgactgttaccgtgtatctagactatttcactcctagagaacaatatttagatgttctggccttgattttttaaatatatttttaatctataggttgcattctgtgagaagaatgc

SEQ ID NO: 6300 - DNA, 910 bp, artificial
  synthetic oligonucleotide
actaaagaaaaaccaaattttgatttgctgttagctacccaagctgtgatttctataattagcataatctttcataagatactgaagataaaaatttgtatgattcctcactctccttgtattgccaaagaaaatgtagttctgcaagccacaaatgaactgtgtaaacaattatgggctgggtgcagtggctcatgccttgtaatcccagcactttgggaggccaaggtgggtagaccacctgagttcaggagttcaagaccagcctggccaacatggtgaaatcctgtctctattaaaaatacaaaaattagccaggcatggtgacaggtgcctgtaatctcagctacttgggaggctgaggcaggagaattgctggaacccgggaggcacaggttgcagtgagctgagatagcgccattgcactccaccctgagccgacaacagcaagactcagtccaaaaaaaaaaaaagaacgatttgacggtagaacaacattatcattgagaaacctaatttggaagaggtataaattgagtgatgtctaaccaggtcacattaaagctgtgtgatttggttcaacattattagtgtaatttctctcttaccccaacctttaaaatttaaaaagaaaacatacacaatgggctgtgtattgttactcacaaaatctgcagtgggatgacacagaatgaaaccatttttatttcattttgaaacatcttgcacattattttttcatcaattaggtgtggaagaaatagtccttcttaaaaatgatttgtgttttccttttaaaggttacatggtagaaaaatgacaaagcttacagaatggaacacttatttaaactggaacagaaatcttatgaattttgaaaactgaagtgcaattaagaaacctatgtata

SEQ ID NO: 6301 - DNA, 815 bp, artificial
  synthetic oligonucleotide
taatttatgaggaagaaataagtctgaaaataaattttattcatgcttcaacattaggcagttcgaaactgaagcattaagcactgatgttttctctagattttgtgacaggcacataaaattctgtgtttccagagctatacattggcaatgaacacacaaaactcactggtttttatttgtttgttttcaatgaaggtttagaatgttttcgtatttgaattcttcaaataatctgcagtcagttgtcaggaaatataaaaataaaaatgtggcaagtatctatttttaaatcactgcgattcttcctggagcatttccactgaaagcacaaaggatacagaaatctaagttaagcacatttgggagtacagaagaatctcaagcaacatagtctctcattagctagatgtgttcagatagcttggtagaattttgcctatggctataagagctgtgtggctccagagaatcaatttcagttctctctttgggattcactggtatacaaagttcttcggaggattctttttctcactagaaatactttctcttcttacctaacctaacctgtatccctcaaaaatataagccatttacctaacatttttataaaacttgatagtgaaaagagtccagaaactgacatggaagaaactatatcataaaaccatggagacacttattttgttatataaaattttagagtatgcagatgtactgtctgatatatatggttcaatttaaagaaaatataattgatgcagggtggacacaatgatatgttaaaatttgctgaaagacagaaaaataat

SEQ ID NO: 6302 - DNA, 1938 bp, artificial
  synthetic oligonucleotide
ccccattaaaaaccactgctttaggtcacaagcttgtaagtggggagctagtattcaaatttgaaggaaattaaaacattttaccccaagatatatttctttgacatattttgaaatggctgccaattggccagcaaacagaagtggccttgcaaagctgttttctggtgggaaaaatttgcatctgtagagcatctccattaataaagccataccgctgctttccacatctttcctagatccaggaaggactgagagtctcacaccttaagaaacctgaaaagaaacatttaccatctattccctctgaaagacacttcatcttcatcgagacaagcctcttcctttcttcctcctataacctgccttgccactaaagcctgttttttgacatactttaagttaacattctttctgtaatttcaaaatggtatacaagtttctgttacttattggaaagttgagtcatcatttagaaggcgctcatgtctacacattaaataaatttacattccttttctcctattaacatgcctcatgccagtgtgaaccccaaaaatctgagacaggtctcagttaatttagaaagtttattttgccaaggttgaggacacatgcctgtgacacagccacaagaggtcttgaggacatgtgcccaaggaggtcagaacacagtttggttttatgcattttagggagaaaagagacatcaatcaacatatgtaagatgaacattgtttcgttctggaaaggcagaactactcaaagcgaggagggggcttccaggtcataggtggataagagacaaatggtggcattcttgttagtttctgattagcctctccaaaggaggcaatcagatatgcatttatcacagtgagcagaggggtgactttgaatagaatgggaggcagggttgccctaagcagtttccagcctgacttttccctttagcttagtgactttggagccccaagatattttcctttcacacaagtgactttttagtaaacttttggggaaccgagaacctatggcttccactaactgaagtatttgattctaaatgacatgattttcaacattatgtgacactgtagaatgtgccatacataaggcataaacggtaagcaggaaaaaaaagggtacctgctgtgggaagttaggtctggatgccaaacttgacctaattcacatatttttaactggaaaactcaccataattggctccttatattagagctccatactactaaggggaatgtaataagcatgagggctccaggccctttctgaaattagttaaaagagcttccaggtcagggacacacatgtgcaggtggtaggaagaactgcaggacatcaggccctttagcattttctcaaagtactcaaagcaatagaagtaattctgcaaagctctgacatgaaccaagatatgtggatatactcgaactactttttgttgacccactaaagtgaaggtactagaggatcagggtagacatcttcaaattcatttaaaaatggtaggaatctgagattctcattaatgtgcttagttctcagagagagttatattctgaacctcctttcagttcaagagaaatattaagcaacaaaatgaaaaccaaaagaaggcaaattttggaccctggaactctgcacctaggcaccttccacatgatttactgctcacagtgcagaatacaaataatggccatgccagcatgtgaaagcttaaaatacattctaatgaagatcacattgtgaacattgccaaggcagaataaaatgcaatcaggatttaaatgtgtctaaaataatagctccttggattcaagcacactgattaatgtcagagacacttatgaaatgttgttgcctggtcatcagtgttatttttcttgtggaacattttgtacaagaagcaataaa

SEQ ID NO: 6303 - DNA, 1752 bp, artificial
  synthetic oligonucleotide
ttttaagtgcaaaaatgcatatgaccaaaagtgatacgtctgctattagtgaaagatttaagtcaaaatgaacaaaacccatctctcttaataaagtgaaatagcaaatttaaacaatttgacttttcacattgtatgtattgtcaaattggttttaaaaaacagattatatacttagtatgacattttgctacagttcatatttcaagtgcaagtttgtggaatggagagtatgattcttaaaataacctcaaatgcactgtaaattataaatttctagtacacgataaacaggatgtgttgtttacaactgtttagatccactaaatatttgtagatttgcttcctcagctagagcaggaacatactggctataactccctgccttgttcaataacttccagtaattatcaggaataaaatgcagtaaatttatgtaatagactgcccctttgctataatatacaatcagaggcgatcaatgcttcttacaataaggagaagaattacaactgtgttttattttatagctttggtaatacagctttgaaaaccaccagagggagtagagttaaacttcagtggtcaaattccattgccataaaacatagcctcaggctgacattttacaaagtagcaacgcaacaaagggctgtgtacttcttaacagactattttatttgttcactcatctaggtagtcagacttccacgttttgctgctcttttagttcatacgcctggaataattataatctctctgaatataataagtataatcaagtttaacctttgaccacatcattggaagaggggagggttagacctagttgataatgagacctccagtgttgcagtaacccccactgacttgttcattacaaagttatatttgtcacagttttagaaatatattttcattgtggtttaaataaaggcattgttgagccctgcctagttatgcttaaagtataattatacgctacatatcttggtaagtaaatgaaagacttttcttggttgtttgttataaatttctattttgcctgtagctaagtgaaggccaggcctctaaagtgtttcaagtataatgcacagtgaatataaaacagtccattaattgggataataggtcccagcatgtaattgcatttcttaggtactatggatagcaactgagtgaagtggtatttattcaaggttgttagtcacccgtggataactttatttgtccactgatgcttaaataaatgcatcatccatcagtaagaatatttatgaagaaatttataacaaaaatcattattgcgtctcaaattatgaaaggaaacagtatataaaagttactgaagaataccacaataaaatcttgccagtgcctcaggttacttgcttttatgttggtggaccgtaaaatattgtggaaactcaagaacaagtgtgaaccaaacacctttactgtactttttttcatgtgctacccaacgaaatatctgtaagacatgaggtaaattccatcagcatttttcagccccatgaacatgcagttttaagaaaaaaacaatttgccaacagacaacctgtcaatgtaccacaaacctttacaatctcaaataatgtatgtgtgacgctttgtttaccattgtaaaaacatttgctttggttttcatttaataggctattggctctttctaagatgctaaaaatcacatgttctattttatcatatggaagcctccacaactcactgaaa

SEQ ID NO: 6304 - DNA, 285 bp, artificial
  synthetic oligonucleotide
aggaatgtattcataataagttccaggtgacttagtttgagtggtagtgttcttaactccaattttgaatgaaagaagaataaatgatttagttatgagttttctaccctaaatggtctcagaaccatgatcttgtctttatttcatattccaacttaagtggtgtaatatgcttaacaatgggtggaataaatcagttctgagaagcactaaggaaagcacaatgaaggaacctgctgcaactgagcttttaatgtatctggatcctattacacttgcttattg

SEQ ID NO: 6305 - DNA, 535 bp, artificial
  synthetic oligonucleotide
aaatgcttaaattattgaattggtctcacactgagtttggcagaaaaatgatttactagttttctcttcgtttatgtctgaccaagttgtccaatggatgggagtctgtcagaaatactggattgttaatttctggagaaaatgaagaagttacattgtatttgcacactttaaaatactgtgaataaatttttaaattgcaatacatttttttccttgaggttttcatttccctgtggtaaaacaaataaataaataaaatgaaattcctattaaggatcctaaggatcacctctaagcaattggtagttgctggttgaagtgttgggctaaaaaagattctatggcttcatctttgctcagaggaaataaatgccattgttgatgacgggtgtttgccctagaaatggcatggtgtaacagaagtgcacctgcttagtagtgacaatggcttttgctaatgtgatgtagttggtctccacgtagaaagacttttctcaacctaacacttgacatttctttaaggtgctattag

SEQ ID NO: 6306 - DNA, 1862 bp, artificial
  synthetic oligonucleotide
ctggaagaggccctctcctccaggaacttctgggcgcggatgtcatagaagagcagggaaccatggccggtgcccacagtgatgatgtgctggtagaagctcagcgaccgcacgcctgtgccaccctctcgagagcacaggggccggatgttctgctggcgctggcgcggatccaggaaggagacgtgggactgagagcccacagcgtacagggacaactcatcacagtaggtcaggcacacattctctcggcagtagggcagcctgatggacaggagcctggatagtgtgctccgggctttccacaggtggaagtagccgtccaaggacaccgctcccagctcctggttcttgccgctgaaggccagggcccgtaccttgcggttgctggggttggtgctggccctggggatggcctccacatccctcggacggatgtgggcatatactgggagacccacctcgctgtgccaggcaatgctgccattaaacatgtctgggtccatccgccacagagccacggtgccgtcgcgggagccgctcacagctacggtgtcactcagccaggcgactgcgaagatccagtccttgtggccatggcggtcgcccaggcacagggggtccagggtgggcagctggtagatggccaggctgttggggttttcgccgccggtggccagaagcgtcttggagggattcagctcgatggcatggatgccgcagccctggtgggcctgggccagcccggcctccttgtcccgcatgagggggatgcgcgtgatgtggcctgactgcacgtccaccacaaacagcgtattacacttggtgccgcacaccacctgcctggcgttcagccactgtgacgcgaacaccttgttgagggtgcccaggtccagctggcgctccgtcagcagctcgggcagcctctggacggcgtagccccgcagctcgccctcgaagccctggagcccggctgggccccgcgctcctacctcccggcccttcagatagtgcaccagcctgcgacgcgtcgccggccgcttctgcttcttgggtagcagaggcccctctccgtccgccgccgctaaaccctgcgacgacgagctcccggctcccgcctcgaccgcgggcgctttccgtttcctgctacctgtttgctgctgggccatggtgggcggcgggcgatctgcagcagcggcggcggcggcggcggcggcggcggcggcccggcggcggtggcggcgcgtggcacccgtgttggccgtggcggcggtggtggggatggctgcgcttccgcgtcagccgagagctcaggatctctaagaccaagaagctggtgcgatcgcgggcgcccagacttcagtctgaggctcggcggcggcggcggcggcagcggtcgtcctggccagagatgcgcggcctgacgtagcagagccggggcgaagcgcggcggcaagggcggcagtggcggtgcagacctaggcgagagcgggaagagtgtctgtctggatggctgcgggagcgaagtcagtgtggggggaggacgacgctggggcccgagtgtgaagggcggaggcagtgggaggagctgctgggctggcgtggggtgcctgccgggtagcggaggccgcgcggggtggaggctggaagggggcggaggggagaagggggtagcggagctgcaggggcagagtcgcggagggccagcaccctaggtccccagtatcagacatgcgttgtttcgctaccctcaggacaacagctaactacccttcttaaaatccgtacttcagtaaaatctgaaacctaagatataatcaagcacggggctagaaggaggccgagccacggtctgcctggag

SEQ ID NO: 6307 - DNA, 583 bp, artificial
  synthetic oligonucleotide
tattccttgctcaggcagaaattatcatcgcaagtaaaactaaaatcaatttaaactttatatttttcatgggccaagtggggttgggggtaggatacgtactgaagaatttaatagttgttctaaaagtagaatatccagagtcacactgattaaggaacaggaatcaattttaagatgtcacccttttcccccaaaaatgagaagtatagaagcaaaaacaaacttctacccataatcataatgggaaattttatatgtagtacatcatggcagataaacagataacttttagaaaatctgcaagtgggcactggttctcggcagccaaataaaatatcactttaatggataataaggcataaaatgtttcttaacatatttaaaatatatttatggagtacctactatacgtctgttgctgatctatttgctgaggaaacagatgaataataatgatagtgaccaccatcgtaacagttagcactcaaataatgcttactatgtgcagtcactctgctaggtgttgttttatacatagtctctcaattactcttcacaacagccctataatttagagaca

SEQ ID NO: 6308 - DNA, 1303 bp, artificial
  synthetic oligonucleotide
tttgaattctgaaatctatatatccatataaaatttaacccgtccaagcatatttttatccccacataaaatttatgtcagcagtgttttgccaatatggctaccataaaagttttgtttagaccaagagagtgagctctatatgtcgtggataacaatttccttggtgcagaacagtcaataatataagttataggatagagtgcctggatgactgccttgtgtacacttttactagcataaacgtgttcatcttctgattagatacaaaatgggccaggtaccatcttatctacagttcgtttcccacacctatattgcataggtagcaagacccagagaagggaagaaaatcagcatcaacccaaatagaagagttagttgaataaaacctatttgagaaaaggaaaagacagaagaggaggggttgcacttgggaataatggactaaagtggaggttttaggaaatactacctattgatttctcactcacaagtggtgcaagcgagatctttagtagatttttaaaaattattattattattataatgatcatttgagggaagaaacaataacatagaaatgcttattttcttctttagcaaaatgtccattacttcccacttggctcctcttctccctagatttgattattcagagataacttatgaaaggcaatttcaaactctgtatagtaccttgctcattttcccaagtagttcttttaatgggttttgcacatcctgggtttcagattatgtaatcttaggcgaactccatgatctgactctagcaattgacagatacagatttgattatacaatcatgaatggctagggaaagctttcattcttctttcaaacccataattgcctgagctttcctttgcagctgcctgcctctcggcaacccagttgggtttcattttgcagactgctaactcctaatcacaaactccactttttgtgatggggaaaacaaccatgcagcaccaaaacaacaacaaggaccattcttttctaacatagaaatttgtccaaataccaaatcctatttctgcatcacaaaggccatctctatctggactttgcatggcccacatattctatattaaggaaattcactatgagaaaatctagatttataaagtattggggtagggattatttgaatagacataggtaagagggtggaaatacacaggaaatatcaattcatgtatttgctttaaataaaggatttcataatggtcctcttgagcatcaacttccccaatattcacacttgctacacttaagtaca

SEQ ID NO: 6309 - DNA, 335 bp, artificial
  synthetic oligonucleotide
ttgtaagattctgtgtatgtaaatttacaaagactacatatatacgctgataagtgcaaacaatattgttctagaagaaattactaagagtttaccgatggggaaattgactagggtggatgaggggggaaatttttagttttcttttatgcatttctatactgttttaattgttttactatattcatgtgctattttaatttaataaaaatacattgttttttgatagagggcaccagtactgaccagtagaatgaggccagaagttcaaagtccattgtaaacaatcagcaaccggaatccatgccagagttgaaataacctattatatttct

SEQ ID NO: 6310 - DNA, 1178 bp, artificial
  synthetic oligonucleotide
ggtatttaacaaaaagtattcagagtaacttccaaatggctacacacacacaccctcctcagccatcctcctctctctccccaaattgactcaaagccttactagcaagaaatggtatggagttgtacaaggaaaagtccccataatagcgtcattccaaagtattgattatagcaggtcaaagtagtacctaggacagaaggcagcccagataagtaaggaaatttgacagagattatgcaggttctagaaatcagagcaggtaatgggactaggccaagtaggcaagctagagccagagcaaaggagggcaggaaaagtgaaggcaactagtgggtccaaagcctgataaacaaccagtaaccaaaaggccacaaatgtttgaagacaaaaagaggcggaagttgggagctctctaaaaggcagaaatgcagaggaaggtaagtgaccaaatttccagcaaccaagagatataataggacaaagtacaattcagataaaatagaaatacccatccggggaaggatctaatttagtggcgcaaaatgttgttgcatctctcatcttaggagattgttatgcttcctgtgaaggcagacatcaattctggcattgccaggctggggctaacagggagaaacatttagactatatggctgttgtgaaaaaaagagaaggttaatcaaaagattatttatgatgatggggagtggggcgggggtattggtgggaaacagggctctgtatgtagcaaaaagaaagcaattagcattagaggaagtatacagaaagcctgcacacacacatactcctctgccagtcaagctgtgaagactccgaatctctctgaggagcagaatatgatattgtattagaataattgactttcccgttcaacctagataagaaacgaatggcatattgtactgggcacacatctctaatagagataatgccgcctcctttgataggtgtatagcattgtgtctgtccagcaggcaatctgaggcatttttttttcttgtcttcctaagtctgagcttcattctcaaactgacggtagggaatttcagtaatgacttgctgccctgcgttagccctttcctgctctgaaaacgctccctctttgcgctttttattcagagacagtagtctgaatttacatttgctggatttca

SEQ ID NO: 6311 - DNA, 3773 bp, artificial
  synthetic oligonucleotide
aagtagaaagtaccttttccttaattcaatggaatcaattaaatatatagggctgcaggcaacattgctgaatctcatagcctcgagctcttttccacagggtttcctgtgtgaactaatacatgaagctaggttaagcttgttgaaatgaagaaacggtcttgtggggagtaattgaaagaattggagatatttaaactggagatgagctgactccaaggaacatgacacatcttcaaatacgtgacataaaaaaaatttgaaggttctttgtgacccaaaaccattcaaagacccttaagtacaatcttaataaatataaatttgcagtcagttaagaaaagttctcattagtaatagctgttcaaagatacataggccacccaaagaattagtaagtttcccaccacaggaagtatccaagccaaagttaaatggccatttgtctcagatgcaataaaaatgatataactggattagttaggattagattcacttgtatataatagaaagaaagcaaaagatcagaaaactcaacaacgatggctaaataatatagaagtttatttttctttcatgttaaaagtgatttggaagtgggcagtccgaagctacagggtaactctctagtgtcatcacggacctggcgtcctgtctttctgttgtatcatcctatcccatgtcttctacccgcaaggatacttcatgggcccatggagttccaacaacatgtctttactataggcctcaaaaaggaggaaaggaagaaaaccaaaagaagcccctcctgaatgtgtccactccctttcagaaacctccctggaagtcccacatgacacctttgcttacatattattgcctaaaagttagtctcatggccttggctagctgcaaggaaggtcagaaaaacagaattatctttgattctgggtagaaatgtgttcatctaaaaatagccattctgtgcctgaggagaaagagaagaagagatgttggagtaggcaatagccatctgtggcacaacagccatctgacgagttggagcttaacaaagtttaagattctttccaacccttagattgcgtgagctcataacaggattatgcatcaagagaactgctttcaacatactcttgatctgggaggcaagactgtccttatatgtatccccaccatctgtgtaactggttcccggcattaaatatcctctgttttaagcacttacagtggttttctatttttctggttggccccagattaattcagtgcctgaaactattaatcttattgttaaaatctgctctctttagagagtctctgagggaataagatataaaataagcaggttttagtgaaaataattggataaggagagatacagagactggaggcaatttcttagtaggggaggaaagccaccagagctttcaaggcagccaggagaacaactatttgttcaaataccaaatatttactgagcaggcactacatgccaggcactgttagatgctagaaatagaatggtgaacaagacagacatggtttctggcctcgcggatctcatggatcatagaaaaatgagagatttaagaagtataagacaattaagaaattagagttgacactgaggacgttaggccataagcaaacttcaaaaaactgatcctttggcctttgctttgattcataaaacaaattaggagcatgggggctattccgaaatgtctgaggaacactgaccttgaaactgttttcctccctcttcatgccttcctttgtgattccttaaaggcggtgttcttccatgttcacaattttcctttcctgctttccataattcttccctcgccttgtattgggttatgtagctctgtgtcaacccattgtaaatattgctgcatttgcaagtataataacaaattccatgcaactttgcctttccatattgtctgacaagaggccattattgttttaaatttgtacttacatactgtaatatttgcattttgcatttaatcactgtcacattttagtgacgggaagtggagctggggacaacaattgatattatgtatctcgacctgaaatagtacccgcagatgggatgttgcctggacccatatagccttcagtgatttataactcaatgatcataatgtgtctgttgaccttccagacagttcagtaatcattgttttgtacctaacttgcttgaaatctaaaactacttcatccaagcaaaaggaagcaagcactgtatttaaaggaagtctccattttaaatggctttgacaacctcctcccagtagccttttcaaagtttcccgactcctcccttgcttgtttcttgtttatcttcctcagtcataatgcacagtttggacttgactattagtattgcttattatattctgccctgtatcatgagttcctcatctttctgcaggtgaattgtaaccaatttaaagacaggaccaggtcttttaattcatgtttggttaatgacaccatattccgcccccccctccttttttttttttgcctctgttttccttttggtaggccttagattttatccaaccccctactcctccccacacacaacactctagctttcctactcctagggtctgccagcaactaaccttgtgaccttggtcaaattgcttaacctctcagaaactgcttttctatccatagaatggagttgacgcctacctacctcttggtgctaaggctggaatgaggaaaggtaaccttttaaataacagttagaagagaacctagcacatagaaggaattcagttagtctacttctcttctccctgacccacagtctaccaaaaaactcgatctattctgagacccatgccctcagagtcctatcctctgtgaatgtgaccaccctagtaagttagtgcattacccctgctacatggtatatgtgtagtttatttatatttttatttttaatttttttgagatggtatgttgcccaggctgatctcaaattcctgggctcaagggaccctcctgccttggcctcctgaagtgctggggttacaggcatgagccaccacacccagcagtatgtgtactttaaatggagttccatctagtagaatgtaagtttcaactgaggccaggcatggtggcacatgcctataattccaacactttgggaggccaaggcaggaggatcacttgaagcccggggttcaagactagcctaggcaaaatagtgagaccctatctctgcaaaaaatttaaaaattagccaagtgtggtggcacatgcatgtagtcccagttacttgggaggctgaggcaggaggatcgcttgaactcaggaggtcgaagctacagtgagttatgatcacgccactgcactgcagcctgggcaacagaaaaagaccctgtctcaaaaaaaaaaaaagtttcaactgaactgacacctgagcacactacgtagatcccttcctggtatcttctgtcatgacacccattgcattcatatttatcatagcacatagcacaatttaaagtgaatcacttctgtgtctctttacatgtttattgtgtctcacccaataggccgtacactcaaaggcaaaagccacatctgctttaattatcagtgaatttccagaacgcaacagagtgcttggcacacagcagacaatattttttgatagattggtgggtagctggaaggataaacagatgtagtaagtagatacagttagaataaatgaaacatggtggaaatttcag

SEQ ID NO: 6312 - DNA, 1114 bp, artificial
  synthetic oligonucleotide
cactacaacacatataacgaataatgtttcctatacttgaaacagtgtagtactcagtaaatatttattgaataaatgtgtgaatgaatcttcacatgcttaagataatcatacagtcgtatccaggattctaataatctcagcctttctcccccacccaagataacacacctatctgaatacaggtgattgaaagacatgtctattattggactaatcaacttgaatatatattatttaagtggctaccgcacatatatatacacacacacgtgtttattccagcactttatgtgtgtgtgtatatatatatatgggtgtatatatatatgtatatatatacacccatatatatatgtatatatatacacccatatatatatgtatatatatacacccatatatatatgtatatatatacacccatatatatacacccatatacacccatatatatatacacccgtaaatatgtatatatatatacacccatatatgtatatatatatgcaatatatatacacccatatatatacacgtgtgtgtgtgtatatatgatagccacttaaataatatatataattatctgcaccaaattaaaacatatttcagaactagtattgtaacaccgtggttaagacttgtcagagactttaggtgctataggagctcagtgaaaacagagattattatgagctgaagtattaccaagggccttcataaaggcaaaggaagaaaaattaagaaaatagattgaaaagctacagataagccatgaggagtaggaagggaagaataagtatagagtgggcaggaagcagtgaggatgcagacctgaagtggaggatcattgctggggaacaaagggaggcaggcttgggaagacgaggtaggattggtttattgcaggctataggaaccagtctgaagcactcagagtgatccagagggcaacagggagctattgtagagactcaagcaaagtccagtggaaaaggtgtttgtgagatctgtgtatgtatgaatgaatataaaaaagacagggtgaaaaagatgagcagggcaagatttatcttttttatagaccttttctaaagaggtggcaactgaagcc

SEQ ID NO: 6313 - DNA, 1870 bp, artificial
  synthetic oligonucleotide
tgcacagacctgtgatctgcagtttcttatcagcataaaccatgcagagagacctatggggatgctgatgctgcatttataaaggggactaagggaaataagcccagtttaaggaagtataaactgtggtttctcactcattaagtcattacttatattctgaagccccaaataaacttggtggaatttggaagaaccaccagagatggagttaaagggagggggaagggaagggggagctcattccttagtaagaactctcttttaggtgaaaatagaataagaagtcaacagagaagagatcagaaatgtgtctattcctaggtattgagatttaagtcaaaatcctgtgttcatttaaatttcatatggaaacatgagaagtcctcgattaaatacttacatggtcataattagtctatcagttgccacaataattctgcatagcaaaccacctctaaactcagaagcttgaaacatcactttttttttttttactcacatgtcactcatctaggttggctgcagctgggcttggctgcaagctgttggttggatccagatatgtcacacatttcttttactctctttgaaatggcaggatccttgggcacgtttttctcacggtgatggacgaaggacaagagggcaggcaaggccaaccacaaaagcatattccaagcctctgcttttgccagttccacctagtcacacggttaagcccagagtgggggaccacactccagccaccactaggtcaaagcaaatcacattgccaactccatcatcaatggggtaggaaagtatactcctcccacagaggttgaggggaagggtcaagggaatgaataataatgtaccagtcagtaaaaaaaaaaaaaatgtgtgtttggggcagcatgtatttaaattaagaaggcagcataatatggtggtaaaaaagcttaggctatgacattagtcatatctgagttcaaatcccagtatttccagttagtgtactggctttatatgcccaatcaccatcttttatgtgccaaacttgggaattatgtgtgaggatatactcaaaattaagcagaatgtttgccgaacttaaggcatcaccccccaaaaatcttaaacttgctgtagccaagaagaaacaacatttttatgtactgaagagttccagttaattaagtttttacttttttctttcttccaaaacaaaaatgaatcatttcctatgacaactaaaattactctaaagagcagaatttagttttggacccaggtaatttggaataagcacatgctagacttttttctctcactgaaattaatcataaaacctggacagaatgcatgaaacatctacttaaggactctgaaaagtaaataactgcagggaacacaaggaagaacactagaatttaatataccaccaaccctgtggtgagtttaccacattccccctcctgtacccactggtcagaaatcaagccagccagaaacccaaaagtgagtattgtggtacagatagagaaagccccagaagcagctctctaatactggctcaagaacaggaaactcctaacactcataaggtggaagaaaactagccttctttcttatttttattgtgtcccatcctctaggcaatcctgcagctgtagcaatgacagtggcagcagcaggtactggaaaactgctggggccaaactctaaaagaggggaacctttctctccatttggttaagctgcagctccaagagagtagggccaagtcccattactttgtattctctctctgccttcttgctgcttggctctagcaatagtacaatcatgaaagtagatattttctggccagaagacaaaaaaaaga

SEQ ID NO: 6314 - DNA, 1777 bp, artificial
  synthetic oligonucleotide
catacaatgtgttaaggagccacccaatgatgaacagattaacaggaaacagaatgggtggaggataaaactgcaagacagcttaggcttcaaaggaagagctttatacatgacagtggagaagcagtagcttagaagtggcagtgggtgaactaggagaataccgataccatcctgaggaactgtggggtgtgggagcaggaacagcctctctattggagaggaccacattattcacaggggagagccaaaggaaaaaagctgttctagagagaggctgaggacatagaggaataaaaaaaaaaaaaaaaaaaaaaaaaaaaaaaacaaagaggctgtcagaaaggttaggagggagaaacagtgacattgagccaagaggcaaacacaagttcaaacagattccatagcattttgttttctgggtcagtttgtgtatactatttaattactgaatgttcttgtctgctattacttactgcatgaagtctttccacgagtttttgatcaccaagacaatttttagtgtcaaaccaagaatcaaagtcctgtagaggggtggaaattctccaatgagtgcacagtttttttaaatatacccgatattctgtagattcttatacaaccaatacggaaataatgcatttaaaaagtactttcaaaaatattatcagctgtgatagctactattatttacttctgaaaataggtaaaatactggagcagttaacaaaatttgagccccactgtgtaagaattccatcaactttttccttaaaagacatttattaggcttccccatactgtagcaatattatatctagtttgaaaagtagaatataaaatcaaagacataatgctaataagaatgttaattttaccaaacaataaaacaaacaaaagcaagataaagtgtgcaaagcaacttatggccaaacttgctactttttattatcaattaacagtcataatggggccaggtacggtggctcacacctgtaatcccagcactttgggaggctgaggtgggcagaccacttgaggtcaggagttcgagaccagcctgaccaacatggcaaaaccctgtctctactaaaaatacaaaaaattagccaggtgtggtgacgggcacctgtaatcccagctactggggaggctgaggaaggagaatcactttaacccgggaggcggaggttgcagagagctgagattgtgccactgtactccagcctgggggacagagtgagactccctctcaaaatagtaataataataataatgggaaaaatcaagcaccaaagttcttaaatctttccatttagtttggtgtcctagcataaatttgtgttaatgataaaaatatatatatataaataacacatttacacaatatgctgtctttcaaatcacatactctgagctctttagcactcaccaaatgtcaatgcctacaataatcaaagatcattttatagcttccacctgccaaactagtatataaaaatatgtttcaaaccccttcaacttaatgaaaataaaatggtgaatgcactactatggactcagcctcacatcataagttttaggagtaatgtgatagagacaaaattgaacaggcaagttgatctcaaagacaagaagcatactatttctccaaagatcctcattttaaaactctattaaagaactctttcctaagaaaaccaaaacatgcagataaaaaattacaaattaaaaagtaccataaatttcaatctataatgttttaaaacacatg

SEQ ID NO: 6315 - DNA, 3925 bp, artificial
  synthetic oligonucleotide
tcaagacaatcatgactttacttttgtccattttgaaattttaaaataataatcattaataatagtaactgttcctcagatagcagctagtggctgtgtggcagggactatgtgaggcaatttgcacacatctcatttactcctcacaacaacgctttgagttaaatacagttgatccttcaacaacatgggtttgaactacacagatccacttatatccagatattttcaaccaaatgcagatggaaaatacagtattcacaggatgtgaaacccacgtataaggagggccaactgtgggacttgagtatgcgtgaatttgattatacacaggccatgccagaatcaatcccccacagatctcaagggacaactgtatttcccatttaacagatgagcagatggagaacagcaagttgaaataacttatttaagagcattcaactaggaggagagctgagattccaatcttaagttggcttaactcccaactctgtgctctttctactaccccacaatacctctataattctatagaacttgatgaaatatacctttagataacttcttttagcccatctaatttctagtttgtacttgcaggctgcccctttttcttcatttgaattctcttaatccattttgagagggtatctttcctcaaacactaacctctttggttagatcaggtatgcctggcttttttgtttacatttcttttcaaaaccttcagatttttttgtttgtttttgttttttgttttttggtttttttttttttttttttgagacagagtctcgctctgtcacccaggttggagtgcagtggcacgatcttggctcactgcaagctccgcctcctgggttcacgccattctcttgcctcagcctcccgcccagctaattttttgtatttttagtagagacggggtttcaccatgttagccaggatgatctcgatctcctgaccttgtggtccacccgcctcagcctcccaaagtgctgagattacaggcatgagccaccgctcgcagccaaccttgggatgtttttaatactccatacacattaatgcagagcttctagtgggatatttacattttttttcaggcttcctgtgtatttatgtatatctttaataaagatatgccttttgagtttttaatgatttttaaattatacagcaatgacaagtgcttttaaaaaaattaaaaggaaatttaagcagaattgacagataaggcagaagttcttcaatccctgttctgtctcctactcccaactttgcctaaacccccattccccagccaggccactacccttaggagtttatatctttctagaccagtgctgtccaatagagctttctgtgatgatggaaatgtcctgtatctgtgctgtccagtccagtggcttctagcagcagggggctattgagtacttgaagtgtggctagtgcaactgagaactgaacttctaatttaatttaatttaaagtaatttaaattcaaattccctatgtggctagtcactattgtactggacagtgcagttctagacctttgtatatgcttttttgttcactcatagacaaaatactgatttgtgtgtgtctctatatcataaacggtcttatatgtatgtgttggtctgcaacttgatttttttttttaactcagcagtgtgtcttggagaacctcccatcttattacataaagacctagctcattgtactttttttcaaattcctaattttgtcagtaatttcctttactaaaatggatgtgtcaggttgtgaaattctttggggttccccccctcctcattatctttgatttgccattaagtgctgtgatcatgataacccgctgagaaaaagtttgattttattgagtaatcaccccatgttttggattcttgggcatgctatgattagaggctttaaaaaccacactatattttcaccaccattggcaccaatgactgttaacaaaggagccaagtgcaccgtggccaattaatttcagaagactttctgtgggctggctgagatagagctaggatagggttccaaccctgcacttggtactgtgatctgttgcattggttctcagacttcagtggatgtaagaattgcttagagagctttaaaaaaagtgtggatgcatgtgtcctcacccctagaggctgtgattagtagacccaggcagctgtgcttttaagacatactcaagttgattctgtcacatatctagtatattggaaagagtcttaaactagtccagatgtcacctttggtattcactgtagcagtgagcaagtttgttgattgttttgtatcttaatgttctcaactatcggaacaaaaatattccttgctttggtagccttccaggttgtgaaaataaaaagacatgtgcaaaatacttttggaaattaaaagttgcaaagttttgtaaaagtataaaattcatcttaaactaatgctatactatggaccctggtgatggtaaagtgattgtttgatcctcggttctctaagagttacagttcaaatatgtgaaaaacttccccagtctgagatacttgactcagctttgatgttcttattttcaacattttaaaaaatttttatttcacttcaagttgtgggatacaagtgcagaacgtataggcttgttacataggtatgtgtgccatgttggtttgctgcacctatcaacccatcatctaggttttaagccccacgtgcattagctatttaaccttaatgctctccttcccctcgccccactaccccgagtggcctggtgtgtgttgttcccctccctgtgtccatgtgttctcattcttcaactcccacctataagtgagaatatgcggtgcttggttttctgttcctgtgttagtttgctaaggatgatggcttccagcttcatccatgtccctgcaaaggacatgactttttttattttttgaggtggagtcttgctctgttgcccaggctggagtgcagtggtgcaatcttggctcacttcaacctccgcctcccgggctcaagggattctcctgcctcagcctcccaagtgactgggattacaggcacccaccaccatgcctggctaattttttttttgtacttttagtagagacagagtttcaccgtgttggctggggtggtttcgaactcctgacctctagtgatcctcctgcctcggcctcccgcagtgctaggattacaggtgtgagccactgtgcccagcctgatctcattcctttttatggctgtatagtattccatggtgtatatttaccacattttctttatcaagtcttattattaatgggcatttgggttggttccatgtctttgctattgtaagtagtgctgcagtaaacatatgtgtgcatgtgtctttatagtagaatgatttatattcttttgggtatatacccagtaatgggattgctgggtcaaatggtatttctggttctagatccttgaggaatcgccacactgtcttgcacaatggttgaactaatttacactcctaccaacagtgtaaaagcgttcctacttctccacagcctcaccagcatctgtttccacatctttttagaacctttgctgcatgtatcaattttttttgacatgaatttttgtgaaatttcctagtctaaaaaagaaaccgatatctcaagttaaaatctgttagttatgttaattttggcattggtttgtatgaagttttaatatttaaaaaaacacagctatatcaggaagctgaaagtgctgtgtcaggtggaaaatttttttatcagtggagatgtgtttatacgttgtcatggttttactctagtctaggacattttgtttcagccattttctaaaatggctgtaggttccatttattaatatatctctg

SEQ ID NO: 6316 - DNA, 3440 bp, artificial
  synthetic oligonucleotide
ctgacttcccttcccttgaaaccagctctctcccctttgctagtactgtcccaatggctgggacccaggagggtctgagtggttgtctattggccaggggtctccccacagcctctggggggagcaccaagtgtgcagatccaggagccctaccttcctctggaacactctctgcacccagtcttcttcttccctgaaggcaccaccctggactatttgcctgtggtggtattgtgcaagtgtcatgccttgccaatgacaccagatggtaggctccctgaggataggctggtatggtgtatcattcgtatcttacattcgtatcttttgctccctctgttacctgcctgacaggagtttctgtggaaaaagcctacccacttcttactgtggtggtggctcacttcgtgttcaggtcttgaatagagaaatcaccggccagctacctggaggcaggaggtgccagccccaaccactgcacctttctgagaagccaggcagtgttcccagagccacagcagggccaaaaagcaagagcagagaaaggaggtggcctgcgatgagaggcaggcagagctggctgggcccctcggaggctcctgggctgcatgccatcctcctgttctggagggtttggaaccacttagggccctgtgcccttgccccaggaaactcactgccctgccttctccttctttctgctcccacctccctgtgactccagccatggtcctggcgttagtccacctggtcttggccttccccttgtgtggtgccaggcaggcagcaatgacagccagatcataggactgtggcagctggaggtgggagctggcagccccaggagacattgacacagaggacaggcagcctgggatggggctgctggggcgtggttggggaccaggctaggggcggacatgggcactagtgccaagtattggcaggtgagggcaaaaggactcccctttcctgagctgcagggaggggtcgggtcaggtgctgtgcttcctcctttggtgcctagcggcagggagactaaagtgaagcatgtccgtgcctgggacagaaaggaaggctggagccaggatgtaagagaaccaagtctctgggggtgggatggaggctatggggagggcatcctgtgcaggggaggagaccagccaggaccttggggttagggaggagaagaccagcccagcccggctgggcccggccctgcctgggggaggctgcctctgctcacacatgcaggccgaaaggagcaacagctgggctccatgccgccaccccctccgcgcactcctgcctatgcaacaagtgtcacgtctgcatgttggcacatcatccccggtttcccgcgcccctggactggcgggaggctcccagccttcagggaccagaagacgttcaacatgggagcccagcccactcgactctggtcagttccttccatcgatccacgagggagcgggcatgtcccccgcctccacctctaccacgcggggtgcagggcgtgggacacgcggcgcacacctgtggtcctgagctcctgggactgcgagcgacggttaggagggacaaggtgacgggcaggtgatgccaaaggccgagttgagccccgcaaaagaagcagtccttgtggccagccgccccatggctcggggcgctctgtcaatctgctgcctggcgctggccggcgcgtggctgctactgcacggctcgcgccgggctccccgggaggcggggagagtgcgaatagggcggagggaaaggagcacgccggctgcagcccgggcgagcgggagggcgcgcactcacctccacacaccgcggtcaaggagagccagagcagcaggagcgcctgcacgcagagccgcagattcatgctgctccttgggccgccgcggccccggcgagccggcgcgggggaggagaggtcgggcgcccggaggccaagaaaggcgcgagccgcggctggcgcgtgcgggcgcagagctcgggaggctccccggccgctgagtgtgcgcgctgagccccgccgctcccgctggccgcctccgctcttctgcagcctcctctcccgccgcggggcagcgccgcgaagctggcctcggcggctccgggagcggcagcggcgagctctttcttagcggctggctgctcggccgcggctgcaactgcccgtgaccccggctgccagagagaatgctccccgctcactccaggggctgcattttgtagcttgtggcttggccgcgagcccacttggtcatgtggtcatcgggagggctagagggggggcaggaagagggagagggagcgagcctcccgcaccgcccccctccaggcacgcactctgcagccccagcccgagcgtgagcgcgagagggaaccccgaggtggccccacaacaaaggctgcgcggcctctctgacaacctacaaccgctccccggacaatgcccgcctggccgggggccagagggtttgcagagacctgaaggatttcaaacacaggaagcatttggggcggtggaggggcacacttaaccctttctcaccttgcttccttaacagctgtcaggaaacctgggcgcttagggaaggactcagtctgggttgccttcactcacgccctctacctctgaccctggtccttgcccttgccgctggccagcttcaagggtttggtcaagacaaccaaacactggccctcctctctcctctgcattttcaactggctttgaattgggggtgactgcctaggcttgtgcccaaggcttgattaattgcccaggcccctcatgttccctgcatcccccaggaggcaccctctacctggaatgcccccaccccacccttccgtgagcaattcattctttgcagcagcacctcaaatcccatcgcatccagaagccttctcaggataacactaatccagcaggggccgcccatcagctcctccccactgttgggacatgggacagctcctatggtctaccctttcttgttccctggagctgtcctcattctagttccccatcaacgtaagaggcaggtggtttacccaactccacacagtcaaggctggattcattttgcgtgtacttgcgattccgctttagaagcgggtcctgaagttgtttgcctttccagactcgattgttagctgcttctatagcttgggagctcccaaggcatggggctgcttccctcattggactgggaaccccctaaggtaggatactgtcttctcactcttctggatctctccaaagtccccaatatcttgctctgcacataggtggcactcaacacatattaaaagactgaatcgaaaggtgtctccacctttcagcaagccaggcagtttgcttgaagtgttaagtccagatttacacaaaagatacattggacagggtgcgtgtgtgccataaa

SEQ ID NO: 6317 - DNA, 2008 bp, artificial
  synthetic oligonucleotide
ctgtccctgcccctcctccaggagggtccacactggtggcacctgcagacacacactggggcattcctccccagctcatcagagaccccagagcttctagaactttccagtcagaccagcctgcccaaccccaggtagtgaataactggaggaatctgagattgggcctctgagctcggccactacaaggcctggaactataagtgatcccttctattcttttgcctcagtctcctcttttgtaagctgaggataagaatgcctgcccagcttactcccattcccgggcctgaaatctacccaccccaccgcccatgaacatcaccatgacatgaaacagccagccaggggaactgcctctgaaaagccccagagaattcctgaagcctgatgatggtgggggacctgtggccatctggactatggtgacagctggagtaccacaacaggggactgggcgtcaccaagacttcacctcttggcagcttggcttagagaggctgtcaccccttctatccttcgcagctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctctgggttttgcattgtgtctgctgtgttgccggagactgctgtcacctgtggcttttgtggtgggggaggaagaagagagggtgaggtgggggtggggacatgaggctcctagaagctcagtgggggagcacgtgggcttgagagtatgtgtgtgagcatgcatatgaatatgtgtgcgcatgtgcacagatgcacgtgcacaccacgcccaaccagccaacctccag

SEQ ID NO: 6318 - DNA, 2195 bp, artificial
  synthetic oligonucleotide
gaaactacggctgacagagagaagggcagagtattccaggtggggaaatgcccagggtaagaggctggaggtggggtgtaggaaagagtaagcataaacctacattccacaagggactgccgtgtcagacaatgttccaagcactgtaggcgtactcgctcatttcatcctcacaacagccagatgaggtcggtgcttttgtcttcattccactaatgaggaaacagaaacctagagaagttaagaaacatacccagtttacacaatcagtggcagaaccaagatgggaacacttgccctgatgtgaagtgggcttcagagaggttcgataacttgccggaggtcacaaatccagagttgaacttctgagaaagcttccctcatgcccctgcctgtcactacatgccccctttctcccacagtaaccactatcctgacttacaatagcataggtgagttctgccaggctttgaactataattatacagggggaaccatatggtgtatatatactctttggtggccctacatttcaaatgtattgtatattacatttgaaatatatattgaaatatatattgttgagtatactcaatgtatatttcaaatgtaatatacaatacaatacatatatacaatacaatacatatatactcaacaatatatatttcaatatatatttcaaatgtaatatacaatacatatatactcaacaatatatttagtatatttcaaatgtaatatacatttgaaatgtagctctttccaagaggcccacacattcccctgagccatgaagtgaaaagggggccaacagtgtatggtaccacctcccccgtcaggcacgactcccaggaagtcctcactccaaagggaagccagcagaaaagccagccaggctcaagaatttcaactcaaccctgaatgggggtcacctctctctgaaaggcggtcaagatacttggggctgtccctgaggttggaggtaggcttggcaaaatgccaccctggagggccctgaaactcgatcacccaaagaacatgtgtttgtcctttccatctccctgggctgagagtagccaactgggcccaagacccagcaccatctctatagtcctttgtgattatctcctcccactttggactaaaactgagacagagggaccctcgcacaagggtctgggagccaaaggcctttcctcccagcccccagactgcagattaatgacaggaaaaggccttgggaaagagctgcaattagagggcaggcaggcagtgaatttactcttccccaacaaagccgacttccggccccatgcctgccctcctgcttgctttccagcctcaccagtccccagggtttcaggggcgactcttagcctcctggtctgcagatcaggctgagggttggtggagagaaggccacaataggccccatcggcctataaatagcagcccagcctgccctccttgggcccaggccagcccgatgcccaccctctctccgttccctcttttccatgcaataagaggaggaagttatccaggcagctgcatcctagccatacaagaggaggaaataaatggaaggtggaggagagaaggggaaagaaagggagaaaaagaggaaagaatagtgggaggggacaaccaagaaaggaagatggaggagatgcaggtgaaccagagtggtcaccctgtggtcatgcttcccctcccccacacccacctatggcccccttttcagctccccagggcaacacagaggaggctttctgacagaggctgcaggcaccccacccatcaggccccaatcgtgctagcgtctgcttggcctgaccactgacctagtttctcatcaactaccttgctgtgacttttaggaatgtgtgacccctgacccccaattgctgacttggctttggtcaagacccatcaagagtactaaactgctacactgcagtccccaggagttggggccaattatttgtgtgtgtgttggtgggggacaggtgatattgcccctgccctgggagtttgtcactggacacacacaacccctttagtaggaaagaggatgtgaaaccttcaacgttgtgtgggtttggggcttcagttcctcaagcccttatctcgggtgtctgcagtctatcccactctatctgtctggccatctgtgaaccctggttcctgtg

SEQ ID NO: 6319 - DNA, 2469 bp, artificial
  synthetic oligonucleotide
caccaaaagttggaatggaaagtgagctccttcccattccataccgtggtaaaatttaaacaaggccattgaagatgaaggttatccagtaaatcagccaaaacattcacaaaacattctcaaagcagcctctgtaaatgcactcttagctagggtctagagccatggcactagcctggccctagataccatgtgtatgcattttagagtcttcggaggtactgttcccctgagtctccccctcgccacccgctgaccacttaataccattttagtcaacaaggctaagtcccctcaggggatatgcctgtggccagagccacacttggtgcactttaggcatagccctggccaatcccagaacaaaagacccaaatgctgggaggggaggggtgacagaaagaattccatctctccagtatcttagggagggatttgagccgagaagggcctcaggcttgacagggaccagcagaatagcacttgcctgcaaccaaacctagtaagaatggccaccacaactactatttattgaaccctcacaaactgccaagtacatagcacactaatcccaataacagtcttatatggtaggtactattattatccccgttcaacagataaggcaactatggttcagagaaggtaacttgaagaggtcacacagctggttagtggcagagctgggtttggaatccaggtctggccaatgcccaagtccagctctctaatcactatactacccaacctctttcccacaaagagtgattctaaaactctcccagaagcaacagagacaactgggtcagggcatggtcttgctggaaactggctatttgccaaaatgtagagaggtcaacaggcgcccaaagtcaccctgctggctttgtaaatgccacagagactcccacataaaagtccagactcctagattcctaacctagaatgcaaaggagacatcctatctgcccatccccacagacatcatcccacttccggtttctgtcttctgggtagcagtgaggttttcaggatgccaggctaagggtgagcttcttggaggcagtgttgtggggatgggcttgataatggacccccgctgccctacccccagtcctccctggagggaggacaaataggcccattgatttgaaactctcccagagggcattagagtaatgactctggactgtgtgatgcctacacccgctttgacctgctgactgacccctgccctgggaggttccaaaggccacaaatctcagttgcttgtgggccatgtggtttgtggctgtttgtagtattggaggggagggggaaatgaggggggtaagatacactgcttctcactgtgctgggcttcccaagagaactagcaaggggtggacagggccccttctaaacactgccaagacacactgcaactactgatacgggctccatcatttatttttgaaagcaggagggctcctggctcatttgcataaatgtttgcactgcctgctatattttgatttggaagaagggcaccagggcacagaatatacataacagatttgtaactgggcagcttgatcctgtccctggccaggcgagccaaagatggcccctcaccctttgtgtctatttttgaaagcccctcttaagtgcaaagcccagcaccaaggatgggtggcaatagaaagacctcgccctgaatggggtgcttctaagccaggtgtgtaggtggatgggtagataaggcagcacttgacttgaaaaagggatgaacgggcatggtggctcacacctgtaatcccagcactttgggagacctgaggcatgaggatcacttgagcctaggagcttgagaccagcctgggcaacagagagaacttgtctctacaaaaaacatgtttttgagaattagctggacatggtggcgcgcacctatggtcccagctacttatgaggttgaggtggagggatcgcttgagcccaggaggtcaaggctgcagtaagccatgatcgctccaatgcactgtagcctgagcaacagagcaagagaccctgtggaaagaaagaaagaaaaagacaagaaaggaaagacaagaaagaaaaaaaggaaaagaaagaaagaaagagaggaggaaggaaggaaagaaggaaggaaggagaaaagaaaatggctggaagtctggattcctaatttctatcattcaacaaagaaacatttattgtcttctatgtgccgggcactttagtagacactgaggtgagatgataaatattgagaccctatctccatcattgaggtactcctaatctagcacaggtgatgaaaacacagtcaaatagccctagggcagtgtgccatcagagagaataatggaggcttgctaaagtagcactcagctagtggggtgggggtctgaagagacttggtgagggacacggttgcttaattgagtcttaagcatcaaccctgct

SEQ ID NO: 6320 - DNA, 2919 bp, artificial
  synthetic oligonucleotide
ctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatgg

SEQ ID NO: 6321 - DNA, 2538 bp, artificial
  synthetic oligonucleotide
gctcctggggtgtgcaggccccagcgggagggcgggccgtgcggcgggtgaggccgcgagatgcccagaggatacaattttggaaccatatgcccgactccgcagaatcctgggcgtaacacctggggtgactggagagtttcggcgacttcttagggaagtcgagtctaggactcctgcgggaagttggggtgggggacgctggcaagatatgagtcaggggaagggctagggggagaggggctggcccagcaagtgcaaagagagccagagttcgggtgctggaagaaagcccatgcctacctttcttcccctgtccaaagccaggctgctctgctccacgcgcccacttgaaagccactcaggcacgctccccttctatctcccctttgccctctctgacctgcctcaacatcaataccgccgcctacgtgggtctgctgataggaggctctggagagagtgcgctgggaattgttactctgtatagttccacgtggcctttttgggggtgggggcagcaaggcctaagccttggcagaaagcatcaagactgaaggagccccaggggatggggccttctaaagggcttgaggttgaaggacctactcagcctccagcatcggcctgcttctcctgccttgggaaaggatcatctcaggcgcaggactgggggacaggagtggtggtggatgatggccacaaaggcagctgcagattacaagttcccaaggaaagatcctgtggctggactggggcgccggcccctgagacctcctggatactcagaatcaagtccccaaaacaagcactttgtcttttccaagcgggcatgcttttcccaggggattccagatcctggagacacacagttctctgctggcctctcatccacgaggtcccctctcaaatttggggtaggttccggatgtccctaagccctctttaccttgactttgaaattcacgaatggacagacacgtctgcacacgcgtgcacacacacacactttcccattttgctaagagctcagtggtctgtaacctcagacagacctgggttcctattccagctcactatttaccagctgtgtgacttcaggcaagtcacttaaactctctgagcctcacttttcttctttaaaacagaacaaaaacaaaaactaggctgggtgtggtgactcatgcctgtaatcccagcactttgggatgccgagcggggtggatcacttgaggtcaggagttcaagaccagcctggccaacatggtgaaaccccatctctactaaaaatacaaaaattagccggtgtggtggtgcatgcctgtagttccagctactcgggaggctgaggcaggagagtcacttgaacctgggaggcagaggttgcagtgagccgagatcgtgccactgcactccagcctggatgacacagtgagactccatctcaaaaaaataaataaattaaataaattaatttttttatttttgttttttatttttatgggtacattgtaggtgtgtgtatttatgggttacatgagatgttttgatacaggcatgcaatgtgtaataatcacatcagggtaaatggggtatctgtcacctcaagcatttctcctttctttgtgtgttttctttttcttttttttttttccttctttttttttttttttttttttgagatggagtctcgctctttctcccagactggagtgcagtggcgcgatctcggctcactgcaagctccacctcccgggttcatgccattctcctgcctcagcctcctgagtagctgggactacaggaacccgccaccatgcccggctaattttttgtattttttagtagaggcaggggttcactgtgttagtcaggatggtctcgatctcctgacctcgtcatccacccgcctcggcctcctaaagtgctgggattacaggcgtgagccactgcgcccggcctctttctttgtgttatatacaatccagttatactcttttagtttagatttttttttttttgagacggaatttcactcttcttgcccaggctggagtgcaatggtgtgatctcggctcaccgcaacctctgcctcctgggttcaagcgattctcctgcctcagcctcccgagtaactgggattataggcatacgccaccacacctggctaatttttgtatttttagtagagatggggtttctccatgttggtcaggctggtctcaaactcctgacctcaggtgatgcgcctgccttggcttcccaaagtgctgggattacaggtgtgagccaccgcgcctggccctagttatttttaaatgtgcaataaattattgttgactgcaggcaccctgtagtgttatcaggtactagatcttactcattctaactatatttttgtacccattaaccatctgcacttccctgcccccagcctcacttttcttatttttaaattggagacaatatgaacctacctcccaaggctgtggcaaggactgaatgagataacaaatgtctatggcagtgtctggtgcc

SEQ ID NO: 6322 - DNA, 308 bp, artificial
  synthetic oligonucleotide
atttacccttaagcaaagggggaaaatttagctttcaaattaataatgcagtactagaatatgctggtagttttaaaaactagctagagtgacctagaagttcactctaaggaaaacgccaaaatttgcagggacaaagacgaggacttgaagggagagatgggtatctgaaaaagcaagataaagacttttagttacagtattgaggtgtgtgctgcaaggccatattctggagatctcataggaggagaagattgaagctttggttttgaaatttggtgatgttgctaaaaatgtggatgcctaga

SEQ ID NO: 6323 - DNA, 237 bp, artificial
  synthetic oligonucleotide
gatctctttagaacatcagattaatttcaaattggtttattctctaagtctgtgatctattttttgaatatgattctctttgattcaaaggcacttgaaagttttatttttagcatttactactggggatcaatgactttctggaagaaaaaaaaatagccaagtgagtgtctaggctcatacaaaaccagtgctttggcaagaagtaaaaattgtgtttatgatccaggaaatatt

SEQ ID NO: 6324 - DNA, 838 bp, artificial
  synthetic oligonucleotide
ttcttatgggctcccctctctcactctaatattccctttcttttaaaaaaaatctgttttccctactgactcatcggttataaatgtcttccctccttcctaagttcctctcttcccctttctccctttctctctcactttacttcactctttccatctttttgcactaatttttgtattggctcatttcagaacttatttcattctctttctgtcttgcatttattattttttgcagtggcatttcttattgactcttccttgttaaacatctaagtttttctctcttcatcgctttctttccttctctttttcatattctttcttaattgctccccccactgttttttacatatttatctctatagctctcttgaatatcttttattgttggcaccttcttttacatttttcctttttctccttctcttctttgtaaagtcttcttataggtttctcattttaaaactcttctctcttttttgttctgtcaatatctgtctctctttccttttctacttctttatatctttttttcttatattttttggtatactttattcttctggctccttttgtaacaatagagggaggcttagcatgactgactccatttttgcatctgactccctgtggtaatttcctttaggttaaaagcttctgctcagctctgcatgtatgcctgctaattgtaggaggaatttagcttatagttctatgtcacggcatgttagaagatagtacaacaggccaggtgcagtggctcacgcctgtaatcccagcactttgggaggccaaggagggcctgtgccaggcctcactctctctttactttgct

SEQ ID NO: 6325 - DNA, 1319 bp, artificial
  synthetic oligonucleotide
gcacatacaggttagaggattggatagtatcgcaaaggggagaaatggggactcaggtacacatgtgtcctgtttaagattggggcttctcagatgataatgccagtcacagtcagtcccagacactggaggggaacttagaaaatttcaagaaaggtacttcttacaaccagaatacaaggaggagctgctctggacccaggacagctgccctgatgatactgcctgcctggccagtgcttggctctggaaggggacttagaaattatccaggtaggcattccaaagcacaggggtccctgaggaggagccccacttgcctggatctaaggctggtattgatttcattgtttaaatcttgcctctaggtcaaaatggaatttctgtgagagaagggagtgcactttacttctttgtttctctgcctcccacttctgccttcgctatagaacctgcagactgcaaagaaagaaagtggactgcaaagaaagaaagtactgcagcctgaggggttctggtaatgcagaggcagttgcagcagcagtagcaggacttactcccaaagacttcaccatgttcaccacacaggccagaagagcaatgcctgtacacatgtccttaaagtggccctgaagtcccctgggtggctctttgtctctaagatgctggatgaggtcaacctaaatggcaggaaaaacccaggattcccacagaagcagaacctcaggtctgacaggcacaataagagggagatctggagctgggcaggcagatggcacatggacatcccctgttacaaaggcagcccaagcaagctagggcactacccagcctctcacatgcctttttatcctgtgatgtcaagaccctgaaaatgtttgggaagaaaaaaattctcccaagaggaagttttatttttatgaaaatatttacttttagccctcaaatgtcatctcactcaacttgcatgtacacacacacacacacacacatacacacacgtactctccccttccctccctcccacccatggctctcatatctatactctactctcctccatatagtagttatgtgatgttgaagaaagtttcttaatatctgtgtgcctccatttcctttttggtaaaagtggggggttaatatctgtatgcctctatttcctttttggtaaaagtgggggtaaataatggcatttagctcaaaggacgaaagcacagaacagatatgaagacctctggcgtgagagatagtactgataggtaagtttccttccttccatttaaaatgtgaaaactcacactgataaattcactaat
